United States Patent 10,407,724 (METHODS AND COMPOSITIONS FOR SCREENING AND TREATING DEVELOPMENTAL DISORDERS) - sequence listing, part 61

SEQ ID NO: 1685 - DNA, 548143 bp, Homo sapiens
cagttaccaagctcggtgaaggagacaagttcccacagctgactcggctcggctctcccaccttcccggcagcggccgcgagccctgattgtatccctcgctttcctcgtgggggagcacggactgacttggctgaagaaaatgccagttctgtggatgtggccgtgacaagaggacgtgcggctggaagaggcagaaggggacgaggaaaagcatgctttgaagagaagaataaaccagcgaccccaaccctttctgcaaattggtgctattacttgtgggatccatttgctttcattccctcccaccccaccgctgaagaaaccttgccctgagggctgagagccagccccctgcagccgggggacgcttctgggttggaggaccttctggatgtagcgtcggtggaacctttagatactctcctctggaaaagccaccatgaattcggtagctgggaataaagagaggcttgcggtctccaccaggggcaagaaatacggggtaagttgtgacggtacgacgcggagacgcgttaccagacccatctcggcggaggtccccctttccccgggatcgtgcggccccggccccgagctctcccccgctgcagaggcgcccccggggctggcggggttgtgagtgcgcggaggcgggtcggccgcggggacgcccgcacgctcgcctcgctctcggaattttttcagccctctcgttccttcctttccacgcacccgtaacttttgccgcattcctgcacttctaggcagagtgaagccgaaggggagggtttcccatgaatgctgggcagtacctcggatcgtttagctggagccgtgagagcctctcgtttacctgcaggatccggagagttggaccccgtatgaataaaaatcctgaaatcacagccctccccctaccccccccatagggtcttccaggattttgttcccgggatcttgctgggataggtgccggcttcaaaagcgtggggcgctgaacctatggatcccccccgccttgcagaagccgtggaaacggccccgagcgagtccccttcctgaccccaggaggaggccaccggggaccagcgcaggggtcacctgggcggtggggactcacttaaggacaattaacgagacagacggagggcaatttggccgcagggcttggagaggtccccaaccgactcccgtgggcggttcgagcgggtacttggtggcgcacgtatgacccagctcctgggcgctgcagcccgccgccttgcagcccctgacaccggcgtgtcttccccgcaggtgaatgaagtctgctcgcccaccaagcccgcagcgcccttctccccggaaagctggtaccggaaagcatacgaggagtcgcgcgccggcagccggcccactcctgagggcgcgggctcagcgctcggctcctcggggaccccgtctcccggctcgggcacctcgtccccgagctcgttcaccggctccccgggacccgcctcccccggcatcggcactagttcgccgggctccttgggcggctctccgggcttcggcacaggctccccgggctccggcagcggcggcggctcctcccccggctcggaccgcggcgtctggtgcgagaactgcaacgcccgcctggtggagctcaagaggcaggccctgaggttgctcctcccggggcccttcccgggcaaggtgagcgccgcgcggggctggctggggaggcgccgggagggcggggccgggccgccacccacagcagctgctcagcccgccgcgaccttgcgcgccggctccacgcgagagcccccggcggcgctggggatgctccacacctcacggggctctagcacgcggggcgacccatgccccttcctcagccaggccgcccggggggcaggaggaccgagtcccgagcgcgaaggggcgcccgtggccacaggcctcacggcccacgggggaggcccccaggtggtctctcctgccgccccctcccagctctccctggcggctgcaggctgcgctttcgatgtttctccccacccccacctgtgatcctttacaaaaatgtcagcgggagctgtaaaagcaagctgatgctcggagctggcatttcccactgcctgtttgtggtccatcctttccgcggttgcagaaacagaaacatactcgaaagccagcattttccccttctcagtctgtgtgtgtgtctgaggaagatccggaggcgggtggctcttcggagcagtgctccctcctggcctgctcctgcgccaagcacactggttcctccatagcaaccctgcccgcagtgtgtgactggcccgagcccccaggggatagcaatgcgattgtatttgcactgttgggtccaagtactatcaaatgatcatatttactcggccacttcaaagagtttttatcagtggttagagagcaatatcaaggaaatagagtggattgctgtagaggtttttgacactgttggttcaacgtcaatttctggtttattatttccgtgactttagaaatgaaatactgtgatttcgagtaggcgtttaggaatgactgcgtctgctggcccaacctgcgtatgcagatacacacgttgatgttttcataggcaagggttaaattcaacaaatgcccacagacgctgtgaaacttaaaatgggggaaatgaccaccaggagaattggttttatgaatgcagaacttatctcaagaataatgaactcgtggatggttgtcagtgtaccgtttttgtagtttgatacatctgccgtgacatcccaaggatacatctcaaggaatcaaaaagcttatttcgctcttgcgtgctagaccttccgatttaacaccgtttcttcattcacagatttatttgctctcgtgatccttcatcaatattcattgattttctactccatccgaggcactgtgtcaggcacagcaatgaaaataccaggtccattcatgcagtccttgtccacgtggagcttagattctagtggaggatacagataacaaccacaaaatgcacagttcacaatgtcttcacatttgtggagggaatgtagggtgctgtgaggttgttgaactggatgggagcatctgataaagatggaaggaccttggttcttaaagatctagtagctgatatttggcagtcctaatacgttacagcctaccaaattattttagacctttcttgaggacctattcttataataggcttattgtggctttgggtgttcctatatgcaaaggccgatcaaaatacactcttctcatttaaaaaaagaggaggggaaggaaaatctacagaggaaacaaatgttgaaactcatacgcatccatcatgttttatggagtcctgtgaccagctggaatcttgtttttatagaaacagcctggaacattcacttacagtgtcacgggaggcagctcaatatatttgccaattttatgtatgtgataaggtaaaactcttgttggtaaactgattgtattgtcagagtgaggtgatggccccagaagaaacactggatttgctgaacccccatgctctacaatgacttcgagtgatccaaggacatctagagaagacctggcagtcatgggggcagtcacaggggatcactttaagtgcatacgtgaatgtcacatagtaccacagtcgcctgagttttatatgtgaagcagcacagtaaagcgtgacatttggtgcaagggcatagacagggctcagccaggaagaaggatgctttgcatcagctcattgttagtaatgagatgtggggcctcaattttaactacaaaatttctgcaagcctttgtgaataataattgtgtgtgtgtgtgtgtgtgtgtgtgtgtgtggtgtgtgttttaagcatttgtaccttgcatttaggtacaatttccattatacctttagcatttgcaaccttatagccaaacagttgccatgttctctggtgtaccatggatggaggccatgtaacttggataagacttttcttcttcccggagcaatattaatgaacaaactgtggaccactgtagccctcaggcacagaaggagttaagtttcattagaacaagaggtgtcactgtgactccaacatgcagttcgctcagttcgctctgaagagtaagagtctggaagataaagacatgtttttgaggagtaattaacaaaaatcatctgtgtaatttgcttaagatgcttacctgcatttgggaaatattttcttaaatagagtgttaaattctactaggtggtattaaatgtctcctaggtagatatttaaaagtcaaaagcagaatagcacatccaggaaccttaatattttaggatggatttggttttggttcttcttcaccactgatttactttgtgacattgggtaaattagttttcctctctactttttaactttcctattaatatcctaaggaaaaaaatgaatgagactattaaaacgtcattaaaatgatccaaggtaaggtctgaaaagtgctttcattctttagagaaagatatgagggttgatgattattaatgagctaagattctgttagatttatgttttacagaatttaaggtttttcttataagatattactcctgtcagtttctaatttcatctgtatattttctaaacatgctgccatatgagttctcacactgtgcctgttggtaggtagcaagccctattgaatcccccgttctgtctttggaacagttggttaaggaggggaggtgaagtagtagagagcccattccgggtatctggttggttccaggagctagtgcctggctctggtggcctgagaagaaccatcttattctgagcactccaatggaggatagggcttcatggtagaaaatgacattatttgaacgtaacggagtgggtgatagtgttggctgaggtaggaaataggaggagacatggaattggatggagctcagagggaaggatgatcatgagtttggttttccatgcagcgagtctgagctttctggaaagagatggaggcagatttaataataaaacactttgtttttggctatctcaagactggcgtgtagaagtgacagctgtgagctcacatagctctgctgttgatactctgtattcatcctttccgatagcaacttacctggtgagtagacgtttgtgcttggtggcagattgtaaaacactcagattgacttttattaccttgatcagtacaaaaagtacttactgggtttatatcgtttctcttttggtgccggtgagtggaagtggtcggataaaagaatgtggacgtgtaaagtgttgagattttaagtgagaatggcccttttacccactgtagccttccagtgtgtgaatacaaaaccatttcatgtccaatggcaagagcatctttcctgctttgtacacagtcagggcactgagccagaaataggggccaaggaacgaattgctcaattttgggctagcctagatcattctgatatctgtgacagaacttttgaatggactgggcaagtcctacgaaacaacagcccaacgaaattccctggagtaagcagtaaagctccaggttggcaaaaggttatcagacatctgttcatttccatatcaataaaagaaaatcttttatgtaaaaaaaaaaaagtgcagaactatgttcctatctgattgtctctcagtcagatattctgagtccatttatgccccagaaatatcaggaagattagccagacatactgagaagggtggccaggaatcacagagatgaaagaaaggaatgcgtcataggggttaaaaacgccaaacgtggactctaaatagccggagaccaagtaagtctagacttgaggagatatagatatccccacatgcatatttctgtattttgccagctccaaaagaggggtatggaaaaataactagacgcaaaaagtcccccaaaagccatcataaaacattttatagataggataaaacagacattgcatttcgagtacttattaattataagggacttctagctgaaatcttctctttcttctaagaacatgtggctattttcaaaaagcttcatttgagtctttctcatatcagaagtattttagataaaggagcagttagtagataatagcagtcatgaaaaagtcctacagcatttatcatttgaaaatttctgaaacattttgggagtttataaaaacattcccaggagagacatgtgagcagtaatctctttttaaggcttagcaagctgtggaataatggcagttcattctaccagactattaattgtgaagcaacatggtcagtttttatagtgacttaattcactttgcaaaaatccctggcctgcaataattccttccacacccattgcagataggattactacattagaaatgtgatttttaaatggctgaggctggtagtttgtcagcatttggaaggattaagtcaattaaaatggaggcaacatcagttgccatttgttatttggcattatatcacagattgtaccatgagtgggccaacaatagcgatgatagtaataataataatatgtaataaatggctaacaacgattgtcctacataccacgaactacactgaaacacacacacacataatctcatatattaaaatgaagatgaacgtgattttttcttttttaccctggaattccaagtgcttgatgtggttaagatcatagaaggaagcatgaagaaaaaatatgcaaggaacagagaaatccaatcacactttcccctagaagctgttaagggtccctgtgagtagaactgactgagtgagaggcaccggctcgagatggttattatttttcctgggctcacagatgagaattttacttccagtgagtggggaggttgggggaaagtatgtgagactgtcaggttctgagttgaggaattgtcttggctggaatgcaaggggcggggggaaggaacctccttatatttacgtgcacccattggagaccctgttgtcatcccttcctgaacagaaaaccctgcccgagggccccgtcctgaccttctgcgaggaagagttcttcagccggccatttcagtgccccatcggcagggcggccagacctctgctctgttttgtcctcaaaaagattgcaaattggctggtgtctgggagggttcttggtcattttgcaggaatacaagacaaatttcctttttaccactctctgcagtcacaagctattcatcagcatcctttctttcctgtttctcgtctatggtgttattgtggcgaaggagcactgttgagaatgtgctcccaatcgctcttttatacctatagatgcacccatcagaaatatcttttttttttttttttttttttttttttgagacggagtctcgctctgttgcccaggctggagtacagtggcgtgatctcggctcactgcaacctctgcctcctggattcaagcaattctcctgcctcagcctcccgagtagctgggactacaggcgcccgccaccacgcccagctaatttttgtatttttagtagagatggggtttcaccatattggtcaggctagtctctatctcttgaccttgtgatccacccgccttggcctcccaaagtgctgggattacaggcagaaatatcttattttaaagtacattcgtgtagatgcaaaaggactggggatacacctgtattcctaatgtacttttgaaatatttgtcaagatatcaactcagtttgtatccatcattggcttaccattgcctttggaactgctccagagcctatctgagaaaattggaaatgagtgattgttaaaaagatgtttgtccacctccaggtctcaaagaactcacctatgttttcttctagtatttaaatagtgtcctttttaatatttagatctctaatccattgagagattattttggtgcaaaatgaaagatatagatcaaatttcatctttctctaaatgtctatccagttgtccccactttattaaaacattcttcttacttgcagacttcttcttgtgaaaaaaagaatttatctttctcacattaattgaagataccaccattgtcataaatcaaattttcagttgtatctggacctattacaggatcttctagaatgttctcactctgttgtccaggctgggttacagtggcacaatctcggctcactgcaacctccgcctcccaagttcaagcagttctcccgcctcagtctcacaagtagctggaaatacaggcacggaccaccatgcccagctaatttttgtattttcagtagaaatggggtttcaccatgttgtccaggctggtcttgaactcctgacctcaagtgatctgcctgccttggcctcccaaagtgctgggattccaggtgtgagccactgcgcttggcccacactattttaattatggaagctctgtagcatgttttcatgtttggcagggctagctctctctccctcaaatagtgcctttcttttctaggagtttccttgcctaactccaatttttttttttgttaggaccgtgttgaatgtatacattaacctgggggaatagttggcatctttatggtgttgaatctttcccaagaacatggaataccttttcatttgaacaagtctactttttagcaatttttaagagtttcttcatataggctttgcacatttcttgttaaactttttcttaggtattatagcttttgttgctattgtaaatggagtcttcactttcattatctcttttaattgataattatttatgtgaaggatattgatctacatgttttatatcccgtcgccttattaaattctactatattcactgatttttaaaaaattggtactcttggattttcaaaaaattttgtcttcttcaaatacagatatcattactctcttcctttgctatttttatgcctctaagtgttttctcttttttgttacattggctggtactcctgacacaatgttacataatagcgatatagtgggcatgtgtatatatttttttctattaagatgttggcttttggactgagatctgtctatattttttaaagttaagtaaatatccatcaattcctactttagtgttttattaggaatgggtattatattttgccaaatgtcttttcagtatttagagagagaatcatgcaatttttctccttagatttgttaatattgtgagttattattattgattttctaatagtgaaccatccttgtattcccataataaaccccacttggccacagtgcattttgaaagatatgcttctggatccaatttgctaatatttcatttattgtttttgctttgatattcatatgccaatgaacatttttgattcctgtttatgtgccagttctagtactatgccacattataatccaaataggaaaaatactaaaattcctgccctggagcaactcacagtctagtgtcagagacaggcaaggaacgtggcgaagcgtaagcgttccagccacaggaaacggcaggcataggccaggaaggggtgatgcgtgccccctacatatggggaactgaagtcgcacatggtcaccatacacagtatttgtatgagtgcgtgacaggctggaaaggaggcagatggaggatgaaaggccttgtaggctataggctggactttatcctgtaggacgtgggcagccattggagggcactcatgaagggagtgaaatgatcagatatgcatttaagaaagattgctggccaggcacggtggctcacgcctgtaatcccagaactttgggaggccaagacgggtggatcacctgaggtcaggagttcgagaccagcctggccaacatggtgaaaccccgtctctactaaaaatacaaaaattagccgggcgtggtggcccacacctgtaatctcagctactcggggctgaggcaggagaatcgcttgagcccgggaggcggaggttgtagtgagccaagatgatgccactgcactccagcgtgggtgacggtgcgagactccatctttaaaaaaaaaataaagattgctgtgagaatgagcaagaagatgggttggaagagtggtgtcaccgagaccagttgggaggccccttgcagtggcttgagtgaagaatgacacagactgaactagggtagtacagagggaagggagaggcagctccggcctgacacatatcatatgtagaaaacccgccatggggagctgctgagatacggggccagagggagaaaagatgatgcattctcccaggtttctggccagggaaagtgtgtgggtggtgctgccagttatggagatgaagaatacaggcagagaaggggttttgttattgtgagcccagtgttcgaggatggctgtggatgttaaattgattggggtctctagagcttgaggtggaatggtccaatgggctcctgttggcgctctagagcggcttctgaggtggagatatggatctgggggatgtcagcgtagagaaggtgatggaatccacagacggcatgagctctccacagatgtgtggggtgagacgacagacagctgaacatgaagtggtggagaccattgacatcgaagggaccagtggcctgaggagctaagaagacagaccaagaaggagggaccagaaaagagggatgaaaaaccaggagaagacagtgtcatgggaactgaggaaggagtgagcttcagggcataggggtgacaaaaggtctgatgccctggagaggtcaaggaagtaaggactgaggttttctttgaactggcaaggaggaggtcattggatgtctttgttggaagaatttctggtgccctggagaaagccaatggcattgtgtccaggaatagattgagaggtgaggacatctcaggcagcatttgagttgctgaggacactgagatacaagagatccacttcttgaggctcttattatcttaaaatgaagaactacaatcaacagacttgcgtgcaaaaccaggctccgtcacttagggtgtgaccttgggcaagccttggtctttctaaacgtggttattctcatctctacagtgggagtcatgacagagccccaccaggaggatcgtgaggattaggtgaaattgtgagatgctagtcaaccatcgctttctgttattattccagtgactttccacaggaagttgaattttatataagattcctaccctccttccttccctccttccttccctctttccttccttttttccttccttccttccatctgacacgaaaatggagaaacagcagtcagagaaaatgaaagcattcagtgcgtctttgtttcttcacctccaagtggataaagcatctcattcttatttattcatttgtagagttgtcaccacagaaagtttaagggagctcagtggatgtaaatagcgactcctttgggttgaggtgccatgaatatggattgagagttttttgtcacagatggaaatcccttctttaagcccggcccctctcgtagcccctccagggagacttgcagatgtggcatttggcatttcggctccggggaatgagggagagcagatttcctccagtgactgcgcatgcgatgtgcagatctgagccgcaccaggaatttgggcttatctgccttccaatccagctttatctgtctcagacggttttctttgcagttgtactttgctgatcctatcacatcgattccaaccagaccccatgggaagtctgggaataaagaagtcaccctcccccaccaagcaggatatcctgcacatacatcagctctcagggctggaggtgaccgtggaggagagggatcctgtgagctctaatacaaaaaaccgagacattctgaacgttgctatagaggttagcaaagcagaaggctctgagggtagagtaagtattattaattttttaaatatgcagaacgataaatatgtcttaagtgttatagaccaggttacagctgagggactattttgattttccttttctacttattggagtttacgttcaatactgttgccaaccacaaaaagttattggaacaaattttagctctccacacagcatggttctaaaatctttgatggttcttacgtgtaaactttctttttatataattgtttttttttttgcttgaaagcatgagctgcaaataataaattaaaatccgcttttctatcacaggggtgacaaatagaaacttttattttgatatgtccttatctaagtgatgtctgaggtctgtatatgctaattcaggattttttttctgagctaacctaggaaccgatagaacttgagatttttctgcagtgtaattttgtctttgagttggcagtgatgagcagctacacttccccatgaaactctatcatcgtatttagagtggttgctttctttggggttataatcactacttcccaacccttcctccacctaactggtggcttcacacaagaatgggagactcacctattaactgattagaagccagcaataacaaccagcaccaaaagctgtcgagctatctaaccaaatggttgtacagaaaataaacagctgaattcaggcaaacaactggaagcagccaccattgtttaaaaaaaaaaatcacctgcccagttcagttgtgtaactttgcacagcagggagtctcagtcctaagcaggtggcagagtgtcttccccatggtaccatggctgggaattagagcatcaggtgtcctttaccaagacaggcagcgtggtgatgggggctgagggatagatgggaggaggatagaaaggagaggaataagaggggaggaggaggaggacggatgagagagagggcgaggaaacaaagaaatgggtggtatacgcatccaaggttgtctacaatcccagatatttaggtgaaaaaggactgtccttggatctggggacagaggtgcagtcctgcttccagcactgataagcattatgatcttgggagaatcacctagctggcctgtgcttgatttttcttttgtaatctaagagcatggtagtcggtgggctctaagcttctcccaagcctgtgagtctctgtgaagctgaggctttgggagtccactccgtgaacccagattccacagggatgtgcctggcaaaatccaagtgggtttctggctgaagctgttctgtgggctgccatgtttgtgggacatctcatctgcagccgccgcagcgacctccttgtccgtccagccaaggggagggaccggaagccaagcggaggggccggtagcgccgtcgttgctgatgcttctgcttttggaattcggatcataaactgacagggttcttcctgtttcttaataaagctatttgttttactgtctaatgtgtttctaagcagaaatagacaaacaaaaggacaattgattctagaagagagatttagtatggagtatttgaagaaaagtattgccttagaaataaggatgttttgtagttaattttacattaaaagttctgccatattgattaggatttagaaataacatacgaagagttcttcctgagtagcagtataggaacaccagaactctataaacattttattcatcattcttcatctgatttttttccaaaatctttttgctccctttgatttctctctttttttctgctctttcaaatgcctagacagagccatattgattaggccagtatttacatatcacatgcccctgacgtgggtttaatgccccgtagtgtttgatgctgtggtctgggaaagaatggaacaggtagctgcccgctgagtcaacgaggcccatgcagttatcatcgatttttatttttctctttaatcatttagccaaggttgcctctttaaaatatctacttcctgggggatgtttccctgactcttatttcaaatctaatactttgtatttgagtctaaacacaattcagggaatatagctattaaaagcagaacttgattttgtttaactagtccagagcgcgtgatggctttggagcagagtggagaacaggcacagaggagcacgagccccaggaacaccacttggtgcccctccctcgtccttccaccgagctctctgcacgtatcttaccagggcgtgaatggagcattctgcagccagacacatccaacccacagcaaaccctccatgcaagcttgcctgtgtcctcagacattctaccctttatttctcctcttgttctttgcccctaagtttgtccatgcactcgactttctaacgggccatggtgtgtgtgtgtgtgtgtgtgtgtgtgtgtgtgtgcgcgcaagcactttgtggaggccctgaaggcagcatgtaaggtggtaacacggtagacattctgccccaggtttcagacattgttaggctgaagcttttattggaggtcaaggcagctaataaagtgggccgtgcaattacaagagcattcagcagagaaggatggctgaccctctcggcaggctgagagcagaggaagcggttggcagctcctagtcctcccatgatggctttacaagcattttttgcagccggggtggtaaatgcgatacaaaggcatggtttcaatatatccaatgaggcactctgcttcctgtgtgaggcatccacttgggggaaggaagttgcccggctgtgggctttttgtggtggtggtttctgctaatttaccttttttatagagggctcataattattagggatcctccataatgcccctttatggtggtcaggaaggagataacaaaatgatgcagaggtttaggaggcttctccagggtcacccagaaaacctctggattctgaatctccttcaaagatttaagaggatttatttatgctgctctcttgcccatgtggatctccttgacactacactccgtgagcgtagttaatgtcctgtcttgttcactttgttttttgtttggtgcctgtgtaccaagtagatttctggtgttttgaaaaaaaaaatcacccgtccactgctgcataaccaaaacgtcactggtgtgaaggaagaggatgatagaggatgggacggtggtgacaaatggcgggatgggagatgatgcctgggtgagtcctggaaagtgccgtgatgccatcccactgacatggcctcctgtattccagcaaagagtgaaattcacagggagcacagagtaagagcagcgccttcacctcggtggagcttagtctaggcatttatgggtcggctggtttgagggtccttgcatttcttgtcagtcaatacgtccttgttttggctaagtctcatgccctcatatccacttctacccttgcagaataaagacatgtgggaatgctcactggatgcttacaattggttccaggtgttccagggacgaaacttatcagaaccaaacatagagggcaaatgtcttagccaattcatgctgctataacaaaataccacgaactgggtggcttataaacaacagaaatactgatttctcacggttctggaggctgggaattctgagatcaaggccccatcagattgagtgtcttgtgaggtctgctttttgattcatagatggcactgtcttgctgtgtcctcacgtagtggaagggactggctagctctccagggtctgttttgtaagggcaggaatcccaattatgagagctctgccttcatgacccagtttgctcccaaaggcccacctcctactaccatcactttgggggttaggtttcaacatgattttggggagaacataagcgttcagtctgttgcagcaagcatgaggtcacttgtctagacactgacccctcaggcagtgttcatgtttggtttaatttttccctttatctggtaattgattctgcactgtctccattatttggtgagatggtaacatgtgattacatcccaatggagttgggcatgagaataagaaagaaatctccctttaaaggctttggactaccttggagtttgaagagagtggaggaatgcagtgagctggttttgatcttttggtgaaagtgacaaggaggcaggatggtttttccacggacattgacagggtcgtgctggttctcccaaagagaaatagagtagagttcatcacattagttaagagcacctcttcagcacattatatctcttcagcacatcgtttaagagcatcgtctttaataattcttacatggggcccgcacggtggctcacgcctgtaatcccagcactttgggaggccaaggcgggcggatcacgatgtcgggagttcgaaaccagcctgaccaacatggtgaaaccccgtctctactaaaaatacaaaaaagttagctgggtgtggtggcacatgcctgtaatcccagctactccggaagctaaggcagaagaattgcttgaacccgggaggtggaggttgcagtgagctgagatcgcgccattgcactccagcctaggcgacagagtgagactccatctcaaaaaaaaaattcttacatgggacaaaaatcactatcctatgtcaattgaaataaaggccattagtttttaacactgtataaattgccttttctcctgggaacttcagcatattcttttaaattattagcattttataatcatagaacgatggcatagagggaacctacagggtgtccagcattgcattacagttccctgatgaagagcatggttcttggggtctggccatcccatcaggatttgtatattttgctctgccgcataccagctctgggaacctagagaaggccttaaccattttccgtgttggtttcctcgcttgcacgatggtgttaatcataataactgcttcacaggcgtgttttgtctgctgcatggtagtcattcattaaatgtgagtatccaagctcccatcccaaactgccagaagggaaaagtaaaacttacacttttagacagcgacctcctgactccagggttcattccatctcattaacagtcagttcattcatttttcatttccttatccatccacctgtttgtttatccactcatctacctgtccagcatttctttggccttcaccgtacattcgtgtgtctagacttggtggtggggatgtaaagatgactaagacgcagcccttgccctcaagtccctcccagtctggtggggggggtgggtacagaagccacgtggtaagtgcagagttaggacacttggggagcagccagcatggctccgggctgctggaacattgcatctttcttttcttacaggccccgcctaagaagtgtcatggctgggagggagtcggaaggggtagcttcctagaaggggtgatgatggagaggagttagtgagagaagactgaggaaggtgaggaatctcatagctagagaccagaaacggccttgaggggctgcaggaacccaaagaaatgcagcattgacagacaggaggtgtccaaagtgggtggcccagctgggcatggtggctcacacctgtaatgccagcaatttaggaggccgaggcgggcagatcacctgaggtcaggagttcaagaccagcctggccaacatggtgaaaccccatctctactaaaaatacaaaaattagccagatgtggttgtatgcgcctgtaattccagctacttgggaggctgaggcaggagaattgcttgaacccaggaggcggaggttgcagggagccgatattgcatcactgcgctccagcctgggtgacagagcgagactccatctcaaaaaacaaaaacaaaaacaaaacaaagagggtggcccaccacatcaatttcacaagaagtgaaataacaatgtaagatttatatgtcagttttaacaagtgatgataccgtgtaatacatcagtatagcagtacgatagccatgttcatagcagccttattcacaatagctaaaatgtagaagctacccaagtgtctgctgacacatgaatgactaagcaaaatgtggtatatccatgcaatggaatagtatccagccctaaaaaaaggagattcaggcacaggctatgacctggatgaaccctgaggacattatgccaagtgaaataagccagtcacaaagacaaatattatatgattctggtgatatgagatacttagtgtagtgagattcatagacatagaaagtaggatggtggttaccaagaattggggaagatgaaaagaattctgcatatggaaggtggtggtggttgcacaatggtgggggcgtacataatgtcactgagctgcacgctgaaaaattattatgagaggtcaatgttatgttgttttactgggcgcacacacacggaaagtagtataagttgtgtcacaaaattgtatttgacggaagtgatatccctgtgcactggtcgcccagtgacggctcatgagggtaatcatggtaatacgtacaatctggccaccagagactcccaagcacgttacaagcagtctcacgtttgatccaccctatgagacaggccactttacgggtaaagaagctcagtgaggttagatgcctggagacgcgggccggggaggctgtggtcctgcactcactgcacagcccttcctgctccccggcctccctgtgaggctcactgcagtcccttggagggaaaggggatgctattgagaattggggccaggtgaatggctatagagggatgcaggagtcccccccacctttttctctcctttctcttacttccacggaccttctgagaatagggctggccctggcagccaagagccccttagctcctccctctgcatttgccgtggtacgacgtgtgacacgggccagacccacgctgctctgttctgcaggactcagtgcaagacagctcttttatttgtgcctgtggtcgttagaaaagttttacacgggcagggcagtcgtcatcactaagtaaacacattgagccggcaaatcagtctttgtgagagcagcacattaaatggttccctgcatagtagttactgatacattactataattacatcgcacattttgcagtaaactccaaaaaaatgatttattatctcttgggtgcttgacagcaatatgctcaatggcagcataacttttccaaatctgcccacacattttatgtgtatgactcttttggaattagaccaaatggacccttttaaagatctgctgagttaacaccaccttatatttatatggctgcgttcttcaggccacactgtactgggtcattgccactattttcccacctttctctttacacccctttaaggagtatcatggccagatgtggcgtggtgtctcttaaattcacttaatagacaaaagagaaggacatctctaacagtaatacaagaaaaaaaaagagagagaaggacagagagaccaagaaactctttttttactcctattcagcaactatgtatgtacttatttatttatttatttatttactgagacagaaccttgctctgtcatccgggctggagtgcagtggtgcaatcatagctcgctgtaacctcaaactcctgggctcaaacgatcctctcgccacagcctcccaagtagctgggactgcaggcatgtgccaccacacctggcccctcagcaactatttttacagtatcgactctgtgtcaggcgctgttctaggctctggacgcttgatgagtgtcaccagtgagcttaggacagagctgacgtcttctgcctattctttggctttactccccatagggcttttctggagaagggccctttggagcttgtgggatttcagggtttattgaaatttatttacctttttgcaggtgtctcatgcttcctcggttaaggaatgggaattatcataatgtataccatggtgtctggccacagatgaagtaccacagtcatcagattatgaagcctccaagcttctcttgcagaggactccttcaaaccactctcgtggactgtggctaactgggagtttctcctgggggcccattgctcattccttgctgtctctcccggttgagacttcccaccagggtgaaaagctagaacagtggcttttgtctttagcaaggccattagatggtacagtaactgctttcagatgctgctgatgtggcccagattcagcatagtgacccagaggtgaaaggctacatattccattacaacccctagccaatctgcctccagactctagtgcatttcagtagagaaaggaaggaggatagggtgacatacacactagatagcagctagaagtaagtctgggaaaatctaagaatggagcttcaatttctagagatgcttttgtaaagtgcattacttatgtgctgtgaacgtgatcatgatggattattcaggtaaggtggagacgagaacacagagaatcagaacagggaacttggaagaggcaaagtaaacaggcatggttgcctgtttattttgaggtttcgggtggctattagccctacaaatgccagctaagggcaaatttctgttggttgagattctttgagattctgtcaatgcaagattttttaaaaagcaagtataaaagatgagaagatgcagttttgtggcaaagcgtagaaagtcactaagtccacacatgattaaaaatagtgaagagaccataattcaagtcatatgatctcttttattgtaatcatatttactcaaaagcctcttcgtttgttccatttctaattgttttctcttcttgtgtagagttaaaagagtcacgggctttattgaagggtggagaaattttattttcagaaattttgcctcaatgtttattccctgtgagacactgacattttcttctcaaaacatatatatctatatctatatctatatatttagatgtctatatatatagatatctatatctatatatatagacatctatatatatagatatagatatatagatatagatatagatattttttttgagacagagtctcactcttgttgcccaggctggggaacgagctcagctcactgcaacctctgcctcccgggttcaagcgattctcctgcctcagcctcccgagtagctgggattacatgcatgagtcaccacgcccagctaattttgtatttttagtagagacggggtttctccatgttggtcaggctggtcttgaacttctgatctcaggtgatccgcctgcctcagcctcccaaagtgctgggattacaggcgtgagccttgtaattacaggtgccttgaaggcgcctggccttcaaaacatatttgtttagggaaaagtagtgtcagatctatgaaggtcatactggaagttgctaataagtagaatgccatatttcatggaaggagaccagagttcaggaagcatccttcccacagggtctatcatgggatttagttccttctttttctgcatcccagatgttcctggaggtgcatacttgctggtaagcctggagttggagggatgaaagctaccaaaggccctgatgggtgttatataagatgccacgtgtgagccactccccacaagacgccaacaagcagggaacctagttcagcactttcatacccagtctaaaggcttctaggaaactgtgggtcagctggcccactcctattaaccatgccttcatctgtagtggaaggaacatggctcacaggatgggctagcaggcgatggggcctttgactttcagattagtcttcctgcgacttttaacggtcatgtttacttttgaatataacctgggatgaagcatttatcagcctctggtacttttgtgaattggtagtttacagcgggcttactggtagccttggccagctctttgccataaaatctttaagcatagacacacaggggtatggccattccctttatttttaattaattaagtagtttctagagggagggtttcgttctgtcgcctcgactggagtgcagcagcatgatcctagctcactgcagcctcaactctctggctcaagcgatctgcttgcctcagcctcctgagtagctgggactacaggtgtgtgccatcatgcctagctattttttaaattgcttgtaaagatggggtcttattgtgttgcccaggctggcctcagatgcctggcctcacgcctcctgccttggcctctcaaagtgctgggattataggtatgagtcactacatctggcccatgagtcactgcacctgtcccattccccctgcctttattgattcctacttccgcctaggataacactatctcttaaaagagtgttgccaagaaaccccatttttttacattctatattgtattttaaagaggaaaccctatttagagatatttttgtgggaatggttttggagtttcaaacttctgaagaacctggactatgttgggggcatttacggtggcagtgcacacggctcacactgacgaatggctcggctgagcaagccagtgaagcagagggcaggagaggtgacttcctggcatcctggatctctgcaaatgaagttgctgtagcgccattatttacctcactgtatgtgaaatgaaggggtaggattcattgccttttggttttgattttacttgtccttaggggtgtgtgtgtgtgtgtgtgtgtgtgtgtgtctttccccctggccttctggtgacggataatggtgatggcagtttaggcctgtttctgattagtaaaatgacccttcaaatgagactaggagaaaaatgctctcctgaacctctggaaccctggtttttcctatcacaagtttaatggcttcaggtcctatgtttttagccgagaaaatgaaagactcagtcagcggggattagggttttttgtttagagagaaggtaaaaaggttacatgaagatttggtgtgggtttagactggggttagcctccacgtaggaaaggtctgaagatcgagaatgaggccaggttgtgcaggtgagcagagctatctttggcagctagattgggatgtttctgggcagagatatttgtcccttaggagtgtatcaaatcacagaggtcacatctgactgtcactgctttgttacaggagaaagacctgttcatcagaataattcctacgctttgagccacttattcaagtgatgctagtcacgttcagaaaacagataacctaccatgtgtttgtgctgtgctaggagttctagagctttcaagcacaaccgtatatccgaggttgactttggagctgtcatcgtgggtttggggctgtattttaaaataagaggagcggtgtcttttgggctttgcttttttttcaaatgcttttttctgagtcccttcagtgatccattcttgagctgtctcttcagtcgtcagtctcttggtagtctttattctaagtttttttcctttttaattgtagtaaaatatgtatagcataaaatttcccatgttattcctttttaagcgtatggttcagtggctttaagtaccttcatatcattgcacggccatcgccaccatccacccacttccatcatctcaaaccaaaactccaaatgcattaagcaataacttttgttattaaagtgtttaataatcactttggtgctgtttaacctctttaccctgatttcctccccctttcttgctccttttctagtagtttctactaatagatcacctgagtaagactgcccgtgtcaagcctggtgtcaccttaggttttggggataaaggctggtggtaccgcctgtgacgtgggcttgccacatgcagtgtctgagtggagggcaagtggggccggctctacagccatccgagcagacgggggctctgtcccttactcctcaggcacctgacgttggacttgcctctgggtaaataattcttatcaagcatttacttggaacaattcttaaccatgttttttttttttaaataattactgacatttgtactttaagctgtatacaaatgttcatatttgacagatattctaagcattagagatatttaatgaaaacttgtaaataggcaaaacgacatttaaaaagactgcccctgtctttgtgaaagcagcaaatagttctcttggctcccatttccccctctccactctaaaatatttttaaataaaatagcgtttgaaattctccagagaatgctttaaagagaaagatccacgtgacctcattaagtcattcattcacgtattcatttatcacacatttatcaggctcccaatatgtgccactttctctgtgttaaatactatggattcaaaaacaaaggaggccgggcgcagtggctcatgcctgtaatcctagttctttgggaggctgaggcgcgtggatcacctgaggtcaggagtttgagaccatcctggccaacatggcgaaaccctgtctctattaaaaatacaaaaattagccgggcgtggtggtgcgcgcctgtagtcccagctactcgggaggctgaggcaggagaatcacttgaaccccaggaggtggaggttgcagtgagccgagatcacgccactgcactccagcctgggcgacagagcgagactccgactcaaaaacaaaacaaaaacaaaggagaccccaacattggtcgtgagaagtttaccaaccaggaggggagataagtgtgtaaacaagcaaacaactgtcgtaaaggctgtggcacaagagtgggtgggtagaattcgggtaatccaggaggtgtcagaaagaccaggggtggacctttcatctgagccacgaggacaagcaggtgtttgctttggagacagagggtggacaggatgttctggagagctgcagttgcggggcagaggcagtgaggcatgaagcacctggcgcatggcctgtgcgggcctgggtggtgagggcaaagacagtgagcagaggaggcagcgcctggggggcctggccagggaccccaccccctgcatcctgatgaagaactgtaagaggaccatgtctgtgtgcctggataatcgctggcagcagcaagggaatttcgaagcaagatctcagctggagacaggcaagaggctgtcgccatgcttttaaagaagtatcagagatattttgcttttgaaacatttggcttcactggaactttcgtcttcctatgaaatattggaggatgtcagatcctcccccatttctaagagtaggagagactcatgtatctttctctttggggtaaacattcagcttcagatcctgcaggtagcagagagagagagagagagagagaggagtggttaagagtgtggccattggagtccagggagtctgcgttctaattctggctctcctcttaaatagtcctgcagcttgggcaacttactcaactgtgtccttcctcaacttccacatctgtaaaatggggagaacaccttcctttcagggttataggcaaatgaggtaataatctcttttaaaatacttagcccaagtaaatgctcagtaggtgctagctatcatctccagtttctatttcctgaactgtgaccttgactaaatgtggcccagtcctttaagagaggggatttgtggtcactttaaaaaaatcttcagctgtgctcatgtggtccggagtactgtgttagttttcctgcctgtggctcatgggccagtggtcaccatggaaatggtggtggtgggggtaggggtgggggaagagaaggaagccgagctacagagacattcatacacttgttcgtgaccacagcaggatttggggtccttctagagtcactgctgcaggattctttttgtttttttcttttttagaggtggggccttgctctgtcaccctggctagagtgctgtgaaacgatcacagtccactgtaaccttgaacaccaactgcaggattcctattctcttttgtgggcaagatagggtgggggacattgtgcacccccttcttctctgtcccagtctgtgacagaccctgtcagacattgagaggcctgagagctgcaacagtggttgtgccagagaggaatttgccaaagctctcagcgacctttctgcattaaagtttcgtgccattatctctttcacatacaaattcaagcccttttttttcccttgaaatcacttttgtgctgtttaacctctttaccccgatttcccccccttctttcttgctccctttctagtagtttccagctaatggatcacctggataagattgcccctgtctttgtgagagcagcaattagctctcaccctgagaaggcggcgtgttctgttgcttggcagccttggtgtagaggatggattgggtctgcgtcttttcatttgaaagtaggttatcgattagcacggatgccaatttactacagaggctgttgccaatgcctcttgatctcattatggtgtaaattttcaagattgtatcacattagctcaggagaattcaggagagaaaaacgtagtaaagttaaaaaaaaaaaagccaaaaaaaaaaattcttccattatattatagcccaggcaaaaataaacatggctacagctggccatgttcggaaaggacctgcggtgtgtgtgtggctgggttggttatgagctgtaggaaaacctagcgacaggtttcaaagtacttcatgtttttggtttattccttcgatttcttttaggactgattttcttgggaaatggtgatttttagggaaactgcagactgttgggtctatttttttatgacaagagccctctagtctcagctttgtgagacagaaaaaggaggcagggacagtgagatggcagaggaggagatgctggcgaccgtgctaatgctagctaatgctaattttgaggaccagatagtttgggtgcaggcctaactgttgttcagttaggaatctgagatcattcccttccaaaaagtggctttattgagatacaatttatgtgccataaaattcacctgttttaaacgtgtgcgggcctaactcttggccaattaggaatctgagatcattcttctataaaaaatggctttattgagacaatttatgtgccatgaaattcacttgttttaaatgtccagctcggtgcatttccatttattgccaggtctgcagccatcatcactatctaattttagaacatttctgtcactccacaaggaaatggcccattatcagtcagtcttcaccctactccactcccaggcacaggaaaagactaatctgctttccgtctctgtagattttccttttgtagcattttacatgaacaaagtcatacaatctgaggccttttgcagatggcttctttgagttggtacagtgttttcaaggctcaccctgttgtagcatgtatcagtacttcatttctctttattgcctggtaatattccactgtataaacataccacatgctgtatatccattcaccagtcgatggctatgtgggctatttctagtttttggctattatgaataatgctgttatgaacatttgtgtgtcaatttgtgtggacatatggtttcatttcttatggatagatgcctaggtgtggaattggtagttgatatggcaattctatgtttaacattttgagaaacttttttttttgaaatagagtctcactctgtcgcccaggctggagtgcagtggcgccatctcggctcactgcaacctccacctcctgggttcaagtgattctcctgccccagcctcccgagtagctgggattacaggcacgtgccaccatgcctggctaattttttgtatttttagtagagacagggtttcaccgtgttagccaggatggtcttgaacctctgaccctcgtgatccacccgcctcggcctcccaaagtactgggattataggcgtgagccaccacgcccggccccattgagaaacttccaaactcttttcccaaatggcagcaccattttatattcctcccagcaacagatgaggctttcgatgctagtatcaccctgtagctttgatttgcatttcactaatgaccgatgaggtatagcatcttttcgtgcttattgaccattcatatattttctttggaaaaaacatttattcaaccttttggtgttttttaattgggctatttttgttgttgttattgagttgtaagtctttaatatatcctggggtataagtctcttatcagatatatgattggccagtattttctcctggtctgtgagttatcttttcactttcttgatggtgttgtttgaagcacaatagttttctgtttgatgagatccagttgatcaatttttcttttattgcttttggtatctaagaagttgtctaatccaagatcatgaagatttacttccagatttttgtcttaagagtttatagttctggttccaacacttaggtctatggtccatttcgagttaagatcactcatttttcttgcataaagaaattttccagactcattcaggtttcaagaaaatagacttagaatgaccactgtggattttcttttctgtccttcattttctaacaaagcatatgtagtggccgtcacatgctgggtagaatcaagattgcaaagactgacgtaagaatttggcacatgagcaagctggagttggagatcctgacagaatctctaacacatcttctgagggtgggagaactgtcacagaagcaacctgcaggtgtgagatggactccagggccttggcactcatcagaagaaagcttgacctcctcacctgcatggggttggggaacaaagcaaattaagcatcagagaaagacctggcggtatgacacgattaagccataatggcaccagggcacagctgccaagcaggttgtcagaagggcagacagagtgatggagttttttgttggggtactgtcatatagttatttgatgaagccatctctctgtttttgactacattcttgctttcattggattttttcctacatcttgacccctaacctcctgcaacaggtatgggtgggagttgttgtttttttttttttttttttgagctttcttaagtatacctgtggttttcctccaagtcccccaaggatcagttatagctctgggaaagtggggggaagtgagatgctagacttatttttaccaaaatccaagactagtgacacaaggtagaagtcactggatggaatgaacttgtaggatattcccttttggggcactaatcacaaaggcaaattgaatggtagagtgtcaaggtgaactttaatactttgtaacatgagctccaggccaggtcttaaaacatcttggacatattgcaagaaatagctcagccctatagcacattgaatgagaatggagagtggatcctgggttggctttagactctggccttggcgtttgtgtgtacacatgtgcgtcgtcatctgtgcacacaggtacacaaatgtgtctttataatctctggggaagcaggttcacttttaatgttctttcatctgctatttgattttaaaatcttgggggaaagtattgaaaatcaaatgtactcatctgtcctgtgtaaaaataggagtcaaaattttaaaatctgaatttatgcaacaaattaaatatggagtgttacttctcatcacaaaataatctagccattgttaccttcaagagagcagtttctcattgatgcaattaaaatgaacttctcagggattcttttactataaacggaggtgcacccaaaccttatatctctgagaaaacagtggctgtgtaatgagtggtgaattgtttttggcgagtgtggctgccaggttgcttcctcctaaatctgagatggtagacagaggtttattattgctgtagcagatagagagcgtcttgcttgcactgcagaagtctgcccagagcacttaattagacatttctgtggctatttgcagcccagtacaatgggagatcaggggattccagattggaatcctagacatccaaatccatagttagcgttcagagccaaattttttattgcttctctgggattatgctaatcattcaattcaaatttattcaactcacatttttgacattctgctgtgtgctaaggtggtggaaatactttttttttttttttagacagagtcttgctctgtcgcctaggctggagtgcagtggtgcaatcttggttcactgcagcctctgccccccgggttccagcgattctcctgcctcagcctcccgggtagctgggattacaggcacccgccaccacacctggctagtttttgtatttttagtagagatggggtttcgccatgttggccaggctggtctcgaactcctgacctcaggtaatcaggtggcggagatacttaatgaaacctggttccaaccttcaagaatagcacaaggaagggaggggggtctggataaaatcgaaaggtacaagttgtgttgggactaagtggatctaaacatgctttctgaggctgtcattaccccaaaagtcagctttgtgtcaatcaacaaacactgtggtctgtcttttctctcagcaaagtctgaaggagtgggacactccaactgtgtgtcacaggaatgagctgtcatctggcaatttacagaccagcttcaaggattccatttaccaccagtttattcacttgtatttctaatatttatattttcttaagatgatcccctctcccatgtgtgctaattttctaaataacagccacatcgacaaaatgccccctttgatgagtcatgggctgagctgggttctagtgatgctggctacaaccttgagagttaaagaaaagctatttatattttctttttattattttattttattttattttattttgagacagagtctcactctgtcgcccaagctggagtgcggtggcgtgatctcagctcactgcaacctccgcctcccggattcaagcaattctcctgcctcagcctcctgagtagctgggattacaggtgcccgccaccacgtccagctaatttttgtatttttagtagagacggggtttcaccatgttggtcaggctggtctcgaaccccttacctcgtgatccacccaccttggtctcccaaagtgctgggattacaggcgtgggccactgcgcctggccctatattttcttaagatggtcccttctcccacgtgcgctaattttccaaataacagccacatcaacagaatgcccccttcgatgagtcatgggccgagctgggttctagtgatgccggctacagcctcgacagttaaggaaaagccactttcgcaaagaatggaccctgcttccgtaaccttgggttaaatgttgtctgcgagcaccttactgagtttcttcattttttgctttatttgggtgcagctaaaccagctaaacagccttaataagttactccctgggatacaataagctccctgcatctgtgaggtgaaaggcagcccagtgaattctgtcgacagtagctgttctgagaaagtgagcttgaaagggggtgtaggagtcaaaggtgagaggtcatgacgtcagtagtccaaacacctggaggttttagtctaacttcctttcttgttacttagccaggcagtaagttacgtatctctaacttggccttctgtaaagtgggactcttagtacttgccctgcttatctttcagacagaatcaaatgaaatagcagaagtgttttgtcaattaaagtgacatcagatgcaaagagtattattatatcatcatcatcatcatcaccaaaggaactatggtaatgttggataaaaagccaaatacttttttttttctttctttctttctttttttttctgagacagagtctctctctgtagcccaggctggagtgcaatggcgcgatcttggctcactgcaacttccacctcctggattcaagtgattctcctgcctcagcttccagagtagctgggactacaggcgcgcaccaccacgctcagctaatttttgtatttttagtagagacagggtttcaccatgttggccaggatggtctcgatctcttgacctcatgatctgtccgccttggactcccaaagtgccgggattacaggtgtgagccactgcactcagccaagccaggtacttttctaagtaatttaattctctagaagaaaagatgataagatctttgcctggaactggaggccattatcttaagtggaacaagtcagacacaaaaagacaaatactgcgtgttctcacttataagtgggagctaaataatgtgtacacatggacaatagagaaagacagacagtggagattgcaaagatggggcaggttgatgaggaatgagaaattactgaatggacaccatgtagtttattccagtgatggatgcattcaaagctcagacttcaccaatatggaatatgtccatgtaacaaaattacacttggaccccatacatttatacaaaaaaagacctttgacactaggcataactagtggtttggttaatgcagaggagtattgctgtggtcgctttcttttaaccagcttgagagacagtacaagagaaggttcaggttcttgtcttgacagaagtctcagtacacccacctgtactttaggagaatgtggattggaaggctcttggtgtttcagttttctgagtgggtttgagtaattatgttggagagggggaggttgatgagagtgtaacacacttttcgtggctataagagatgataataaagagttattagaacatttattagacacatgatagggaaagttggttaagggccttgaagaacaggcaaaggatgtggaattcatgtttttgagctctagatgatatgatgaaaattgtggttgaggattatttttctgatcttgaggaaattcaagtttgaatgatgaggatgaatgaggttaatcaacactgaaattggaatcagaggcaaattcaaggccgggcgcggtggctcatgcctgtaatcccagcactttgggaggccgaggtgggcgaatcacctgaggtcaggaattcgagacctgcttagccgacatggcaaaaccccatctctactaaaaatacaaaaattagccaggtgtggtggcacacgcttgtaatcccagctacttgggaggctaaggcaggagaatcacttgatcccaggaggtggaggttgcagtgagcctggatcgcaccattgcactccagtctgggcaagaagagtgaaactccatctccaaaaaaaaaaaaaaaaaaaaagaggcaaattcaagacacagtagaacaggggtgtggtcggtgaagccgggagagtaggcaggaagtgaggccagtttgggaaccagcaaagcccacctctctctcgaatagcccctatttgtcccaagatcttactttcctaccatcatgtttggttttgactgaatagctcaattcagagagacatttcaactttccctctgtgctttgcaaactgatgacgaagatatgttttaaggaactagctcccaagttagttcctcttacaaagatgtacagattttaaaactgaacatgtgtgtgttgctgctgagaatgtaaaatcatgcagctgctttggaaaatgatacgacagtttttcaaaaaattaaacaaggaattacatatgattcagcagttccacttctggtataaacccagttgaattgaaagcagggactcaaacaaatatctgtacacccatgttcgtagcaacattattcacagtagccaaaaggtgggaacagcccagtgtccatcatggatggatgagcaaaatgtggtctatgtatttacaatggaatattgttcagaaaaggagtgaaattctgaaacaggctacaacatggatgaaccttggagacatgatgccaagtgaaataagccagtcacaaaggacaaatgttgtatggctttgcttacacgaggtacataaagtaatcagactcagacaggaagtagaatggtggttgtcaggggctggagttgaggggaatggagagttattgtttaacatacagagtttcaattcgggaagatgaaaaagttctggagatgatggtggtgatggttgcgtagcaatgtgaacgtactgaatgccactgcacacttgaaagtggctaatatagtcaagtttacatgtattttaccataataaaaatggtgaactgtcattatcttgcattgttgatgcttttgttcaaatcctgggaaatatgatataataaatctcttcttatgttattccaggtctggaaagtgaactctggttaacttttcaatatcattttccccaggaaaacaaaagataatgatgtttcctaggccaaacacaccttgttaacatttccataacaaaacagcaaactgtcatttaaagtttatctcactgttattcttgagccacaaagaagcaatgtttacagacgattttacactaacaattggatgtgctggaaatgggtatttgggtgatctcagggttcgtgaacctcaggctgtggagtgttcttgttctagatgtccgctgagagttttctttctcaaggggctcctaaattagaggtaagccccctaccacctgtgtgatcccccagaagttagaaccttgcgccttctctgtggcagggaggagacctgtcctctctagagctggaaggttgtgtgttaacaaagttgaaggcagtcatattagtctgttttcactttgctgataaagacacacatgagactgggtaatttataaagacaaagaggtttaatggactcacagttccatgtggctggggaggcctcacaatcatggtggaaggtgaaagtcacgtcttacatggtggcagacaagagagaaagagagtgaagtgaaagaggagaactcctatgagaccatcagatctcgtgagacttactcactaccgtgagaacagtatggggggaaaccacccccgtgattcaattatctcctccccggtccctcccacaacacgtgggaattatgggagctacaattcaagatgaaattaacctatgaaaccatcagatctcgtgagacttactaccatgagaacagtatggggaaactgcccccatgattcagtcatctccccctgggtccctcccacagcatgtgggaattaagggagctacaattcacgatgaaatttgggaggggacacagccagaccatatcagcagcctatgggatgttcccccgagggctccacagccgggtgctcagattgctgggactctcttgtcaggacttcttccttcttttttgcctaggtcttatcagaactaagccatttggtttgtaatctttcctgtaacactggctgcagggtctttagcctggattctagattggagggtacagggcagcagcctcacaggtgcccattagcacatcccacaagcagtcacggcactgcacttgcactggaaacagcttctcattttcccgggagtaccttctgccaactttgagaacaccaattcctaattcctgttccagtatccactttggttttatacataggacatcttttcctataagttttccctgaatgttttgttttgtttttttttttttttacatttcttacagatgtctattaaaatctcagcattcttataaaatactctttgatttgaagaaagtagtcattttcccttaggcttatgatgcctcagtctccctataagagataagaaccaggctgggcgtggtggctcatgcctataatcccagcactttgggaagccaaggtgggtggatcacctgaggtcaggagttcgagaccagcctgaccaagatggtgaaacaccatctctactaaaaatacaaaaattagccggtgtggtggcaggtgcctgtagtcccagctactcgggaggctgaggctggagaatcgcttgaacctgggaggcggaggttgcaatgagccaagatcgtgccactgcactctagcctgggtgacaagagcaagactctgtctcaaaaaaaaaaaaaaaaaaaaaaaaaaaagagataagaaccagatatgcataaatatgaatatttgttcatttgtaatctggctcttcctgtgataagatgccaccaatatttgggtagaatgctggggagaagttacctcccaacattgaaaagagtaaaatcccagcactttgggaggccgaggcgggcggattacctgaggtcaggagttcgagaccagcctggccaacatggtgaaaccccatctctactaaaaatccaaaacttagctgggcgtgatggcagacgcctgtaatcccagctactcgggaggctgaggcaggagaatcatttaaacccaggagacagagggtgcagtgagccgagatcacaccactacacacccacctgggcaataagagtgaaactcttgtctcaaaacaagcaaacaaaaaggattaaatatatataaaaaaatctagaaggaaatatatggataaagaagtttctaagcttgatagaatagaaggtatcacaagagaaaatatagacaggtttgactacataaaaattaaactctgtatatcagaaaacatttgtacgttgacaaaatcaaagggcaggcgacaatctgcagagaatgtaaaaaattacaacgaagcatgaatatctttaatatagaatttttaatacaaattgctaatgtcaacattaagaccgcagtagtttaagggacaaaggcagttgaactgactttgcaaaaggggaaacaaacacacatggctaccaaacgcaagaaaaattgttcaacttcattagtaatcaaataaatgcaaatcgaaacaacagtaagctaccatttttgatgcagcttaacaaagattttgtaaaatgtgatattctttcatataatgaaggataaattaataccattttggaaagcagtgtgatgaaccttaaaattattcttactccttgacctggtagttctatttctgggaatctatcttaaggggataatcctaactaccaggattaatgcacaaaagtatttcctgaagcatttaaaaaaaataattataaagaattagaaagaagctgcatgttcagcattagggaaatggttacagaaattatgatcaatctatttgatcaaatgctgtgtggtctcttaaaataacatttgtaaaatgtttcccatgtttcaggggacgtgctcatgatataattaatgctaagtgataaaaaagcaggatataacctcaaatgtaagtattttctggtctagacagtttaaaacttcacaggaaagaaaaaaaaggatgcttgctacaatattagcagagaataatattgatggctgctggtctcccctagtaaactgtgtttcctaaaagggcatacattactttaaaaacatttttaattttgagatattttgtaaaaatttgattctcatatatctgtcttaagaatttattatataaatcatccttgaataaactaagttacatagttttcaaactctgtctcctgctaaatgatcatctatactgatgactttttaaaataatataaacttccaggagggaggaaagaggtatgtttattttaggggcctccagagcccacagtaactcttccttcttggggagaggagtctaaagataacaggcctgagtttgtgaactctcatctctagtatacttgacttcttctatgtatttattgattgtgtggtatcacagatttggggggtgcgtgtgcaggtgcacgtgtcccgttctgtagtggtggggattgggtttctagtgtacccatcacctcaatagtgaacattacacccaacagataatttttttttacttttagtctcagggcactgtgcaggtttgtgatacaggtaagttgtgtgtcatgggatttgctgtacagatgatttcatcacctaggtagtaagcatagtacccaataggtagtttttgagactcacccttctcttaccctccaccctcaaagtaggtcttggtgtctgttgttcccctcctagtatccatgtgtgctcattgtttagctcccacttataattgagaacacacggtatttggttttctgttcctgtgttagtttgcttaggatgatggcctccagccccatccatgttgctgcaaaagacatgatcttggctgcatagtgttccatggtgtatatgagccacattttctttatccagtctactgttgattggcatctagcttgattccatgtttgcactattgtgaatagtgctgcagtgaacatacgtgtgcatatgcctttatggtagaatgatttatgttcctttggtacttgacttcttattgccattgtgttcaccaaagacaatcatatgactcagtctgtttcaattggtttgaaagcttaggctttcctttttaaataaaccggaaagcttaggctttcctttttaaataaccttttttcaaaatttcatatttttttctcattttaggaatgtaataatagtcatcatgcgttaagagctttcaaagaaccagatcctgttctaaacactttatatgtgttacatcatttaatgttcacagcaatcctctgagatgtaggtactgttatcatcccagttttacagatgagaaaactgaagcacagagaagtcaagtaagtggagaagcccatgttcaaacctgagtcatctgtcgccagagcgtccctccactgcgccagatttatgacaacttacttgttctttatgaaggcagcaactcaggcacagtaggccaaggctgccatctgatgaaacaactggcaaatcaatggcagagaaagattcagagcagagacagggctgcgtccattgatcgtgttaggacctggaccatggggcgctagaaaatgacatggacgccagaaagtttctttttgctgctgactgatcatttatgaactttccatggacttttgaaaataatatcaaaataataccactagaattgttaaagcattccacgtaggacactgggtcatttgatttctgtaggaaaatgtgattttgtaggaaggcgtatggtagtttcttccatataaggccattatctcgtctttgaacctaatttctactgcagttcaggtttggagaggcctaattcatcgtggtggcacagttttaaaatttgcccctcatttggaattgatttagagtttccgtttacatagagtgcttgatgcaggaggcagttatggaaagggaggccctctctgagcacggtgcatggggttagagttgcctagattttggtaacatagtgacactgcaaacaaaactctatggaaacaaaataattttttttttctttttggacacagagtcttcctcatgcagcggtgcaaactcggctcactgcaaccccttgggttcaagcgattgtcctgcctcaggcccccaagtagctgggactacaggcatgtgccaccatgcctggctagttttttgtatttttagtagagatggggttttgccatgttgcccaggctggtctcgaacatctgacctcaggccatccacccaccttggcctcccaaagtgctgggattacaggtgcgagccactgcacctggcctggtttttactttcaaatctgatattttagcctgttagtgttaaccatgtttaactgactcaaatgaaatgctggccctggctcccatatagccagaagaataagaatgctggtaatcaggtattggcgtttcttcaaaaagccaaaatctgttgtaatagaaatactggtaatttcttcactctgtgaagtacatgtgtatgggggtgtgtgtgtgtaggagagggttgaagattttaacagttgtttgcccaaggttactatataatctaaacatatataaggctccaaggcatttagcttatggggaaaattaaatagtggctattttataaaggcaactagttgggaggcctcaatcattgttactttttatgggctctactaggattttatgtaggaaccagtgtgatctggggaggagggattcctttacacacatccttcagaaagccaccattgtattcctgttgcatttgatgaatatccctagtaggtttcttttctccacctgccacctaggtagatcaccactgctgcatgtcacttttactgaagtgagtaaaatctctgctagtagtgttttccaattatgcatatattttcttagtgcttatttggcactgactttggggagtcgtagtctttctgagatgggaataacatcatttgtttgttgcgcctcagttccaccgtcatttaaataggaggcgtgtcgtgatggtgggcaaccttgttcccacctgaccttgtgagatgcgctaggtggattatggtctttgaactacacattgcttgaattccttgggagacgtgggtcacataaacaggagcctgtgatttttcaggattgacggggaggggcatcttcctttcctaaatccttcctttgatctcctcagcggaggtcacttaagcaacagctggctcttctttgcccctggggctccgcttcagggccgggggaaggaggctgagcatgtcgagtgccctgggaaggcccatctgcctgtcaggtgttgtttttccgccaaacaccgaaagagctatgttttgttcctcttaaagagtttaccatccagaagggaaaaataagatagaaagtaaatagctacagcacacagtacctctgaggataggggtaataggattgtggtcaaagcagggtgtgctcggaaccatttgaggcgaccggcaatcatttccttaaaagagtagccttgagaaaagctctaatagatgggtaagattttgatgggattttggtaggagccaaggagagtaatcaaagtggaaaaaggagggactggagcccttgcctggggcttgaggttatcctcgaggtccttcaggatgtccttctgtggcaggaggatgatagaactatttgtttctagtgttttgtatggttttagagccttatatattatggtgacagatccaaggacacaatgatttgatggtgtccctgtaggaagaccccgtttaacaagaccactattttcctggtaaatgagatataagatgtatagtcttttgtttcctcccagcagctactctgtggatacatcctgtgaacttccctttgcaatgattaggatgacagcccctgtctctaagcttctacctgggctccctaagtccattttcttcccattcctaatagctctgaaaacaaccttccactgtgtttcctccagcatatttccgagttgattgtcaagcacagctcttatgatatcactgatctgctcaaagcccttccctggctctcctgttgaatggtgacctgggtgtaaatgcctcagacctctcggtctcctcccacctttccaagccatatccccttcattgactgtgctccaggcaccacctccagagtagacctggggtgggcctcagaactcgcatttctaacgggtttccaggtgatttccgagaaccactgccatagccaagccagacaggtgtggcttaacggacctcagaattctcccttggatatttttttaagtgcatcttccttcactttgattactctccttggctcctaccaaaatcccatcaaaatcttacccatctattagagcttttctcaaggctactcttttaaggaaatgattgccggtcacctcaaatggttccgagcataccctgctttgaccacggtcctattacccctatcctcagaggtactgtgtgctgtagctatttattttctatcttatttttcccttctggatggtaaactctttaagaggaacaaaatatagctccttcggtgtttggcggaagaacaattttgagataagaaatcctactcctcattgattctgttccgcatttggagatgttggcaagtgcgtcgagccactcagagggcacggattagattttattcatattagaatcctctgcatcacccgaccaattatttgcccacagtaagcccatcataaatatttggtgattgaataacaaccttccacactcaagatgttgcaagcctgagaagtaagaagaaagcgctgcatagtcttcctgcttctattcttgtaatcctcttataaaccatgggccttctaagagaacaattattatttttaatgaactggtgtgtggcatagcttaaacctctttattatccttcagcacttagctttgaataggattaatcagccaggaagatctgaggaggggcagggcaggcttcgttcccaggttattgcttttccagtgaaaagcactttgaagaggacagtggagactgatcttttattttaattcaatataattataactttgttttttttacacacatcacacacacacgtgctcacacacttcagaagtctcatggctaacgatggggctgtgtaagttattcattaggaagatttgagaagcagggtcaagcaatggagaaaaggtatatatttttgaggatttatttttagtatttgatataaaaatgtatgagtaatacatgctgattataaagaatgaaaataggacagaagaagatagagtcaaaagttaaagtgcccccggggaagtgtatttatataaagtgacacaggagatattttgaaattttaatgcccaaaagtaaagtaaatgatgttcaccatatagacgacaactaggcacagtttcaccacccaggataattaatgtgtgatttttctggtgtcctcaaaattattagcactcccatgcgtactggagtttcacagatggatttcactttcacatttgagcatttctcagtggtttccagcctcagctctctcttaagcagatgactttagccaagctgagggcagaaaaagctaaggaatgagatcctgtcttgtctcttcctcccctgctccctcccttcctcctaccacccacacatccttcccttttgcagcagatactcgttgagggcttactatgctgcctcactgaggcattgtgccaggtgtcaggaatacagtggtgagcaaaacagacctccagtacttgtgttttgggagattcaaatcaggataccagagtccatgcagtctctggagcagacagcctgagttcaaattccagatcagtacttactatgctatgtgccctcagacaagttacttgtgtctctggcctcaatttcctcatctgtaaaatgggaatgataaaagcatctacctcaaagttatttaatatagggattaaaataaataaagatgtaaagtgattaaaacagagtgtaatatttggtaagtgcttggctgggtgcggtggctcacgcctgtaatcccagcactttggggggccaaggtgggaggatcacctgaggtcaggagtgcaagaccagcctggccaacatggcaaaaccccgtctctactaaaactacaaaaattagctgggcatggtggtgggggcctgtaattccggctagttgggaggctgaggcaggagaatcgcttgaacttgggaggcggaggttgcgtgagtcgagatcgaggtcgcaccattgcactttagcctgggcaatagagagagactccgtctcaaaaaaaaaaaaaaattgtgagtgctcagtaaatgttgttatttacagtcagggtgtgggcagacatttaacaaataataataaataactaggaagttctaactgagataaaggaaagatgatgctctggagagtgtaacgggggttctaatgtagaccggggggtcaggaaggcgtggtgtgcagctggtggtggaaaggaagcccctgcggcagcgtcgggggaggcgggagagtgtggccgctgagctgagctgagctgaggctggagtcccaagcaggggacagactaggtggggcctcagggcatctaagttcacttcattcattttacagatgaagaaactaaggtccagaaagataattgctttgtccagatcacaggctggtgacagagctaaggcaagacgcaggtctccttactcctggtgcactggtgaggaaaccttttaacctcaaactttcatcattttctgtctctatcagatgcaaatctaaatgtccttacacttgttcctggtagggtgccctcgtaccaacagagggcaaatacacgcaagtgtgcacatatatactcccctccctcctccctccctcctcccttcttgagggtggtggtgctcagggtgtatgttggatggtagtgcgtagttgattaggggagaattcaggttgcttctttgtttccagttttaaataatctgacccatgtgtctctttattcatccatcatacctgttcatatatccacatatctttggtttttttttttttgagatggcctctctgttgcccaggctggagtgcagtggtgtaatcttggctcactgcaacctccgcctcccaggttcaagtgattcttctgcctcagcctcccaagcagctgtgattacaggcatgcgccaccatgcccggccaattcctttggtatgtttaaatagagatggggtttcaccatgttggccaggcttggtcgcaaactcctggccttaagaaatctgtctgcttcagcctcccaaagtgctgggattacaggagtgagccactgtgcctggcccatgtatccacatatctactcatccatctgtccatccatccatccatccatccatccatccacccatccacttgttcattgatttattcatgcaatccacaaatatttattgaagggcagatatgtgtcacaaatttgtgttaggtatttttgatggtcagccaaacaaacccggcctctgccctcatgcagtttacagtctgtcagcagcaaatcgaaaggaacatatcctgtgtctacacttccgtgctatcattgtgcgatgggattttaaaaaattcacgagattgttctaacacccacaaggaatgcacactctcgttaatcccacacgactatttctttagtggcttatttgtgtttaatttccaagataggggcggtgatattcccaaatcccatttctctcctaaatctcgttttcacagatgctcagcaaaggatgtagggcgactactgcagcagcacacagcattcaaccaggagtggaatttcatgaactgctctttatttcccttctggtctcttgagtctggttcatcttgtctagagctctgataatctccgagacaaaatatttaaatcttctgcagctctagggactttgaggaaggaatattgtggctaaaatcctaaatattttggaatatcattaatgcaagggttatacagcagatgctgtctggcacaatctccatcccaagagaatgtgtcaatatctttgtatatggaaatgtacatgtatactcataaatttctccagcctcccaattctgtatctctttcccctttgagactgacttttacttcccttctttagcccctgcttactttaatatacattttttctctctgttttcagaaaggggtaaaaaattgttaccataaatgattgatagaggcctgaatttttattgttatctcttccggagtggaaacctgccttttcatagagaacgcagctttaatccaaaggatggactatctaattgttgaatttcaaatataggcagggctgattgagggtatagggtttttcaaacgttcttaaaatcacaatgtatgagtaaaggcataatactgatgggaccacagtacaggacgttttccaaagggcgtgaaagtcattgtgtgacccctgttgatgcctctttattcttgttttgtagaaaaagtaactgatttcttaaaaagcatattaagcccacaccctgtgcccagtatttctttagaacaaccctaaaaaggagacaggattatcttcactttacacccaagacagctgaagacgacagcagctaagaggcttgctcaaggccacacagttaagaattagagttgagcctcagagctggctcttgggtctggaccacctccctgggttaaatacagtcctgtctcagtacacacactgcctcgcctcctgatttttaaggtattacaagttaaacacgcaacaaatagtctagatcagtttcattttgaaataacatagcagttataatgtggatgatattatgcttgaaataaaataatcctgatcatggagcaagcacagtgacctgccttaacagttagatgttagtagagaggacacagagatcatttaaatgctagtaagggcttgtgactgcgttctgaatgcttagtatttttagattcctccaatcgcttctaaccttcagccctgccatggttttttctgtgaccactggaattctaaattcagaaaggttgttagccacctggataattgcacctttgtaacttttaagacaacaacctagaggcagaggataactacaataaatgacttgtaatttcaggtcttagatctctgctttcacataaaaccagctttccacttccttaggttcaccacctgaagaaatcaaagctaagcattaccagaagtcattatctactatttaaagcctgttctaagcgggagacaagccccctttttaggaggcgtgggggcggggggaaggggatccatttctcattttgccatgtttctgcaggaatgtttttaatagggatcctttttacccccagctactctgcagcacaggagtacgactgtatttgaggaggcagcttgacttcatgctccagggagaagtcttttatttcctgttggggttttaaagttgcccttgcttaggtcgttgctgttttataagtcagcctgaatatttaaaggcaggaggcctgttggtctatgttatgttggccttggggcattagaatgacagagcagctttatttaggattgcgaggcaggccatatgtactcaattatcccattttcgaggacttggccatttgtaccacatctccctgcaagccctttcatgagagccactattattattcacattcagtaagacctgagaaatattattagccaggaaagctctcatttacctcgccatctctcgcaacgttactcactgccctcactgcagagcactccttgtgtaccctctaccttaactaagtttgtcccaagaaaatgatgagaaattcttttacgctggcatacacagactaatcaggtttagtgggaagagcgtggcctctcaagtgtggcagatctaggttcacatcctgatctaccggtctgagcttggaaaacattacttcatttttctgaacctcagtttctctgtttgaaaatgggttgaagtggccgggcgcagtggctcacgcctataatcccagcactttggggggccaaggcgggaggattctttgaggccaggagttcgagaccaacctggccaacatggtgaaaccgcgtctttactaaaaatacaaaaaattagccggacgtggtggcgggcgcctgtagtcccagctactcaggaggctgaggcaggagaatgccgtgaacccgggaggcggagcttgcagtgagctgagatcgcgctgctgcactccagcctgggtgacagagcgagactccatctcaaaaaaaaaaaaaaaaaaaaatacacacaaaaacagccgggcatggtggcgcatacctataaccccagctactcaggaggctgaggcatgagaatcacttgcacccaggaggcagaggttgcagtgagccgagatcccactactgcactccagcctgggtgactagagcaagactctgtctcaaaaaaaacaaaacaaaacaaaaacaaaaaaggccgggcgcggtggctcatgcctgtaatcccagcactttgggaggccgaggagggtggatcatgaggtcaggagtttgagaccagcctggacaacatttttagtctctactaaaaatacaaaaattagccaggcatggtggtgtgcgcctatagtcccatctacttgggaggctgaggcaggagaatagcttgaacctgggaggcagaggtttcagtgagccgagactgtgtcattgcactccagcctgggtgacagagcgcgactctgtctcaaaaaaaaaaaaagaaaatgagttaaagttacaaggaagctgattttggcatccataagaaaaatgggcacaacgatcgttgctttttgcgtggattgccacaagaatgtttttggattcacagatgtttaatactacacatcactttctccttctcctacttttcccataggttttcattcaacagatatctgttgattatcttgtggtgtttcaagatgtgtccatctgcattttagctgggcatatgcccaaacagcatagatttcaagctgtcacaacccaccatgggacagatacttcttaaagtgtgtgtgggttgcgttactgggacccccaattgccacaccgctagcatttgtccacttgtaaagattttcttacttgtcttccttgttgaatcaggaagtggacttttacatggtgcatgcagtttttgatgcgcttcctctccctgctccctggaggtgccgcatgaaagcgcttttccctggacgttcagttccctctccactccttgtctctgtgcatcctgcatcttggcatctccccccgtgacatttattcctgtgaatctgaaaacttcctgtatgttttgtggctacattcgtattccagttgctagagcagaggggagcgggtgctgccacgtgaactttggtgttgaaagagcttcaggataaagttttcagaggacctgctatcaaccaaagctacttgaatataattaggaactaggtccagttcctaatcatactccagaggaggataaatccataggctgtccccaagccagttagctctgagtcagcaatgagcttacatcttcacacgcagatgctgtaggtttacttcatatgtccttctgcagtcattgtcctgcacggctcaggtggcagtgacatactggctagggacatggagaggagctctcacaagggatctggaaggtacatcaggcctaggagagaggaacaaatgaaaacggcactggggcttcatggatggtaataattcatacaggagactttccagttagagcactaagtatcaacactatttggagcatcactccaaactgtactcatttcaaactataatgaaatgcgtcttctctgttgtaagatctctctttttttttttttgagatggagtcttgctctgccacccaggctggcatgcagtggtgcgatctcggctcaccgcaacatccatctcccaggttcaagcaattctcctaccttagcctcctgagtagctgggattacaagcgcccgccaccatgcccagctaatttttgtatttttagtagaggcggggtttcgccatgttggccaggctggtctcgagctcctgacctcaggtgatccacctgccttggcctcctaaagtgctgggattacaggcgtgagccaccacgcctggctgttgtaaggatctcttaaatttctcttatggcttcgtctcaaccacagagcaaataatccccttaaaaatcttaagtttttagtttttccagggctttattttgtgtgattttttttttctttaagagatgaggtctcactctgtcacgcaggctggagtgcggtggcagaatcatagctcactgcagcgtcgaactcctcagctcaagtgatcctcccacctcagcctcccaagtagctgggacctcagatgcacaccaccattcctggctaatttttaacaatttctttttgtagaaatggagtcttgctatgttgcccaggctggtcttgaactcctgcctttgagtgatcttgctgccttggactcccaaagtgttgggatgactggagagagccactgtgctgggccttgtttcttaattgttcatttaacaggcctggttggggtgtgaaatggagtccatgtgtgtattttgcatcctctgtaaatatggccgtagagtacattctaaacacagcctttctgatccactggcttttgtgcataccagggtatgacatcgtgttaaaaagaccgttagtgtagtgtattgtttttgtaaatgcagtttattctaagcacactatatgctggaattatttctagagttcatagtggtattatcattaaggtgtatggaaagtatactaattcctattctataggcaaaaacaactggagcacagcaatactactgccttattgaatcttataagaatatagggggaataatacttgaagtgtacaataataataataatatgctcaaccagcaacactaattaccataagaaagatgtggttgagaactacatttccacaataattacacaattgctacactcacttggcaaccttatggtatggctggtatgctagcaaccaaatcttcctgtgtaaaactacttccatgatgttcctgccacaggatttcgtgctgggctgacagaacagaacagtttcctgaggaacgttttctttttctttcttttcttttctttttttttttttttagacatagggtctcgttctgttgcctaggctggagtgcagtggcaggattatggctcactgaacaccttctgggctcaagtgaccctcctgactcagcactctcccccacccccacccacacccccacccccaccaagtagctgggactacaggtgcccacatctggctaatttaaaaaacttttttttaaagagatggggtcttgttatgttgcccagggtggtctggaactcctggcctcaagcaatcctcccacctcaccctcccaaagtgcaggaattataggagtgagtcactgagcccagcccccaaggagacttttctgattgctggtctttgccatcctcagagaaccaggcggggcacccagggtccctctttgttgactcataccttgggttctcttatatttactcaaacataatgtcctgaagttatcagtagtcccttcttattctccagctccctgtaaaggcttaaagcataactctgggaaaatgttttgcttgggtgggcagaaatggtatatttgggtacagatgtgggatgtgaagcctcagctgtcactgcacctgcacccagagtggtccccacttcttccactctttgcatctgtcctgggcaccctcctttatctttgcacaaaggattaagcatttcatgtgatatgccttaaattgattttccttatgagtagggaaagggagtggggatagaagacaattgtttaatccaataatcatgcaagaatgtgttcttgacattaagagaacaactgtagtctgtggagtagcctaagacacagttgcacatagctatgcaggcagttattgatctgaagaatgaaccgtcatggctgctttgaggaataagatgcatcactattgaaggaggccgggagaatactggagagtggtctccaaccctggatcttgatgctgctgtttactgcagccatgcaaaggaatgtgtgcttcaggtctgagtgttcaaggcaggaccagcaaatttccatgaactctctgaccgtaggccacctctgttccattttgcttctttgctcctaaaaaaattaaatatcttaagttagtttataaaacattatactttaaacaggaagtgaaaatgtttttctgtttttaaaagtaatatatgccattgtagagaatgtggaaaatacagaaagattcagagatcacagaattaagaatccaaatgattttgaccagctggaatgatcaagtctgaattagcatgatgatatttaaatgggatgtgttttgctttgacgatttcggcttagggtcctcggagagagaagcctgtgtcccttaagcctagcaaggtacttggcagagaagggcagagtggggcattcctgaatgaacaaatggatgaataaatagaataggatgcatggaattaaggcaggactccctgtgttggaagcaaagctaggagtcacaaggagaacgagcactcaaaaaagagatttctcagcaaggcaaatttacttctgcagaagggtgcttctcacaggactggttgccacgagagcacaccgaacacaggagggaaagggtttttttcattcctaacgcagcttgtccttactgctgtgtcctgcctccattggctggagttggaccgcacaatctaaactgaacccgattggctaacttgaaagacaactttggcgggaagagctgccacagcaggaggggtaaattacagagtgagtagcagacgtgggctctgtagataaggacttacaagggacttacagtccggtgaagaactaaacagcaatggcatctaataaatacccaaggatgagcagttggtttcatcttcatactccctaaggaccggtgggagagttgtttactggacccggaagaaacatgatagaatttctggggcattcactttggaggaaaccatgggatggtctacattgaaggcctgaggaacttttccctcctccgtgctaagttggtagtttccactttccaccacccacttcccacagctccccccaaacacacgtacacatcgtttttcacaccatcatcctttttggtaaagagatgtgtccatttctgtcctgcattagtgagttccttaccaggtgcaaacactgttagatgtcctgaaaaatgtatctcataaaagagctgtagcaggagggagtatcagagaagagagtagctttccttttgctgtctggctgcaaaaccatctggaagcccccgcggaggtgggctgtgtgcccgagccctaccttggagagacacttggttcccttttccagcagatttcttttcctgacagataattctctgttaatcgagggctcctcaaatccgaatctgagcttcctcttctattctcacctctgtgccagggaaattttcttggcaattgaaaccaaagcgataggctggcagtgggactctacttggctgggggtaaaataagcaatgattgcacataattgcagaaaacaattttgaattttattaatgaggtgctccaaacaacatcttttagtccattgtcccacttaacagccaattcaccggagttcattgtgctgtaatttacatctatcttcccccattgataacaccaggcccttgtgttctgtaattgacacaagttggtcattttcaggggtgtttctctctctaaggacataaaataaacaggcttgctggcgagtgggattgagttagcctcatccacagagccaattggctgctgctgcttgacgctcattttccttcctcaggagaggtggcacagccgtgggtacgtgcacagaaagtcctcaggttaaagatgttgaggtggaggcctggggaggcaagcggatgtcgatagtgagaaaacgagacttctttgcctttcctttgcttcttgccacccaggacccaacatctccaggtggagctgatttttagtgtgcgcagccaggctttgggggcagtagaggtaagattcaggggagggtttccaggaggggatataggccaccacctccttcagcatctcatctcaaaatgtagcatgtgtgagtcgccactataggtcccagtgagctcagctagcccagctcctaccttctttgtgtgtttacagcaaaaacgctgtcactgctttcatgtgtctgtttaaacactgtgtggccatcggctctgtgttgggcacttagggagtatgaagatgaaaccaactgctcatccttgggtatttattagatgccattgctatttagttcttcgccagactgtaagtcccttgaggtcaaggatctcgtctcctctgttcttagtatcctctatagaaccgataacagagtggacacttagaaaaacattaacaggccaggcgcagtggctcacgcttgtaatcccagcacttttggaggctgagacgggtggatcatctgaggtcaggagtttgagaccagcctggctaacatggtgaaaccccatttctactaaaaatacaaaaaattagttgggcatggtggtgtacacctataatcccagctactcaggaggctgaggcaggagaatcgcttgaacccgggaggcggaggttgcagtgagctgagatcatgccactgcactccagcctggctgacagagtgagactacatctaaaaaaaataaaacaagaaaaaaaataaaaaaagaaaacattaacaaatggatgaatcaaatggagaagaagagacaagtacagaaacacgtgtagaagtggaaaagaaaaaacaaaaacataaagggagctctaaaaggttacagaaagagctgtgggacatagagagaggtgtttcttttccctggggtgagccgggaagccttcatggaaaggctggcctggagcatgagagattctcatcggtggacggtggaggttgagcatttcaggggtaaattccgagaacattgtacacacataagaaataatgcaaggtgcctatggctttgacttgagcatttggtatgtgcaaggaagtgactggagatcaaaagggaaatgcagattggaaacagggcctgggggtcttgtggcagcttgtgggtggccatgctttccctgggcactgcccgacccaggggactcagctgcgggtggcacgctcggcgtgcaaggcatttgcttactggaaactacacccgtaagaagatactggggtcttgggaaggaaggtgactgttaacctgtgggggtcagcttacagtgtgagtgttggccagaatgatcaagctctccagccttagcccagatcaaaatccagaggccaggaaggatgtaagcctagctctgtgccatgcagctggttggaacagaggtgcagatacaggctccacccctctgggaccatcagctcccagggtgtctgcagcctcacagcatgactctctcccagtcagcccacccccaaggccccgcagctgcagcttctgctgtgctttcattccagggatgggcagggtgacatcaggccacccgcagcctctggcctcagcctctctgcctaggtggcaccatgggctccaaccagccggggcagctgctgggaccaccccgcacaggcccactctgcagtgagggaaggaccgacaggcttgcggctgctggattactcagtatttttcactttaatatcctaatcctgaagttgttctgcgatgtggtgttctggtggtaaatataatcttttggcagagtttttgaactgtctggaacccaatatcctaagctttttttttttttttttactgtatttggattatattgtgggatttttttccccaaggaggaaaaaacgtattttaaaatacaacatgaagtgagtgaaaaaatttgtttaatgcaaataaaagaattgaagctggagggtgagtgtttccagaggaggccatcaccgtaggaggagaagctggactcagagccagggagtcccagagcctgtggtaggccctgtccttgtgtggggagatcagccagttccaagtgcagggaccaaggacattcccaagcccgtcctcagccagctagtcctgcagggctgttcggagcatccaggtcttctgtcattttttcttccccagacaaacctcctagacataggaagccctttcagaagacacatttgcctctccacagctccacccattatcctttaccactggcgatgttctgttcttcttgggacaccacagcgttatttgtctttccagaccaaaaatatatccctcaggagtatggcggtttttaagctcacaccaagggaatgcttgtataggccttgtgtcttcttgtgatgtttcccagcgatgggcctgaacgggagagactagccaactgttgctgaacgcgatattcttttgtgaataaaaaggccctgattccagccaaaccgggatctggtttggctgggtgtgggacgggagcagtcaccgcaagatccccagacatgtgtctgagcccctgtgtggcctgaggctctcccagttagtcatggcagtagaaagtctctccctgctcgagatgcaaaagactcaccatccaaagagttgggccatcccctgcccgctgtgactgtctagctgtctgccccttgacagggcccaaaatgatccagtgctggaggccggctttgcaaacccaaggcagggtctcactgtgttgcccaggctggagtgcggtggcccaatcagctcactgtaaccttgaactcctagactcaagcaatcctcctgcctcagcctctcaaggagctgggattacaggcatgcaccactaagcctgactcatttctttactttttgtagagatggggtcttgctgtgttgcccaggctggtcctcaattcctggcctcaagtgatcctcctgcctcagcctctaagagctctgggattagagatgtgagccactgtgcctggcctcatgataactttttataaagaaaaaaatttaaatcctctgtttcttctcttcctcatcttcccttactttacccacaaacaggggaagaactttctagcaggaaccatttagttctgtcttgggagcacttgtttccttctcagtttcttagaaagtgcagagtctgcttgctggcaccgcaccgtatcaaatgcttgtgatttccattcggcctgcacccacggcagtgggctctgcccgactgctcctcagcgggggcctgggagggggctgaaaagcctggggctggtgggaagtggtactccctccagcatggcggtttggagtcttgaggaagggtccccccttagccgtggcccagggacactgcccctccccacccccagacccttcccgacaacactgcctgcttgggatgctctaggcagaagtgggcggtggggctggcctccatttcagtgcttggtaattttacggttggggtctccgtcttagaagcaatttcccataattccacttgggagagaagtgtctttattgctcatccccattttaaaggtgggtaattgggggcctcaagagattaggagtcttgctcatgataaaacaggaagtggtgggtctgcgatttggaattctgcgttcctgcaggacaccctgccgcccgtgccacctgttctctcccacgtgatgggcgcaaacccctgagaggtcccttttcagctcttgctccattctcagctgttgtgtttccctctccagatcccccacattgacacaagagatgtgatgcctccgggcagttaagggtgaaaagcgaatgcaggttttctctctcctctttgcccccaatcctacgggtgaatgaggcttgcatctctcttttgctaccatcgagagcagcagctcagtcagctaacttccgtttgcctgccggcatgagttcagcgagtttccccttggttttagagccaaagcctgagcacttggtgtaactttgcgtgctgtcgccctgagaggcggcaccgtcgggccccgagtcagccgtgtgctcgaaccgccccactttaccattcctgttcctcaccggtcactctttagtagagtcccgtccacttaaggagcacttcatacccatgaattgagtaaaattattttacagcatatggcatttttcatgactataattacaaaggattctagacgtcattgatgggggttctccctggcgctaacactgagtgagaagttgacccagttagattaaagctcaagttaataaacagcattcacacatttctaggcctgttgaccaatatcctttaaatcagtgtggctttccaaggggggagcaaataaaaccctaaggtagccagagtgctgttttttccaattaaccttgttcgttttgatttcctttcggttcagaacaatttaggtcaatcttagatttttaagaatgaacctctggagggagaggaaattaactaggccctaagggggcttggttaccacaattaaccccaaaagacagactctcaggctggtggggggcctggagaggggccacatgaccacttcaggccatctgctcacatggagaccctggtgggagtgtcctcttttctttcctgctggctggttaaataaactctgcaggctaccacgctgacgaagggtctgcccatttctcatgctccttctgtcttttagccaaagctgtgttccctctctttctgagaagagggatcagcaaacccttaactcccagagatcgctggtggagttcagggatggaagtgcctgatccaggcagacctaaagcagaggtaatggaagagagatgggaggacagagaagaaaagaagggcgtggggcaggaaggcagggccagactcctttctgtgttaggagcagagccttccttcaccggagcctgggcagtcaatcaccctgagagcgctgggagcctttcatcatcatcagaaggcgttgtgcgtggtgtggatgcacacgtgaccgtgtgccgcacctttgttctgcccgttccttactccttatttaggtgatgaaagatgtggtgccccaactttaagttccacttgacgcagaatttcctgattgaggatggagcctggggctaccttgaggtaattacgggatagtcgttgtacctggaacgtacatttttctaaagttgccacacagtaagactcccacagttctgtccacaccccttcccatgacattattgtttcttcaaaagggaccagccgctgagattttgttagcagggaaatctgtttcacaggaaggagggatgtgtagatgggacctaaacatcgaagtttataatttggtgaaaacctgataaatgggaagaccatttgaaatagatgtttcagtggctgggagtcccagatacccttgaatttaacactgctcattacatacctcagtgaccagaaattggagaccagcctgggcaacatcgcaagaccccatctctacaaaaagtaaaaaaaaaaagagtcaggcttagtggtgtgtgcctgtaatcccagctccctgggaggttgaggtggaaggattgcttgagcccaggagttcaaggtgacagtaagctgattgggccactgcactccagcctgggcaacactgtgagatcctgcctctaaaaacatttttttaatatcatcataaactctgtcagaaatacaaaggagcataaagaatgtaacaaacaatctgtatccacaatctggcctaataaataacacattaccatcccatttgaaggctttttgccagacagagggcaagtccttgagcgggcgtccagtgcaggtgtgctgaagagcccagcctcaagcctaaaatgggatagtacaggacatgaacatgtgaggcaagtggatcacctgaggtcaggagtttgagaccagcctgggcaacatggtgaaaccccgtctctagtaaaaatacaaaaaattagctgggcttggtggtgcgcacctgtaatcccaactagttgggaggctgaggcaggagaatcgcttgaacccaggaggtggaggttgcagtgagccgagattgtgctgttgcactccagcctgggttacaagagcaaaactccgtctgaaaaataaataagtaaataaataacgacatagaagacagaatatggtaggcggtaaaagggaaatgctgagcagcagaatgagagtagtcagagttaagaagagggaggcatcttgggagatcggctgaatgagggcaaacttgatgaaggaggtggcatgtcagttgggccacggagaacgggtaggattatctactttgttctgcatacatctccctaacccttcccttaagcttctcttccaaagtttctctgggaagtttctctttcccttcccagactaaagctctttccctgctgtttgtcctctcttgcttggctcaggctatgatggaaaacgtcctcaggctgggtttctgggtgccagatggcagccaccatgggaggaagggtggccgagtactctcagggcccggctccttggtgaccagccaggtgccctccagccagcggccccagcatgacacggtccaggtaacctcccttcaccgtgctattgggagggtgttttccaggactggtgtgaagtagattcagttcccgagaaggacagagctgcctgatgcgtgaacaggcctctctgagaccagggaggccacagctctgagacatgaagcagatgctgctcctcagggcctgtggagagagaactctaccctcttccatttctgaaagccagtggaggcttctcctcctctggaggattcatttcatttgttagttaacgcatccattccttcaacatagattcattccatgtcagctctgccccaggccttatgctgggctcggggtgtggaaaatggaatcgaagctggtctctgctcctgagaggcttacagccccttttagggtatgtgctggatctggaaagctgggatagaagaaattgggtgactgtgtattgtctttgtgcttttgtgtttttttagaggcttctatgatcagaatatttttggactaatgatgtgagttccttagataatttgaaaatgtgcccctatattctctactgtttagagtggtataatgttggcatgacctcatcttcctttcaagattacatattaaaagaaaatttgactttatattaaacgaagtcaaagctgggttcagtggtgagcacctgttgtcccagctgctagggaggctcaggcagaaggatcacttgagcccaggagttcgagtccagcctgggcaacataatgagaccttgtctctaaaaaaaaaattaattaattaaaaaataaataagtaataggaatcagaccccagcatcatagttgtgcatattacctgttatttctttaagagatatcccttctccttgagttccatttttatgggaattacttgctttaaaaaaaaaaaacacacacacacaaaaacttcaaagatacagcattgacatgacgataaacttccatttctttaaataagctccttgcaacatctgatgtatctgtaacaaaaagaagggcaggagaaggagcttgcatttatgtttatgaacagggtaaactcagagacttgcaacctttaccccgccctcccccaccccaccctcaagaagtcccgaagaacaaaaggcaattcagatggcagaatattacttctgttgctgtagcaccaaactattaaaaataaaactgtccctcaaggcaaaacatttcatttattttcctttgaatgagtaacttgtttattaagatgaactaagtggctaaatctagatggtacgcaggcaagaaaaattgatgtattgtagcctttcggaaagtatgctttatgttccctggaatcatctctgggttttaaatgaagaagagctcgtttagtcagatggggagctgctctccctggaaataggcatcacccggctctgcaatgtggaatgtcatatttgaccttggttctttcgcaaattggttctttctgggctaaatcagtgtgttgaaagagttagctaggtttagtgatcttcaaaggaggaccacgttcctgcctcaactgcgtctgcagttttttgaagtgtttaatataaaatcgtttcacttttgccttatttcatatttgagatcactgtgctactgcatctgttagagaggcaacacagagcacagggagccaactgcagtccctggagcttctgagagagctccctttgttgcttcctgacccagcctcagaggcatcccgcccacagggaaggatatttgtctcagcagggaggttccccattactgtctcctcatctggggacacaaatgtgatgtccaattcccctctgattgaggtctcatttgccctaaactaatgcaacttgaaaggagaaaagggtgtcaatggttaaaacaacaacaatgacaagaacaacaaaaacctccacccaatttagcagtgaaacaggaaacgccgtattgaggagagaagcttttagttggaaaaaaaatttctctttagaatttggacaacaaatgactctcactctcttttctggtggtgattgttttatttgttaatttttttttttttttttttgagacggagtctcgctctgtttcccacgctggagtgcaatggcacaatctcggcccgctgcaacctccgctgctggggttcaagcgattctcctgcctcagcctccctagtagctggcattacaggtgcccatcaccacgcccagctatttttttttgtatttttaatagagacggggatttttaccacattggccaggctggtctcgaactcctgacctcaggtgatctgctcgcctcagcctcccaaagtgctaggactataggcatgagccactgcgcccggtcgattgttttattttaatatcacgacacacatattattcctgatttgtaatctcacgatacccgccttgctcgccaagagtcctgagtgctggcctggtaaagatgattatctccatctttcagacgaggaaaccaaagttcagagcacaggtccgcagaacagtcacagctgccagcagttgcacacccacatgcgccatcccatttgatcatcaccaacctgccggttaggttttcttgtcacccgaattttacaaaagtggaacagaagcaccgagagaataaatgagctgcctgagattcatcaactgctggtggaactgggcttagtcctgcattctttccaaagcccccatgcggtgactcagtatttggccatttttctttatcctttttgcctggtgactctgaagagagcccacctacagtccagcatgtctggatcctgtgcagcgggcagaggccagaggccatggtgggggccccagaactcaggctgggaatcccaggggctactccagctttcatgtcaccagagcagtgacattcgggccctcgggggcagactgtgcctgtggcttctcagtggggtgccttagggtcccctcagcagatggatcccatctcctggtctggttagcataagataaacagggatagtagcagcagttgtcactctgagggagggaaggggaagggagggctcaggtgaaaagcagaagggaactctatggctgtctttcttctccctgtttacctgtccacccatctgagagataaaagaagagcagaggagggtgagtgaggaaaaagcaggagggtattgggtgtggggccgatggttttcactcaatccgccgggagatctgaatatcaactctctatggaagaacaagaaccgaggtgtctcttctgccccatttctagcccagggtgaccccaggagctctgcagtgtgccgcatggaatcgcctaagatgggactgccttggaacaaacagtttcaatgtctatttcacatgtgcgctctagctcagaattttaataagcaaatatacatggtaccttgccgtaggggggctttatgtttctaaatctatgaattaataaacaggatgagcctttttaaaaaagggagcttggggcagaatgaaccactaaaaagttattggctcttaactcctgctttttgtagaagcttgacaggcagctgactcagccagacctgaaaccctttccccggttcttgttggcatttctgactttgccatttcagttggcactgacccttccaagactgtgtatgccaggagggagcatctgcccccatctactctctgggaagatgtcctctcccaagagtcaagagtgtcttgttctgaccgtgggttacttctctgtgtctgtctgagaggggaaagcattgtcatcacacaggaggtagcaaatacctacctctttttttttttttttttttttttttttttgagacggagtcttgctctgttgcccaggctggagtgcagtgatgcgatctcagctcactgcaagctttgcctcccgggttcacaccattctctcgcctcagcctcccgagtagctgggactacaggtgcccgccaccacgcgcagctaattttttagtttcaccgtgttagccaggatggtctccatcttctgaccttgtgatctgcctgccccggcctcccaaagtgctgggattataggcgcgagccactgcgcctagtctgctctggtttctaatagaagtaggtatttgcagctaggcgcggtagctcatgcctgtaatcccagcactttgagaggctgaggcaggcagatcgcttgagcccaggggtttcagactagcctgggcaacatggagaaactccatctctacaaaaaatacaaaaaattagccaggtgtggtggcacatgcatgtagttccagctactcaggaggctgaggcgggaggatcacctgagcctaggaggtcaaggctgctgtgagctgtgattgcaccgctgcactctagcctgcgcaacagagtgagatcctgtcccctccaccccaaaaaaaagaaaacaaagaaagaaaccagaacaccaggtgtgtcttcctgagttttcaccctgatcactgcctctcctgccagctccctgctttccagggaagagttggctgcgccaggggacagagcactgactcccacccaggccactgggacagccatatctaggcctcaaaagactatgggggttcctagcaaattccaccttatttgacttctccgaacagcccaaactctgctgggcttcttcccttgccttcataggagacttgatgcagggggcagaggtgagagcccagggggacagctggccttcaggaggggtccttgctgggtgtttccaggagagcttcggcctctctctccgcaccatgttccaggtggcgttgaagaccagtgggtaatttggggggtgtgggaacagaaaatcagaggaacagctagtgttttcttccttgagacttgtttcccctttgacagtttagatggatagtaacaataatcaccgataggaaagtcatcctgactggggtctgaagccttccgtggatgttcccgtctaattctcacagtaaccctgtgggcttttaaggtaagaatgatcactgactccacttttcaccagtgtcggaactgagacttggagaggttcagtgaccagacgatggagtccagggtccagggtccagggtccagggtccggggtccagggtcttcacagcctgtgctccctccccttccgtttctcctcttgctttgggtttgggaagcctccgcggggtgaggtggagagtgcgcctcactagtcaggcaccccgaaggagtaaggcatgtgactgtacaatatcccaataaagcgtgtgggtggtggggatgggtgggcgaggttgagatccattctttaaggcattaaatactgtctctttcaaaaggaggttgtgctgttttgcagctggttttctttaactaccagaaacaccagcattgtttcagaaagccacagaatttccaaacacaatgagaattccaagaggatggggtgtgggttttgggggctggggtgggtatggacaggcttttggggagggaagaccacagcctgagtggttttgtcccccacgggtaatgaatttcacacggctccactgtcctcagttttatctgcaggatgctcaagttgaagcctgggaaagaaggggatcgggaaggagcaggccccagggattacagtggccataaaaaccaaacagtgacccaggacagccccatttggtgtgacctctaatgactgccttccctcagctggtgtcagaggaggcacatggtgtcagttaagttccaaagtgacatttgtataaataagtttgttaatgggaaatgagtttttttttctccctctccaatcttaagaaagtgtgtagcctatatccaaatatttctgaaagagcatcaacagtaacggcaaacaggggagctaatgtcaccaacaaaacttgtgaggtcaacccaaagaaagaagggaataaatgagcaaaactttggaaagagtttctcacatgctgaaaacactcagcaatatttctaacaagcgtggtggcccttcagtcagaagtggcctttctctgaagtttgaagtaaaaaaaaaaaaaaaaaaaaaattctgttcttcctgcttttttttttgagatggagtttcactgttctcacccaggctggagtgcaatggcatgatctcagctcactgtaaccttcgcttcccctgttcaaaccatctcctgcctcagccacccaaatagctggaattacaggcccctaccaccacgtccggctaatttttgtatttttagtggaaatggtgtttcaccatgttggccaggctggtcttgaactcctgacatcaggtggtcagcttgcctcggcctcccaaagtgctgggattacaggtgtgggcacaccgtgcctggcctattcttcctactttttatactttgtgtttgcattcaacttgacaaactcaggcagccttaccagatagcttggtatttgtgagattcagttctgagttttgaagtaaaattttaaatgtgattgtttttatcctttaaagtatagagaagtcaatagccttggcttctaggtctgactgactgttctatggataatggatatggataatgtgaattggaatttatatccgtggaatcaaacatgttcaactgcatgacatgcatgacagaaagtggcacttggcagagacagagagggaaacagtcattctcccgagctgtgaagagtgcaactctagagtacattctcagttcttttatctgtggaggaaaaggcacgttgtcatggttaagaaatatcacatgccaacttagtgacgggggaaagaccctcttaacaaatggtctgggccgggcctggtggctcacgcctgtaatccagcactttgggggctgaggcaggcggatcacctgaggtcaggagttcgagaccagcctggccaacatggtaaaaccccgtctctactaaaaatacaaaaattagccaggtgtggtggtgggtgtctgtaatctcagctacttgggaggctgaggcaggagaatcgcttaaacccgggaggcggaggttgcagtgtgtcgagatcgtaccattgccctccagcctgggtgactagagtgagactccatctcaaaaacaaacaaacaaacaaaaacactaacgtatactctagaggcttacacaattaattgtagaaaatgaaactctgaaagaactagaagaaaatataggtgaatttttatctaatctcaaaatagagcagccttattaaaatacgacagaagggaagcaaaatcaataaatgagcctgaggttgaattacagattacttgtacaagaatattcatagcagcaccacagcaaaaccttgaaacaacccaaatgttgcatattgagagtggataaacaatagagtttttcacacaaaattttcaaaaattttaaaaacaatacccccaaatcgacaaattgtaatgacatataatcctatggctaaactttacaatataatattaagtgcaaaaaacgttacttaatacacaatagcctttcttaacccaatgttttaatatgaaaaatttcaaacattcagtaaaactgaaagaattttctcgtgagtacctgtatgcccatcatcttgtttatccctttcacactttgttatgtttgctttctcacatactcattcattattccctctaattcagcagtcctcagcttggggtgattttgccccccaggaatatctgacagtgtttggagacagttttagttgttacagctgggatagggtactactgacatctggtgtgggtagaggccagggacgctggtcacagcctgcattccacatggcaagcccccaccacagagaatcagctagccccagattgcagcagtgctgaagctgagaacccctgctggaatccatcttattttctgatacatttcagagaaacctggattcactggtatacttcctcctacatatttaagtatgtatatcattaactagatttccatatttatttacagtgtttttcttttgatgtgaaatgtacatgcaatgaaatgcagaagtcttaagggtacattcactgagctttggtcagggcatgcacctgtgtaacccagactcctgtcaggacagaggaccttaccattggcttagaaaatcccccttaactcgtctccagtcaagcctttcagcctcctttccccaggaggcaacaattattctattttttttccaccatagaaaaaagttagaacagtggttctcatagttttgtgtgttttagaattgcatataaatggaataacaacagatgcacgctttgtctgagacttctttcactccatagcacagcagttctgcaagtgtgttctgcagacctcttaggttctccaacactccttcagggggtcccatatgtcacagctattttcattataattctgagacatttttctcctctacactgtgctgacatgtacgtagatggtgcaaaggtaacggtgggtaaattgaggcagtagcaccaaactgtacctttgtcagtgtgttcttcatcaccaccaacttacagaaaaaggagtcagcatcacttaaaaatgccctgggtgaagcagaacagatgtgcatctttttaaatctcagcccctgaatacatgttcttttaatattctgtatgatggccgggtgcagtggctcacgtctgtaatcccagcactttgggaggctgaggcgggtggatcacctgaggtcgggagttcgagaccagcctgaccaatagggacaaaccctgtctctactaaaaatacaaaaattagccgggtgtggtggcgcgtgcctgtaatcccagctactggggaggctgaggcaggagaatcgcttgaacctgggaggcggaggttgcggtgagccaagattgcgccactgcactccagcctgggcaacaagagcaaaactccgtctcaaagaaaaaaaaaaaaaattctgtatgatgtaatggaaggtcctcataaagcacttccactccaccgtagtagcacgattgtcttcaggaagggcgtatacgcagttgtttgagttgccagccaagctagctgcttttctcatggaacaccatttttacctggaagagcaactgaccaactacagttattcaggtttgcgtatgtggcagtgaagctgtcacttcaagggaaacagctgacagcatttgttgctattgatacaacttgaacttgcaaggaagaattagaatttttgaaaacttgtatttgtcaccatgaacttgagagcttcccaataactaacaatttttctgacaagattggtggtgatattgacatatgatttaaaaacataatgacatgcatcaacatttgcaagatatgtataactcactgaataattattttctaaatgacctgtgtaggatattatacagttatacacaggtaaaagttccattccaactgtggcgtagaccaatggatttccatgtagtggagtagaaaaagtttactgataacggtttcagggcccatattgcaactaacctttaagaaactaccacttttaaagttttggtttgtatcaaagatgaatagccataattatctgaaaaggctattaaaatagttcttcatattcctacttcatatctgtgtgaggctgagttttctctatattctccaaccacaaaaacttccagatgagtttccaaggtagtttacaccattttacacttctaccacaatgtctgagactataatagcctttttacaaatttacaacagcaaaacacacaatttcagaattcatagagatgagatactactgtgtaaaaagcaaagctggggactgatacccacaggacttgaggtggcagtaaccttgggtgggagagtcctgcatagccagatgtgtacctggtgaagggccagttaaagcgctgttgtttaaaccaaggagaagggtcctgggggtgccctttgccataggaaactatttcccatagtattagtatctgtggctaacaacatggccacaggctgtactttcctgtccaatctctgtgtatctaagtctgctgaggctgcagattcctgcaaagagcagtcgatggccctctgcaggagggctgatggagaaaacatgcgtcggatgcttacaccggccgtgtcagagaagaggaatgagcctattgctcctgccatgtaatgattcctgttgggagtcagtgactccttttctgtggggctaccctcacccatccacatttctggctttccttgctaggggttcttccctcgtcttccaagtcctgtgcaggtggctggaggccagagaggactcatttggctataatcagaggcattcccctttcctcggtccgtagggatggaagggtttgagcccgagtttatttacccttagcaaaacacaactaggttttattattattattattttagtgcttgggataaaaaggcccataaaaacaatagcataaaacagcttttactgatcaaacgtcatgctgatttatttgtgagtgaaatctgaaccatatggtctggcttcccttaaaatgcacagggggttcaggattaagggaacaaactcttggcaaatttgttttgcgtttcactgagcacatcatgttagaaacaaaatagagcaattgttgagtgcttactgtgtgcaggaaattgtgcttagtgattgatgtccatgatctcgcttcatcttcacaacgatccatgcagtcagcagcgttccccacgaggggcagcagcagtgctgagctcagggccctcatgacctgcaggaaggtgggcaaagtggggaagatctggaatccagtggggaagagtcgtccaccagtgacagcacttccacctaaagtcccctgatcgtgaaagagatgaaactgcaaacgaggacgtgaacttggggcctgtggatcagctggccttctcaggttgcagagagccagctgtgcattgtcttattcccttgtcccagcagagactgaacgctaagtctttcccaccatcaaggcatgaggtttctctctttgccgcatttgtgttgggcatctcagccctcagtctgtattcttgtggagggtgcacctctttttttttttgtttttttgtacacacagttttgctcttagttgcccaggctagagtgcaatggcgcgatctcggctccctgcaacctccttttcccaggttctaagcgattctcctgcctcagcctcctgagtagctgggattacaggcatgcaccaccacgcccggctaattttgtatttttagtagagatggggtttctccatgttggtcaggctggtctcaaactcccgacctcaggtgatccacccgcctcggcctcccaaagtgctgggattataggcataagccaccgcacctggccagatgcatctctttgagtttgggaacgaaaagggtatgatggcagaatcatgtgctgccagtcatgatcacagtgatgttcattctggttcctgggcttaagcttctaatttgctgtaagaaagctcagtgggcttgccctttgcctaagtgaaaccagcttatttccacttttcttcaggcaccctcacggacatccagtgccacggtcctgctttgtcaggcagcatctttcagattcttgaaagacaggcagcttgtttcgaatgacccacagggaatggtgcaccattcactcagtccacccctagcacgggccagtcctatgtcgttttttggcatttttgaggaacagctcccttttcagtaccaggtgacattattacccagatccagttgcggagaggcgtgtgtgtctgtctggttgagctgaaacgtgggcagatcagaaaggaaggaaaactggattaagccaggatttgcttacctggaaggtccagaaagaaattccccttccttccacagccagaggatttcaagtctataatgttgctaaaattagcagtgtaacaaaacttcccatgtgatgtagcacaggttgatggggtaagccagtgtaacatggaaacccactggcacctctgcatctgggcctaaggctgcggcctccgtcctcttcgccatcattggcctctcttgtttcttcccacccctgtcacaccgcccttgaccatggttgtctgtcatgtggattcctcacgggcagagatactaccctctgagcttgctccctgctttgctctggagtgtggaatttaaaacttgtaatgataggagaagggaagaacacagttacagtattagactcactgtttcctgagccactaaatgtatcagactgttatatttgggttattttccaaaaaccttttggtagtcattaaaaaaacactctgaggctgggtgtggtggctcacgcctgtgattccagcactttaggaggctgaggtgggtggattacctgaggtcaggagtttgagaccagcctggccaacatggtggaaccccatctctactaaaaatacaaaaaattagccgggcatggtggcgggcacctgtaatcccagctacttaggaggctgaggcaggagaatcgcttgaacccgggaggcggaggttgcagtgagctcaggttgcgcctctgcactccagcctgggcaacaagagcgaaactctgtctcaaaacaaaacaaacacactgtggctatatttattcatggaaacaatgatataacattcttagacttgccttcaaaggccacctgtattaatagggtcccacgcatgccacttataacatggattctgtagcacattgggacatcggaagccttctccattcactctcccttgctctccctattgttccagcacctcctgagggggccctctttcaggagctttgatcattccctgcacttgtacatttccataactagcaccacctttgtatctagatgtttgcatgcaaggggcatctccaggtatcttcccatgtatccttagttgcccaggcgggcggatcacctgaggtcgggagttcgagaccagcctgaccaacatggggaaatcccacctctactaaaaatacaaagttagctgggcctggaggcgcatgcctgtaatcccagctacttgggaggctgaggcaggagaattgcttgaaactgggaggtggaggttgcagtgagccgagattgcaccaccacactccaccctgggcaacaagagcaaaaactccatctcaaaaaaaaaaaaacaaaaggcagtttccgcagttgtaagtaggactagaggaaagagtgatgataatattgataacaataaaatacaattattgagtgcttactgtatataggagatacacttagtaatttacatgtattatctcacttaatcttcgcagtaatctgaggagataatgttaccctcattttgcagctgaaatgtagcaggttgcttcacccctggaggctgcacgcctagtagtgatggagcagaggcaggagcctagcgtcacctgactccagagttcattctccaatcaccgcatgatactgactcctaatcgtagcctgatggctttaacaagagaaaataaggttaccttccagctagagggatttattattattattattattgtatttctttatttattttgagacagggtctcgttctgttgcccaggctggagtgcaatgatgcaatcttggctcactgcagcctccgcctcccaggttcaagcgattcacatgtctcagcctccctagtaggtcagactacaggcacgtgccacgatatctggctaatttttaaaaattttttttagtagagactgggttttaccatgttggccaggctggtcttgaactcctgacctcatgtgatccacccacttcggtctcccaaagtgctgggattacaagcgtgagccaccgccccctgccggatttatcttacccatgtgtctctgacaggatatattgtcaaattcccaaactgtatttttaggggggttgcaaattttgcttccaaatgatcttctaagagcaggatattctctgcctggagtgatgagggtaccatttctaaaagaggtacattgtagttcaaactcctgcaggtaaggagccgtgacttactaactttcaactttgacacattcgcaggtaagagcagagctacgcactacagcaaaatccaggctgtccgtcagcagctgatgtgcccggtaccttttgtcttggccatcctgttgttcattaatctgatgtatactcactgtgtttgcgtttattttcctaacatttttagcctcatcctattcctataagtgacaggcactgtaactattgaaagtactgattaaaagtagtgtttgattattctgtaagcaaagtaatactttggattaaaacaaagtgactgtcatctgaatcttaatttctgttattttccaaatttctttattcattctcctgttgatgtatatgaagatgaacaaagagagcaaataaaaccactcagaggccgggttcggtggctcacgcctgtaatccccgcactttgggaggccgaggtgggcggatcacaaagtcaggagttcgagaccagcctggccaacatggtaaaaccccatctctacaaaaaatagaaaaattagctgggcgtggcggcacatgcctgtaatcccagctactctggaggctgaggcaggagaatcgcttgaacccgggtggcggaggttgcagtgagccgagatcgcgttattgcactccagcctgggcgatagagcgagactccatctaaaaacaaaacaaaacaaaaagcaaaaaaaaaaaaacaacaacactcagaacccacacctacagtgtaactagagacgaggtgtaccgcagacttggggaaataaatgtcccgaagcagcagagctaactcccagctcccaccaaaaacgatgttacttccaaagatactgcacttgaacaactgaagagagtgctcttgaaataagaaacttagaggcacccaagggatttcagacctatttttgctggtctaagaaaatccaattgatgtaagaatgaccagaaaatggcagcaaacatccataaaaatttgctataaaaagaaaactgccgggcgtggtggctcacgcctgtaatcccagcactttgggaggccgaggcgggtggatcacctgaggtcgggagttcaagactatcctgaccaacatggagaaaccccatctctactaaaaatacaaaaatcagccgggcatggtggcgtgtgcctgtaatcccagctactcgggaggatgaggcaggagaatcgcttgaacccgggaggcagaggttgtggtgagccaagattgcgccattgcactccagcctgggcaacaagagcgaaacttcatgtaaaaaaaaaaaagaaaagaaagaaaggaaaaagaaaacgaaggaaggaaatactccctgaaaacaaccatgaagaaaatgaaaattgttaacaccacctccaacatgaactaaatataattgcacaagcatttaaagaaatgaaagaaaacctaataccagaaatttgaaaaatctcaaacaaaatgctggaaaatgtaaaattaaagattatgacatgccagaaagaaatggaggaaaaagacaaaaaaaaatcatctcaggcatgaagacgagattacaagatgtccattcagattctactgaaaaaaattataagggatattgagaagaggaacgaaaccattcaagacaacaaaaatgagataaagagaggtgaaaagaatcagagaaaaagtgatatataagctaggcaaagaaagtccaacacacaaaattgaagttgaagaacaagcagatggaataaaactaatatttaaaactacaatctaggctgggcgcagtggctcacatccataatcccagcactttgggaggctgaggtgggcagatcacctgaggtcaggagtctgagaccagcctggccaacatggtgaaaccccgtctgtactaaaaatacaaaaaattagccgggcgtggtggcaggcacgtgtaatcccagctacttgggaggctgaggcaggagaatcgcttgatcccgggaggtggaggttgcagtgagccaagttcgtgccactgcgctctagcctgggtgacagagcaagacttcgtctaaaagaaaaataaataaaactagaatccaagaattctttatggaaaaaagaagatgtgactctacatactgaaagtttctacatgcatctgggaaaattgacccagcgtgattaaattctagatgtatcctcataaactttgtggttaaagatgagggagaaggaggaggaggaggataaggaggaagaggaggaagaaaacaaacctctgggcctccagtcaaaaataccaagtcacttaaaaagaaaaaaaaattagattggcatcagccttatcaacagctacgtgcaaagcaagacaaggatggaacaatgttttcaagaaaggtaaggaccatctgaatcaagaattttaaatccagcccatctgtctttcaagtatcaaagttatcgaaaaaaaagttttaatcctacgagaactcagggactactgtcctaacaactccttcctaaagaatatgccagagggttgttaccatcaaacagagagaagactaaggaaatttgtcaaaataactggtggtttgaacaaaagatgcaaaactactttgaaagagggcttcatgtttcagagattaatcggacgtatccatccataagatccttgccaagaaagtttgaataataaaacaatggagctagattgcaatgttttcaccaaatccagaatctctgaagaaattaggatatggctttggcagctctagacgccaaatttgtaaagcaagagaagggaaaaagtgcaagtaattaatggagcttggaaaagacctgaagcaggacagtcaggagtagatgaaagggttttctaagaaaagaagtagaaatgtggaatttggtaaattttattgagaaggcacccgagtagatttaggcttgtagttcttacaaacattaaaaatgttttattgtattaaagagctaatactccttaattatgacttcattatttatgttacagagaagatctagatgcactatttacctccttttgttcctaacctagaaatggtagcaaatacatgtggtttcatttgttttttttttttttttgagatggagttttgctcttgttgcgcaggcaggagtacagtggtgcgatctcagctcaccgcaacctctgcctcccaggttcaagcgattctcctgtcttagcctcccgagtagctgggatcacaggcatgagccaccactcccggctaattttgtatttttagtagagacggggtttctccatgttggtcaggctggtctcgaactcccgacctcaggtgatccacccgccttggcgtcccaaactgctgggattagaggcatgagccatcgcacccggcggtttccttcctttcctccaaagtcacgttgcacatcaatatgtgatttggcaatggttctctttttcactgagccccagtgaagcctcagaattctactcaacgtagcacacgaggcagccattactactctatctgcatttgttggaagttgaaatatatttgctatccctgccctaattgtagggtctgtagcctgattacttggcatcttcatctcacttgtggaaactaacgggattacagacgcactttctcagcaagcgttcattagtcactgagtaaatgacaaacaatgtatgaggctctgggcataatgaaatgattaggacacatttccatcctccaagaggctcacagggcccagaaggaagtgaatgattctgtagaatttgccttgtgaatgtgttactccttaagttatatcgaacattgcagtgatcaagaaatattctactttgtagaaagatcctggaatcacatagaccccaagttttaggcatggcaaaactttatgcacaatttcatatgtaaagtgattttctctgtcctcatccttagtaccttgctactcaaagcgtgacctgaggaccagtggaaagatattacctgggtacttgttagaaaatgcagaattccagtcccataccagatctcttgaaacagaattctcattgtatgaagatacccaggtgacttgtatgtacataaagtgtgagaaacactgcagactcttagtgtccagctagaacaagattgatttgccacctgccacttttctttctccctacacacacttaaaaaaaaatctcttaactaaccacagacacatattccaaatctcatgttctctctgtcataattttcttatttgtaaacttaacatgggaacactattagtacctgtcctgtctgatgagagtgagcatttgctgagatcatgcatctgtggtgttcagtagagtgcccagcttcataaatacatgttatttgtgaatgatatacatgatactagtttaatggaaaattgggacttagaaataatgtttcgggctgggcgcggtggctcacacctgtaatcccagcaatttgggaggctgaggcgggcagatcacctgaggtcaggagtttgagactccagcctggccaacgtggtaaaaccctgtctctactaaaaatacaaaaattagctgggcatggtggcgggcacctgtaatcccagctgctcagggggctgaggcaggagaattgcttgaacctaggaggtggaggttgcagtgagccaagatcgcgccactgcacttcagcctggcctttagaacgagactccctcttaaaaaaaaaaagaaagaaaagaaaaaagaaatttcaacaccgtagcctgttcccagtggaggaaattctgaactttctcgttgttggaactttgtttgatacctctaagtaaatacccaataaaatggtatctaacgcccccctgccgggctgggtggtacccacacttgtacctcgcactcacactcacacacgtcacacacctgtcagggggcacagccccaggtgagcctgagtgctgtgcttgcctcgtggggtgctccatggagatgggtctcccaggcctcagggcttcctgggtgcacctcccgtttctgcgtgcagggagggatggctacaggactgggcgggagaactttcccagtgtggtgaggcgtgctggtgagacagcagtgtttcctgggttacatgtgggcaggactgggttggagatgggcccgcaatttggcctcctgacttggggtgctccagtctgcaggtggaagttcttcccggcggcttgcaaagaagaaaagcgaggagaagggcactgatttattcagcagggcatttccttggtttggctgaaagcttttgacttgcgtgagctcagcaggggagcgccgtttccaggcctcgcaacaccggcctgctattaagtgtttctaagagaataaaagcctgttgtgttaaaaggacttgccctccgccagcagcagtgggcccattagccaatccgttggacacccggtggcacacaggctggctctgcaggaggtcctcctggcctcctgcccctgtgtctttcagaaggcagagtccgtgggagagatctgcttccccatcctcctgcctggtggagctgagagtgtcaactgacactgtcccttcggcctcctcctctgtccctactgcgctgggttgagttgcctgtggaggggctccgcttcccttcctttgtggagctgatgtgttcaggaaaatattcgaatatgttagatttgtataaactaggtcattactctcttgctttaaggttatacttcaaaggccatagttaattaaaggtaggtgtcctttgtcattcaaagtgaacatttgtgtcagttcaataatatttgcttttaaatttccgttaagacatacgggttgggtgtggtggctcatgcttgtaattccagtgctttgagaggctgaggcaggaggatggctcgaggccaggagttccagaccagtctcggcaacatagcaagatcctttccttaaaaaaaaaaagaaaaattagccaggcatggtggcattcacctttaattctagctactcaggaggcagaggtggggggatcgcttgagcctaagagtttgaggttgcaatgagctatgatcacgccactgcactcgagcttgggtgacagagactctggaaacaaagaaaagaaaagaaagggagagacggagggagagaggcagggaggaaggaagggttcagaatatagaaagagggaaggaaaggagggagggaggaagggaataagggttcagaatatagatagaaaggaaaagtccacagaaaactggagtaaagtctgaagctcctgaaataatagtcagtgtgctaagcaggaacagtgtgtacaattttaagacatgagagtgaaataccgggtttgtcatttgcataagtttttgagtagttagaataaacagtgcttatcgccttcccaaaacaccccaccactataagctgcttgtacacactgcatcacttatttttttttttttttttgagacagagtctcgctctgtcacccaggctggagggcagtggcaccatcttggctcactgcaacctccacctcctggggtcaagtgattctcctgccccagcttcccgagtagctgggactacaggtgtgcgccaccatgcctggctaatttttctatttttagtcgagacggggtttcaccatgctggtcaggctggtctcgaactcctgaccttgtagtctgcctgcttcggcctcccaaaatgttgggattacaggcgtgagtgagcctctggcatcacttatgttttaatgaccaaggtgtatacaggtaagaaagttaagcatgtaagtgccaagttcatgtcttggttctatcatttaccagccatgggctttgggcaagttagttttaacctcattcagcctcaacgtcttcaactctaaaatgggaataaatgttgcctccatcatagatttattgtgaaagttaaaggatattgcgtataaaatggcttagcatagttcctgggacgtaattgacaatcaatattataattattaatatgtgaactataggatttttattatttaaaagaacctttaagtgaatttcttataaacctataatgttagcaatgctatgaataaaatttgttttataaggttgaagtttggtatgttgtattttcttgaagcaaattttataatgcatgcgacttgatttttccttgtcctttcctatttttggtaagaatgtctaaacctgaaaacaatggagtgtagaaataaaaatacatgatgcggaatctgagaatgccaatgctaggggaaaggaatactgagtgtgtgtggccgtgagccccgtgggggctgggatttgctcgctgctgtatccccagggcagaacaccatgggtggcatgcagtaggtgcctaatcagtgtgtgttgcttgaataaatgaatgagaccacatagcccaacaccttcattttgtagatggaaacataaggcacagagaagtaaagtgacttgtctgaaattacttaaggccgatctgggactgagtctctggtccgtgtgatcacaaatgcttctaaggctcacaacgtagcagaatttgtctgcaatgaagatcgtggtgtcttcagcagcacactggctggctggttatctctctttcttcctctgtcctctgctccctctttctacttcttcccttctttcttcctcccattcttgcccattgcccctggtggcgtgtcctttgctaaatgagggctagacagatgtaacttacagctctgtctcataccacgcaactctaaagtccatccttagactacgacttagagcagatgtgaatgtttaacctcccttctctctggacatatggcatcatcttatttctctgttagctggtctgccctcctgccacccatttcaaggcactgttggctcctggaagccatctggatggagtttttgtaacgggaaagtgctcctccagcacccaggaagccttgggtgggtgatggtccctgtgatcacccagccgtggtaaggcctgcttcccttgcttagcaaaaccgtaccctggtggatggtgatgctgcagccggggcccagggggtctatgagcatcatggcaaaaaagcctttatgggagctcccagtttactactttcagcctttcggaaacacacacatttccttccattctttactggcaacactgtcttttgtacagactgtatttgtttggattaatacagggagtctgcaaatttttgttcaaataagaatattgtagctgggtgcagtgttccacacctgtaatcccagcactttgggaggccaaggcgtgaaggttgcttgagctcaggagttcagagccagcctgggcaacatagtgagacctcatctctgctaagtaaataagtaaaaattaatcaggcgtggtgacatgtgcctgtggtcccagctacttgggaggctgagatgggaggatcacttgagccccggaggtcgaggctgtggtgagccatgattgcactactgcactccaacctgggcaacagagcaagaccctgtctcaaaaaaaaaaaaaaagttgttatttggccaggcatgctggctcatgcccgtaatcccagcactttgggaggccaaggcaggcagatcacctgaggtcaggagttcaagaccagactgaccaacatggtgagaccccatctctactaaaaaaaatacaaaaattagctgggcatggtggcaggcacatgtaatcccaactactcaggaggctgaggcacaagaatcacttgaacccaagaggcagaggttgcagtgagccgagatcgcaccactgtgctccagcctgcgtgacagaaacttcatctcatctaaaaaaaagaatattgtcatttgagaatcacaaaactctgatctttttaaacataggagagtgatatagagcagtgcttctcaaactgtatttgatgaaggaccagttttcaaattttccatatcgtgttgcagatcaacctatccatcaaagacaataaaaatgaatagaaaaatggaaaaaaatcccaaacccaaaagacattaaaaagtcctcaattttttttattactcagaacaattgggctgggcatggtggctcacacctgtaatcccagcactttgggaggcagagacgggtggatcacttgaggtcaggagtttgagaccagcctgcccaacatggcaaaaccccatctctactaaaaatacaaaaatttagctgggtgtagtggcaggcgcctgtaatctcagctactcgggaggctgaggcaggagaattgcttgaacctgggaggcggaggttgcagtgagctgagttggtgccactgcactccagcctgggtgacaagagcaaaactgtctcaaaaaacaaaacaaaacaaaaaaaccccaattgatctaaaattatacatattgctgcaaaaaattctaaatgcttagtctcaatttctacacttccttctgggtgttggtagcaaactctctgtagacccgactttgaggagctcttgatatggagacgtggtttcttacgtctaatttcgttttccaccatctactgcaagagttgtattttctgcctcacgtcgctgtccttctcccagcccattcattttacttcccctctcagaatggcctgtgtagtgggaggcccaggacatttagtggaagatggacatgggcaggagttaacgcgtcctccagagaatgcctccatgttcttccgtcatccgtgcagatatcaggctgcagtcccgcagaaaatgatgatgttgcacaaggcgaagaagcagatattgacatgaggccaataaaacaggtcatgagccaataaaaatgaccatctgattcactttccagaagagctacgttttaatgatttactagaaagcgaattctttctttgcatcaatttttatcaaaaacttaatgccattaataggtgaagaacacatttttgattcattgactaggattatggttagtaaaatgattttcttttgtttgggttttcattgttgttttagacagagtctctctctgtcgcccaggctggagtgcagtggcgtgatctcagctcactgcaacctctgcctcctaggttcaagcaattcttctgctttggcctccatagtagctgggattacaggtgcccgccaccacgcctggctaattttttgtatttttagtagagacgggttttcactatgttggccaggctggtctcaaactcctgacctcaggtgatctggcctcccagagtgctgggattacaggcatgagccattgtgtcctgaccagtaaaatgattttctgaatgttttagtgtttttccttccaaaagttgtctttcctgacagtgtatttttattttactatataaagagtcactttccggccgggtgtggtcactcacgcctgtaatcccagccctttgggaggccgaggcgggcggatcacttgaggtcaggagtttgagaccagcctgggaaacatggagaaactctattaaaaatacaaagattagccgagtgtcatggcgcacacctgtagtcccagttactcaggaggctgaggcatgagaactgcttgaacccgggaggcggaggttgcagtcagccgagatcgtgcttccagcctgggcaacagagtgagactctgtctcaaaaaaaaagagagtcatttcccgtgaaaaccacgtggtctttctgcatccctaggggttattctggtgcctaacgacttcctgagtccactttcgccgcttccatggccacattcgctttatttttctcttcttaggggaggggaaggcagggcatagttgctgtaatttgtagagttgggttgatcagtcgcaccttagtgtatatacctcagtgtggaaatgtctgaaaattgtaactttgggtttgtagaatttgttttccatttcataagtcctggaattttaaagtcctgcattttcggttcgtttagaggaagctgcatatacacatacatgtacagacatacgagtgtgtatagaatgtggagaaataccactgccctcagactctcgtgagattatatttaatctttttccttctagggaaaatttcaaaaaggtaggagggggctcgtgatatattaacatttttaccaaaagctctgttagggctggaggggagacagcagagaagagcaacaagggaagttttagtgagatatagccatatcagaaaagcaacaatacatttagggaagctgggagaggcaggagatgccgctgtgggagggagctggaaggctacagggacctgccagagggaggctggaggctgtgggccaggtggctcagggaggctggaggaaggtcagaaccagcctggcagagagcctgaagtgacttggagaatgaggtggaaagaaacttgcttcctctgtgccctgagctcaaagataaaggactctggcccggcccaaggtccctgcccccagagtccccgcccagggatcatggatctccaccttttcctactcttgggtctcacagggcctggggattgggaaacagagtattgccaagccttattaagcagctgtttattgggtcagaatacacctgtcaggaaaatcatcggtagtgagcagtttcttcccgttaccagtaaatgtcggaatttcctgagtgcagctctgaaggatttagaggtgtcattcccagagattagcagggacctaatctgtgaagtgaaggtggaatgaccaggatggccagagccagaggaagaccacgaagccagagggtgccccgacagaggaaaagcggccggtgggttttagatcctcatttggccagagggaggcagctggatcggcttctccagagcctgctggctggaggttggctgtccgtggtggtctggttctaagtaggagaagaggtggaacttggagctgggcaccagctggcactgctgtgttcagagcatgggaggaagcagcagcagcagaatcccaggacccccaaagtgggagaagggctcccaggtgccttacaggtcacagtcgagggccttcttaaaagctggcccaaacctgccctttccttgcagcccaatggcctcaggagacagtgactcacgctgtgtccacctgtgtcatcctgtggacagctggaggtccacgggaacagctgctatggcggcggacacagccccgtccagggcccatggcagccccagctggctgcccgctccctcctgtgggcagtgcttcacagcggcagcgggagcactgggtgcagcctctggaaggtctggaaggtgcttgctttggggactcggccctggtggatccccttagcctgtggtatgagctcagtccccatttctcaggtggccttcaaggctcattcctgactcacccagcctcatctccagccattcgagatgcaggcgttgtcattccttgaaattctcacgccttctagatcctctgtgcttttcatcacactatttcctctgcctggaatgtctgtctttgcctgggaaacaaaagagaaaaatgcctgactgttagatttaaaatagcatctcaaagctcacgttatttttaaatatttcaaacacatagataagaatagagaataacataatcccagtgctttgggaggccatggctggaggatctcttgaggccaggagtttgagaccagcctgggctacacagcgagaccctgtctctatgccttccccccccaaaatagggaacatattgaatgtccggcattagcgttatcagatcttactgctatgccgtatgtacttcaaatctcgttttattttaaagaatgaaacaataaagatttagctgaggcgctcagggtgccctttcccactcctggtctccttccttgcaaaggataatgtctacccttgtgttaactagcccatgtatggtgttctcatttgagctagatattctacctaagaaatctaaacacatacattgtattggactaataaaaagttgtatgtaaattatatattgtgcatgaccagcaattggccttttcactcaatatgatgtttttgaaatttattcaagttgacacatgtatagtattagcagctgcatggtgttccattgtatatatatgtggttttttgtttgtttgtttgtttgtttgagatggaatcttgctctgtcgcccaggctggagtggagtggcgtgatctcggctcactgcatcctctgtctcccgggttcaagtgattctcctgcctcagcctcctgagtagctgggattacaggcacgcaccaccacaactggctaatttttgtatttttagcagagacggggtttcaccatgttgctcaggctggtctcgaactcctgacatcatgatctgcccgccttggcctcccaaagtgctgggattacaggcatgagccaccgcgcccagccatatgtggtttatttacttctcctatggatggacatttcggatttttccctcagttacctacagtgctgctgtgtgcattcttgcatatgtattcttttgcacctacatggaagttctctgatatattcagaggagagaggaggtaaactgtcaagtcataagttgtacatgtcttcaactttacaacttatcaccaaattgctctccaaagtggctgttccagttggacatgcccatcctgtttctcccttgccaatacttgtctttatcaaactttaaatatttgccaatcacatgggtgagaagtgctatctcattgttttaacgagcatctccctggttcctggtgagattgaccatctttgcaaatgccagttgtgtttccccttccatgacctaaatgttcacatcctttgcccatttttccatttgatgcatatgttgtccctactgatgtagggtatggattctatatatatacatacatatatatatatacacacacacacacacacacacacatatatatatacacacatacataaaaggatcttttgttggctatgtgcataacgtgtttctcctcccagtctgtggttggtcttttcacagtgtttaaagagtctttttaaacaaaagttttaacttcaataaagccaaatttacccccattcttctgtattgcttatgctttttgagtggtttatctaagaaatacaaactccatctgtaataaaaatacaaaaaaaaattagccaggcatggtggcacacgcctgtagtcccagttactcgggaggctgaggcaggagaatcgcttgaacctgggaggtggaggttgcagtgggccgagatcatgccactgcactctagcctgggcaacagagtgagactctgtcttgtaaaaataaaaaagaagaaaaagaaagaaaggaaaggaaaggaaaggaaaagaaagataccctttctatagccttctattttttatttttcccttttttgacttttgagacagggtctcactctgatgtccaggttggaatacagtggtgtgatcatggctcactgcagtctccagctcctcactcaagcaatcctcttgcctcggcctcttgtcctgttgagtagctaggactacaggcatgcaccatcatgcctggctaatttttatttatttatttattttttgtagagattgggtcttgctatgttacccaggctgatctcgaactcctggcctcaagcaatctttccaccttagcctcccaaagtgctgggattgtaggagtgagccactgtacctggcctccttttatatttttttctaaatatcattctatatgttcttctaaaagcccatttgttccattactctgaaagacaatccaagatacgtcagagtctcttcttgggaaatatggaatgacgtcttgcatattgtcatgatatgtagtgggtgggtaaaatccgtgaaagggtgagtattttgcttttaaagttctgtgactatgggatggcactctaagcttcagctgcagttgggaaagacttttgctgtagaccaattttattgtacttagtcgagttctagagggagccaggcccagaaaatgagggggacatttacgtcatggaacacagaggaagactcatgaaatggcaagagaccctcccctcccctgacttccaatgtgacacccgtcttctctgtcctctctcttcatactgttgtcttaggtgttccttgtaaccagacttcaaactatctgaaaacgtttgtgagaaggaacacacagacacgcacactcacacacacacacacacacacacacacacacacacagaactgctttggacttggatacttcctagtcctcctgttattcctatgaacgattccttctgttcttctaagtcccttctactttattcagagattatcatcatgactgctcatgatggcagtcagtttatccagatcacaagtcagaagggtgaaatcggctgaaaagaggatgaaatgttttaaacgctcaagaatttccagtcaccacagtcctgaggttcgttgtttcttttctgtctgaaagctgtagaactccatgcagggagcctgtgagcctcggtgggctgatgaaacactcagaagaaaaaagaacttgatggaggcagttgcctgtttagcagacgggatctgaatggaaggtctgagggtctgcagatgtcagagctgtccatggctttgcctggtgtctgtctgagcgatctggcctttgtccctgatgcctaatctgcctgtttgtctctctgagatagccaccaggtggtctactgatgatcaaagccctcgatggtgcagactgctgtcacccctcggctgagtcccaagatggggagtttgagaatgccgagtcttgctgttgccctttctgaatggggtgatgcctggtcagatttcagtttcctggaacatgtgttaatggttctcagcagagggtagggctttatttacacacctggctcagtctagactgcagacctttcaaaggtttgcagagcggccgggcgcagtggctcacgcctctaatctcagcactttgggaggccaaggtaggcagatcacctgaagtcagcagttcaagaccagcctggccaacatggtgaaaccccatctctacaaaaatacaacaacaaaaaaaattgctgggtgcggtggctcatgcctgtaaccccggcactttgggaggccgaggcgggtggatcacgaggtcaggagttcaataccaacctggccaagatggtgaaactgtctttactaaaaatacaaaaaagccgggcgtggtggcgggtgcctgcaatcccagctattcaggaggctgaggcagagaattgcttgaacccaagaggcggagattgcagtgagccgagatcacactactacagtccagcctgggtgacagagtaagactccgtctcaaaaaaaaaaaaaaaaattagccaggcatgatggcagatgcttgtagtcccagctactcaggaggctgaggcaggagaatcgcttgaacctgggaggcggagcttgccatgagccgagatcgtgccactgcactccagcctgggcgacagagcgagactccgtctcaaaaaagaaaaaaaaaaaaaaaaagaaaggtttgcagagtaactttgtgtggctttcttgatcaactgtgggtggacttaagatttacagccgaataaaggacttaaaaatacagccctggaatttttgcctcttcaaatgtccttcttgaaaagaacccctttcagaaagttccactttttaggtggagccccctgagccaacgctctgctcttcggaatcattgatctgtctggggatgagcaatgctgttgtcttcatcatcctcgtcttcagcagcatcaacagcaaggtgaatatttagctggtacacatacaggtggccacaccactcaccacctgttaaaatattgagacactgccacacgtgttggtcaagagctgctgctctgagtcccagtctccccaccacccaggccctgcctctgggatctctgggacctccccacaaatcagcaatgaaagcgttggcacctgaccccacagtgggtctccagggctctgctcagcactccagctggtttatattctggtaggaagacagacacccacacacccactcccatagtcattgaggaatccattctgattgatgcccatgccacagagttgttaaatatcgtgaatttcaagtcatcctaagacaaaaatctgggctcttttctttggttagaagacaaaggaattccagcgtatgcagagctgtgtactgggttctttggagacattataatatatatagatgggccctgaaaggcttgcttgtaagggcagaacacacacacacacacacacacacacagacacacacacacagacacagacacacacagacacagacacacacagatacagacacacacacacacacagacacagacacacacacacacaaacttaaaaaagcaacatgtcaccacattgacactgatgtagattgtaagtgcagaggggccagagggtaaagatctagacagattgttcagagtgtaaatcacttagttttctgtgttcttaacagtgcctgccactgtggctgcttaggatttcttttctttttttaatatttaaaattttggctgggcatggtggctcgtgcctgtaatcccagcactttgggaggccaaggccggtggatcacttgaggtcaggagtttgagaccagcctgaccaacatagtgaaatctcatctctactaaaaaaaaaaaaaaaaaaaattagctgggcgtggtggtgctcacctataatcccagctactcgggaggctgaggcaggagaatcgcttgaacctgggcagggaaggtggcaatcagccgagatcctgccaatgtaccccagcctgggcgacagagcgagactgcatcttaaaaaaaataaaaataaaatttgagatgcttggaggaatagaaaattggtgaatgtttgaggcaggacgtgctaacgaagagaagaggctgacattctgcccgagaagcagggcacgatggcgtggcagccctgggctgtcgctggagcgagcttgtttatggaagtaagaggaagtgggcccgagggatgcagagcagacttgcagggtcctgaaggctggaaactagattttgggtgtattaggaaaatcatgaagacatgttgaagaactatcagccatctcttaaactagaaggcaggccttgccccagaacaattaagtcatctgtttggagaagagggaacagagaggagcctcgtggcctcaaccactattttatcgtgacattctgcagaaatcctggccattttttcttttgctctctgtacctttctgaacttctctgcagggaagtgttgcagcagatgccctcagctcaccagagcccgtgttagccctggttccggtcctcagtctcactgggtgataagggaagatgagggaaaactacttctatcagtcacagcaccaacagtgccaacacggccgtgcacatccaaatggcttcattatgctcaacagcctgggtgagtctgagccttacagctaagatgcattgctttttttttttccctcggtgtgataaaaatgctggtagtatacttttataccccaaaataactgagcacattgagaaagacacggcgacctacttgggaacttcagcagtattagctggaacgctgtctggacagtggaaggactttttgcagggagctgccgtcagaggactgagagccagcgttcagcacggcatcactgagggcgcctggcatgcctccgcctgcccgtgagaaggcacgcttaccttctagatttctcacactcctccagagttgcattctgcttccgtaactgtcctagaacagcatttcctgtatgaagatacacaggtttggccagagactgaactctggttacttcctgaacttgggaacaatcctcaccaaatccactaactattaatcatggtcacagacactctcttgcttttgcatgctctgctgtgatgaagattgttgacgccaagaactaaatcgtaatgagcccacgtgctcttcacagcaggctccgataacactttgtcgcttttatggttaaacctcctcgtaaaatctctctttaagcgaacacgtgattatccccacggtagtttaaactgaacttgatttgtgagtttatttcttcttttccatctgagatgtttgccaatatctctgacatatattctcctatggaaatagccagaaaatgatggatcgaggaaatcaagtgtaaatcagtctgtacctccgagtggaaaccagtcagtgggatgtgaatatacttaatatgttctgttgtcttgtgtattgaaggagccttcatggagattttatatctctggagaaactcctgcaggttgcctttttagagagaggtttgaaataagaacaaagaaagtgagttcgctttagctgagtaaggcagggggcaagtgaagcagtgttagaggaggtaatgtggcagctgtctataacaggtggagcaaggtgatttttgtgtgtttgtttgtttttggtttatttttgagatggagtcttgctctttcgcccaggctggagagcagtggcatgatctcggctcactgcaacctctacctcccaggttcaagcgcctcctgagtagctgggattacaggtgtgtgccaccatgcctggctaattttttgtatattttttagaagagacagggtttcactgtgttagctgggatggtctcgatcttctgaccttgtgatccgcccgccttggcttcccaaagtgctgggattacaagtgtgaggcaccgcgcccagccacaagatgagttttaatggccaaacagaattcctgtttcacaacaattgacattgtgtcggctcccttgtttgtgcatatgtgttaatctattttttttttttttttttttttgagtctcaccttgtcgcctaggccggagtgcaatggcatgatcttggctcactgcaacctccacttcccgggttaattatcctgcctcagcctccctagtagctgggactacaggtgcccaccaccacgcctggctaacttttgtatttttagtagagatggggtttcaccatggtggccaggctggtctggaactcctgagctcaagtgatctaccttcctaggcctcccagagtgttgggattacaggcgtgagccactgcatcaaaatgcaatttattttggatactgaatgcacagaactgatctgggaagcattgctttgttttggagtttgtccaggacaggttagaataatattaacatttgatctgaaggcaaccttacctagattatctataaattgttataccacgagacagaagaaatcctattttcccacttaatatctgtgttaaaaattatcctccaaatatctatcaaattttaaaaattatgaaacatattaaaaaatttaaatctataggaaataatataacatgatccgtgtagctttcatgcatatttagcatgttgacatactttcttcagatgtgttttttaatagaaacattattgtcgaaggcttcttatttccctcttctttccatcctgttgcactttctttttccttagagataaccaaaattagcctcctacatacttttatgggtacctacatctctttgtaggtaggcgtattatatatagtaaagtacaataccgtatattttgtatgctttaaaattatttaatatggtaagatgctccacatatcagttgagaacttgacagtttcaagatttatctatccatttggtttatttgaactgtggtataactttctgatgaatgactgtaccttgatttacttagcttttcttcctgtgatggacactgttacaagcggtgctataataaacttgtgcaagtaactcttcatacctgtcttggtcatgtaatgtgctggctcacaggacacatacatagtcttcagcttaactagatgttgccagtttgttctccaaaatggcttctctgcaaatctcactaccattccatattttcagattctaaaatcctgccatcctcagatgaggataaaacgatgttttcttgttttgagatggaacatcttttcatagttttattgaccatgggagttttctcttttaagaattgcctattcattttctttgcccgtgttttttctcattgtattgtcttatttgtgtccattattgtaattgaattttaggatatttgaatgtaaatcttttgttatcgtattgggggttcccaagaccacttctaggctcagtaactcactaggttgctcaagaggctcagcctatagtcctactcacagcaaagacttattacagtaaaaagatataaagcaaaattagccaggggaaaaggcacagagggtggagtccagaggaaaccacgtgcaagcttccaagagtcttctccagtcacataggacacacttcgtttccccagcatcacattatgacaacaggtgtgaagtgtgtctaccaggaaagctcattagagacttagggaccaaggtttttgttgggggctggttatataggcaacctctctgccttgcctgtacccaaattccagattctcagaaggtaagcaggtgtttagcataaaccacactatttgtacaaatatttaggcacagtgagtcactcttaccagttctaggaatggtaggaaccctcctgaaatcttaagttctcagatgccagccaagagtcaaccttgcaggcaggtcttctaactttctaattttaacttttctctgcacggttatgttcatttcaaatatcttctcctaatctgtgtttatattgtcttttgctcatccagcagtaatatctgtctttttcaacgctttataattttaatatcatgcaaaaaaatccttgcctaccccattcataaaggtagctccttatatctttctctaataattttaacacattcctttttgtatttaagactgtaacctaactggaggttatttttgtgactggtaaaagatatgaatctcatttatcatttttggcatagaagtagccagttgtttctgcactgtttattgaatggtctatcatatcctcatggatttgtgatgcttcctctggcataccaagttctcctgtttgtgttatctatctctgaactaaattccacaccatttaattgagtttataaatcttaatatttaatagcataaattgtcccctgccttgtcttattgattcttggctcttatgactggcttgtcaagttctgccaaaaatatatatatatggttaatatatattaagattaatgtatatgaatttttctgtcagaattgcttggaatttttagattaatgtaaggataatttacatctttacaaatatctggtcttggcttggcctggtggctcatgcctataatcccagcactttgggaggcagatcacttgagcccaggagtttgagaccagtctgggcaacgtggtaaaaacccgtctctgctaaaaatactactaaaaatacaaaaaattagctggatgtggtggtgcgcatctgtagtcccagctactagggaggctgaggtgggagaatcacctgagcccaggagtttgaggctgcaatgagtcaagattgcacctctgtactccagcctgggcaacaggagtgagaccttgtctcaaaaaaaaaaaaaaaaagaaaaaagaaaattggttttcccatatatgaacatattatatagctcttcattcatgtatgttttctttattacctttcggtaaatgtttatattctccataaagacattaacatgttttgttggaattcttcttaggtactttagggttattatttgttactgtgaatggattgttctttttaaaacttacattttctaattgattgattgctgttgacctgtatgggtttttactattaatgagatatataacaaactgaactcttttattaagtctaataccttgtggatcctcttgaatattccatgtagattatcatgtctgcaattatgactcttttgtcataattgcagataatatgtctgcaattatgactcttttgtcataattgcagataatatgtctctttctttttaatcctaattcctcttattgacttttcttgtcatattcttctagctagggtctctagaaccatgttgaatagaagtaatgatggtgggaatccttgtcagttctaagttttgtaagggactgcttctatcacttagccattaagtatgatgttcactgtgtgatatgggtacacatgctttatcaaggtcaggaaatttttgtcccagtttgctaatattttttaaatttcataaatcagaattgaattttatgaaatgttttctctacatccattgaggtgataatttttttcttaattttttttttttttttttgagacggagtcttgctgtgtcgctcaggctggagtgcagtgacatgatctcggctcactgcaacttccacctcccaggttcaagcagttctcctgtctcagcctcccgagtagctgggactacaggcgcccaccaccaagcccagctaattttgtatttttagtagagatggggtttcaccatattggtcgggctggtctcaaactcctgacctcaggtgatctgcccgccttggcctcccaaagtgctgggattacaggtgtgagctactgggccctgcctcttaatatgttaatgtaggagttacattaagagatttttttagtgttaaatgatttttatattatttgcatcaaagatgctttggtcattattattattttaaaatatattgctggatttgacttgctaacatttcatttggaagtttcacatctgtttgctagtgaatgtggcttataattttcttttcttgcactcccttcatttagtttggtttcagagtgatactagctttaggaaataagttggggtatgtttcctctttttctactctctgaagagtttacgtaagattggattaatacagtttggtaggatttgtctctaaaggcatttggacatggggattattcatgtgtcaattttgaactactaacttaattttttaaaatggttataggacttttcagtttttatatttattcttaaattatatatagattaaaaaattttgttttaaattttcctgtctatagactttgaagtcctgctttttttttttttttttttttttttttgaaacagagtctcgctctgctgcgcaggctggagtgcagtggcgcgatccctgctcactgccagctccacctcccgggttcacgccattctcctgcctcagcctcccgagtagctgggactacaggcgcccgccaccacgcccggctgatttttttgtatttttagtagagatggggtttcaccgtgttagccaggatggtctcgatctcctgacctcgtaatttgcccgcctcggcctcccaaagtgctgggattacaggcgtgagccactgcacccagctgaagtgctgttttttttctttaacattatgggcattttctagatcattcaatatttactgagaagatgacctgtaacgcattgactttagcagtagtttttctttctgattaactttatttctagaattttattaggttgcatatgtcccatggatagggtggcataagtggccgtgctgggcacatggtagacatatagtaatttctgctggatatcgtacccagaactactcaggcgttgtaactttccagagcaaaaaattggaatttcctcatgttttacagggggagggtaaaggcgattctatgaaaattaacaaagggggttgggggaggagggctttcctttttgctaaaggaaaaataacacattcttttcgaatgatgacttatttttgaaaggcatcctggctgaaatgatgagctcaggttttgggtctgagcagttcctattgaaagatacttgtggagatttccaaaagtgcatataagaatggcaggttcttagttctgggggaagagtgactggggaggaaatacgtcttccccttttattgatctcagttacgtgctatgacatcacatgtaattttttgtggagctgttctgatgccccacatgaggcccgtgtcctttgctgccagtgcattccaagagggctgtaccctgggggctatgcaggcagctattcttgtgtgggcttttgccatgcctgtttcaggtttggaactgtatacctttcaggagcatggcttatgacatagcaattccattttcttaacaaaaacgaaccctatttttactttaaaagtaaacattccctctgctgtggtttgaatgtgtccctgaaagttcacatgttggaaacttcatcctccgtaacagtgttaagaggtgagacctttaagaggtgattaggtggtgaggactcgccctcatgaatggattaatgtcattatcttgggaattatcttgggtttctgataaaaagatgaggttagcctccttctcttgctctctcttgttcatgtgatgccctccaccatgttatgacccagcaagaagaccctcaccagatgttggcttcttgatcctggacttcctagtttccagaactgcaaagaaatgagtttttgctctttataaattacccagtccaaggtattgtgttatagcagcgcaacatgggccaacacaccctctatccatctctccaccggccaaaatcaactaagtgtccagcttcattacagccagtgtcctttggaggagaagtctctgaacattcctgttgagattcctgattggagctgtgtgaaacccatttagattgaaatcagaaacatggtcaggttgtgagttttccttttggagagccctcccttattttcacatgctcattctcaaaagcactttgtacatcatgtgatttgtatgttttttgcttggtacgattacacagccctttacaacccactgcccacacatgagctgacccagtggcttcgtgctgtaaaggcagatccagaaggcagtgctgccaggctctcttacaaaaatcagtttgtcttcttttgagatattcctgttctgagagttaaaacaaactcttgaaggcagcagtatattatagatgcaaaatctcacataaaaaccatttaagaaaatctggggacatggaaattgtttttttccctttaacaagatggtaccactaatgtattcttatttttttgcccagagagtagcaatttctaaattgttagacatggttcttctttggtttcacataacccattccttcatggtacttaaagttagtaaatggttgaaatacttccttgagaagtagaaatgaggaagcatgaagagattaaatgagtcacttaaagccactgtaaggaagttttccttcctttttattggtttctgcctttggtgttctgctgcttaccctccctccttcctacctgccttgtgctggaaagggccgggatttgggtatgcccttctcagctgtgtgacttcgaacaagctatttgacgtctcaaggtcttacatttctcatctgtaaaatctaagatccttctcttcaaatggctcccaggtcacccctgctgcagaccaggaatatggctaacattttgggatttgacatcaaatcctgagttgactttacgtaacctgggtccatgacatgtactagctgcaaacaagaagctgatgtgcacattgtctcaggacacctggaagcaaaatgttgaatgttagatttagaagggaccttcatcttccctgagtccaacagccccatcgtccggatgaggaagctgaggccaaggttagcccttgagggctgcagtgctgaggtcctgtgtccttgcccctggccagtgctgctcagccttccccacttttaggagagttggttgactttttgtaagacccaggtgggtataaaccaacaataacattctgagctccccaaccaactgaatggacctctcctctccgcgaagggcattctaaagtcagcctgaaatgctaatccaggcggtgatgggaatgggctgtgggacgtgcctccattacagcctcctccccttggaattcaggcacagctgaccagcattcacattaaaatagagacttcagactgacaaagcggactctttgtagcaatgagataccaacttgacagatagccggccccaaaagaaataaaagtattttgcctcaaaatatatttctttgatgtattttgaaatgtccctgcaaagctgtctcttgtggggaaaatctacattctgtggagaatctccttcccttcccaggtctttttcctgatccagtagagaattaactaagaatctggcactttttgaagtctgataagaaacatttaccatctattctctccaaagcctgctacctggaggcttcatctgcataataagaaccttggtttccataaccccttatcttaacccagacactcccttctattgattccaggtctttagataaactcaaccaattgccaatcagaaagtgtttgaatccacctgtgaccaggaaccccctcagcaatcctctgagttgtcctgcctttcaggaccaaagcaatgtacatcttacatgtattgattgacctcttgtgtttccctacaatgtatacaaccaagctatagcccgaccacttgggcacgcattctcaggatctcctggggctgtgtcacaggccacggtcactcatatttggctcagaataagtctcttcaaacattttacagagtttgactccttttgtttacatgggattgacagatgatatcccctgcctcgagggaatacgtgtgtgggcatctgaaatgtcatctcagctcacctctcaatgagtgggaagagactggaacacttttctccatggtccttgaatttttgtcgttaaacgagttactcttcagggcccgtcgtgtgaaaagctttgctgcacatcagcctggaggaaggctggacaggagaaatagcttcccaccaaagccctcccgtgtctagaagcatcacagtggcccttgcttaggtggcagaggacaggggtagatatttgtgatcaagaaagttggtcaggccgggtgcagtggctcatacccgtaatcccagcactttgggaggccaacgtggacgaatcacttgaggccaggagatcaagaccagcttggccaacatggtgaaaccccatctttactaaaaatacaaaaagtagctgggcatggtggcacatgcctgtaatcccagctactcgggaggctgaggctggagaattgcttgaaccgggaaggcggaggttgcagtgagctgagatcatgccactgcactccagcctggtgacagagtgagactctgtcttaaaaaaaaaaaatgttgctcagaagcttctcgatcttgtcacattctccggtggtgagttgagagcagcccaggcctggggtcctagggagcttgacgtggctactgttctagacagtgctgagtttgtcatcaccttgctttcattatgatttcctcctcctcgtcaccacctacggtgtttatggagttcgctgtacatgaagccccagcgtccagaggtgtaagacagagccccttctaggagctgctgtccatcccactgaaaggcaggtctgacacagaagagacaaacaaccatactgggcctctggggccccgtgagatgtgaacttcaggtaccagagtgcatgcgggaggaggcctgggtgccctggggacccaaagcaggagctcatttctgacctgcctctctcaccaagcttcctttgctgaatgccgtgggcaaacagtggtgttggtattggagcaggatcaaagctcattcctggctaacctgcaaaaatgagcaggtaaacaaatgggatccataaaatagagactaaaatgaaagtttgtcttactgtgattagcaactggcccctttccaaattccacctgctctgcgtggagctgtggcgtctcattccaagagccttctcacagcatctgacccgggcctggggtaacagtacactggggtttgccaaggataaccatagcaaggcagctacaggagcacagcatggtgggggggcatgaaatcagaacaagcaggacccacgggcgggggtgagagcaagtggctgggaggcagaggcagaagtgatggctgctgactcaccgtgtgtctgccaggttgcttaacccatctccgctccggttttcccatgcgtgagccctctgcagtgtgtggcatgctgatcggcctctggcatgaagagtaaaagcaaggccacataaaaatcacaggtgcccctcgcttcgtgcaacatgtgtgccagtccagtttctgcaacagccccccaggcgctgagcctgctccatgggttgggagatgttagacctcaagctgtgcccctagctgggtgggtatgggaagttacatggcagtgctggctgcattctgcttatcactgaaagaagtggctttggaatgggtgatttcttaaggtgtttccccactcagttcttctgttcatttttgtacattattatctcttcattgttgtacatttgttggagcttagccccaacagtgcctgcctaggtggtgcggactgaggaatagagatggagtaatcatgatatccaatgtcttatctcactggcctccccgccccaccacatcccttcccattggacggtgaggactgaggctccatcgctgaaatgcacacgtgttaccaggcagggttgtgagggccagttcaatgaacataaatacccttgtcagatcagttgtcatgattctagagaataaggccggaggaagtgagcatgctgatactaaagaacaggggagagaatactgggtttggttgtgcctggtcactaaaagcaaacttcacccactgagaacctgctagtcaacctcctatgatgttcagaagcctcttgaatgttgataattaatggacagggtgagcttggccaggcaggctggctcatgcctgcagtcccagcactttgggaggtcaaggtgggcagatcgcttgagctcaggagttcaagaccaggctgggccacatggcaaaatgctgtctctggaaaaaatacaaaaaaaattagccagatatggtggcatgcacctgtagtcccagctccttgggagggtgaggcagcaggattgcttaggcccaggaggtcaaggctgcagtgagacaagattgcactgctgcaccccagcatgagtgacagagcgaggtcctgtctcaaaaaaaaaaaaaaaaaaaaaaaggtgagcttttctctactgagtttcttgaagtgtggcacaactgaggcatagcatagtgggacaggatgctgttcatttatctgagaggtgaaaggatgtacctcctgctgcttttttggtgggatggggtcggaggagagcctgatgagccaggcaaggagaggaggtaacagaacactggtggagttgatggtgagaagctggactctctcagtgggctgtttgcctgcccctcccttcatttcccataggcttcggtagaagcgtggcctgcagaatcaggaaacagtgctggttaatctgtaagtatgcaacattcttgggcctttctgtcactgaagagcataatgtaattcaggccagtgcagtactgagatatggagtgtggccagcacccatggcaggtgcttggaggtttatcctagtctttctgctaacttcctggcccaagtgcaggtcacttaccttttctgggattcaggtacctgtaagaagagaagtgagtgtgttggactccctctagggaactggaaggaataagcaataagtatactttgacattttataaatagaacatgtttaatacatgcatttcaacgaggcctataggattaacaactttggaggcatgtgtaccggtttgcggtcagtgctcacaccacctggtggaatttccttcctttgactggcaggaagagggaagtacttctcacacatctgttaccttctgccaagtgtaaatgtcatgctggcatctgtgtcttaattgtattggcattcccttgtactgggcctggatggggtgggtgctcaacccacacagacagaaccaagctcccgactgcagacacacatcattaagtttctggacttcagccacagtatctttgttattagattattaactcaatagccttcttgtcttttagcctaggactctggacatagctctctgtagatgcttattgatgactgattggctaacagatgcaatcacagagtcacagatgtcaactcttgcctgtccttccttcctttccttcccttccttccctccttccttcctctctgtctttctttcttttctttctctctctctctctccttccttccttccctccctctctccctgcttccttccttccttccttcctccgttccttccttccttcctctttctctctttctttctttcttttcttttttgatggagtttcactcttgttgcccaggctggagtgcaatggtgcaatctcggctcaccgcaacctccgtctctcaggttcaagcagttctcctgcctcagcctcccgagtagctgggattacaggcctggctaattttgtatttttagtagagacagggtttctccatgttggtcaggctggtctcgaactcccgacctcaggtgatccgcccaccttggcctcccaaagtgctgggattagaggcatgagccaccgcgcccagcttgttcgcgctcgcttgcttgcttgctttttctttctttctctctctctctctctctctctctctctctctctccctccctccctccctccctctctctccctctctccccctctctccctccctccgtctgtccctctctttctctcgttctctcttttctttctttctctcaagacagggtctagctgtgttgcccaggctggaatgcaatggcgtgatcatagcttactgcagcctctgcctcctgggctcaagtgatcctcccacctcagcctctctatagctaggactacaggcatgcgccaccatgcctggctagtttttgtattttttgtagcgacagggttttgccatgtgcccaggctggcctcagattcctgggctcaagcaatctacccaccttggcctctcaaagtactggggttatagacgtgcgccaccatgcccggctcaacccttgtatttcttgatggttttcacatgcagaagcccaaaatctgggagataccgatggcccctggatccaacactagagttatttctctccacagcagtttgcctcatgctcctttggtcactgataagtgttgttaacatttttcaaatatcctgtctgcactgaggtgtgacgagcacattattacctctgattcccatgctgacacacagatcgggcatgtctttgtgtttgtctttggagagccttatttttctcatgtgatatatacaccgaaatacacaggaatcattattgtacagaacataggagacagccactatgaaagcaactgtccggctgatggaagaaaagttcaggggcttctcattttgattacctgtgattttgctttgcatacaattttatttccttggtgagagctgcttcttccttgctgacttttaagagacattggaagacatggggcgggtcttctgaacatctacctgtgcgtcactttttaatttcttttccaggtagagtctgcagtgagggaatgagttctttttttgtttatttgtttgttttttatttttttttgagatggagtttcgctattgttgctctggctggagtgcaatggcgcgatcttggctcactgcaacccacaccttctggggttcaagcgattctcctgcctcaggctcccgaatagctgggattacaggcatgcacctccacgcctggctaacttttgtattttcaggagggacgtggtttctccatgttggccaggctggtctcaaactcccgacttcaagtgatcctcccacctcggcctcccaaagtgctgggattacaggcgtgagccactgcgcctggccaggaatgagttcttaatgagagactcttgagtctttctctggaagtagaatggaatttttagaaggatgaaagacagatgttcatttcacagagcaggctgctctattcacatgcagcctcaacaccagtgacattccaaccagtgtttagggtttagttagggagagaacttcatccccattagttcatatgtgtgtatgttaaagcacttagaaccatacctggcacataagaaaaattctgtaagtattcattgttcttgttattaccatcatccttgtaattcagtgattcatggcggggtgcagtcaaggagtgtcatgacaagcgaacttcagaagactgcatcagacttacaggtcactgcttttgtagccccagtacggtaggagaaacatccactgggaggtgggtccctcgttagccctgaagagtggattgctgatgccttctgcttcaccctctgcttgtgctccttcttccaagctgttaatttctctgaaatcttgtgtttctttacgcaggggttcacatcctgattgcttgttccactcggaagggaaggcagagggcttgcatctgaagccatgcctccttcatcagtgctgtatcgagctctaggtttgggttcttggcacttcggtgcttcccttctcactcagtagtcataatgttagcacggttgatgcattgacacgctctagtgagcagtttgcaggcatctatcatgaactgttcaaagagatacgcagatacatctcacaaacactgatggaatacttagtatgtgctaggagggcactagggagagaaagatgaaaggcagcgcctgctgttgatttcatttgcatcttgccctcaggactcaggttaattggtctaggagcttatagactattaggcttcctagaccccttgggagacatgggacttgccagacccatttccccaaaaaaggtaagcactgtggaggattcttctcctagagtctagcatccatcatttcaccagtgtggctgattccaaaaaatgcattttgacaagaagagaaacacagttagttaacagacgtcagaatgtgaaataactttggctgattggaggagttaaccggttcttttgtcatcttgtggtccgttctgtgtgtgtctgcttagctttctcacgctgagccttttccctcaggatcttcagcagttttttccagtatgtagatgattcaactcacagatggcagcttctaagttattatgccactgattaaagaattgttaaggcagacttatttctctaaatacaaacacatgcaaaactgagattttgaccaaaactttgctagacacaatagtgtattgtttctctcttcaaagtgtgttccatgatagacttgtgttttataaaacagcagtgcttggcatgtatattacgaggtctatcaccaaagaattctaagctctttttaaaaagacatttttaaggtaaatgaccatttaaaaaagatactccgtctcttctatttttttcctttcttatatcttcagcaacatcctaaatgtgacaatgtacgtaaaacactactgcatagagtgaatgttcactaatgctgatgactgtctttattggtatctctaatagttggatttgtggttaaacatatatgcttcttgccccaaatgactacatctttgttttctgttcgggcaaacagagaactggagttcactgtgatctcttcactgttaacactatttaagtgttattcaaagaaaatggaaacttttggtctcagtgtcatgccaacttgttctagattattgttcttaaaaaaaaaacaaaacaaaaaaaaacagagccccaggctggatgccgtggctcacgcctgtaatcccagcactttgggaggctgagacaggcagatcacaaggtcaggagatcgagaccgtcctggctaacaaggtgaaaccccgtttctactaaaaatacaaaaaatagccaggtgtggtggcgggctcctgtagtcccagctactctagaggctgacgtaggagaatggtgtgaacccaggaggcagagtttgcagagagccgagatcgagcgactgcactccagcctgggggacagagcgagactccgtctcaaaaaaaacaaaaaaaaagagccctggccaggcacggtggctcacgcctgtaatcccagcactttgggaggccgaggcgggcagatcacaaggtcaggagatcgagaccatcctggctaacacggtgaaaccccgtctctactaaaaatacaaaaaaaaattagccaggcgtggtggctggcgcctgtagtcccaggtactcgggaggctgaggcaggagaatggtgtgaacccgggaggcggagctggcagtgagtggagatcttgccactgcattccagtctgggtgacacagtgagactccatctcaaaaaaaaaaaaaaaaaaaaaagttgagaaatacggagagacttattatgaagcaataaatagttatgacacgatgttattaacactgggagaaacaaatagaccgatggaacaaaatagatagctagaaatagacttctacgtaaggaaacttggttatgcagataaacattgtggacaagtgggagaaggaaggattattcaataaatagtgctgagacaacttaaaaatcatattttcaagaggttgcaatgaaggtcctcacatatcctatatacaaaaaattagtttgaagtagaccaaatacatcaatgtgaaaagcaaattctaaacagtttagggaagaatataggaagatattttcatgagtggtgtagagaatgactttttttttttttttttaaagacagggtctcactctgtcacccaggctggagtgtagtggcgtgatcagcgctcactgcagccgtgacctcccaggctcaaatcgtcctcccaagtgatcctcccacctcagctaggactgagactagctggggctgcaggcacacaccaccacacctggctgatttcttttgtattttatacagagatggggttttgccatgttgctcaagctggtttcgaactcctgagctcaagccgtctgcctgccttagtctcccaaagtgctaggattacaggcatgagccaccctgcccgacccaagaatgactttttaaagcataagcaaaaagcataaaccatgaattaatgattgctaaatttgactgtattaaacaaagaatatcagtttatcaaaagacaccataaagtaaaagagatccacaaacttagagaagttatttgcaatatatataactgaaaaaggatttgtatttagagtatgtaaagaactattaaataagaaaaagatactcaaaagaaaatgggcaaaggacttgaacagggattttagagaaaataggaatagttaataaacctatgaaaaggtacctaatcatcagaatttaggaaccccaaattaaagccataatgatataccatttgataccaaccagactggtgaaaatatgagtctgataatattaagtgctgacaagggatattggtcagtggaaattctcatacacagctggcaggactgtaatttggcacaacttttgaaagcaatttattcttacctctattaccacacagttctgccattccactcccaggaacagaccctggtggaaagagaataagctttggagtcagtccaggatttgaatccatcttttaccattttcttttctttctttctttctttctttttttttttgagatggagtctcattctgtcacccacgcggagtgcagtggcgcaatcttggctcactgcaacctccgcttcccgggttcaagcaattccctgcttcagcctcccgattagctgggactacaggcgcctaccaccacgcccggctaatttttgtatttttagtagggacggggtttcaccatcttggtcagcctggtcttgaactcctgaccttgtgatccacctgccttggcctcccaaagtgctgggattacagatgtgagccactgtgcctggcctgttttaccattttctaattgtgtgcccctgagcctatgactttctcagttcccttatctgtacagtgagagaatgttgtgtttagtaactgaaaattcatggcatatagtaaacctcactaaatgcagacacttttattaacatgtgactgaagggcaggccccctgtgggcctggtcttatccttatcctttttagtatatgcacttcttctccacagtgcatatgctaatactaggtattcaagaaagcaaggtttgatttggatttgcagtgtctcccctaaatgctcagctcctgctatatgcatttcattctgcacaaacctcctcgccgcctgccacatctaagctatgatacaaatattcttcacgtgtgaaattccttgctcactgcttttacctcactgtggccatcttctctactaagaaagtcagctgtggtatcaacacacaagaatgtgtgcagctggtagtgtatacattcagaataacaaaggttattacactgaaaggatgtgttttttctttattactgggcatcttaattgcttcttggatgttacaagcccagcattgcgaagtacaccgtagagcagaggactaatctgtggattgagttgaggcacaaccctgtgagtgccctttctcagtgcagcagtctcagaggtaattttactcttttctgaaatctcatttcttattttggtgtgtgcagaaaagctcaactggagttacctgcaaatgcaggcatatgtgatagctctgctcagccacgtattaagccacaagcagccaagaacagatactactggcgacagctaagtaatgcacacacacacacacacacacacacacacacacacacacacacacacacaaaaggagaaaagtgataaagaagcaagaattccaagtgagttacaaactccaaggacttggaacatattctgaggaattcttaaattgaggcttacgagtgagaatatataatgtgtctccttaaacgttttggggtgacagatatttctgggttgtgggtgatatttttagggagctttaaagaatgaattcaggagacttgcagcctgatgctggttgtctgggtattttgggacatttcttatagcccagctttttattgctcaacacagatttagaagcttgtcctaatcaccaggaagatccttaaagactggcaataaagacaggaatttcaggagccaggcacagtgcctcatgcctataatcctagcacttcgggacatgggggtggaaggatcacgtgaacccaggaggttgaggctgcagtgagccatgattgcaccactgcactctaggctgggtgacacagcaggaccccgtctgtaaagaaataataacaggcctggcgcggtggctcatgcctgtaatcccagcactttgggaagccgggccaggtggatcacaaggtcaggagatcgagaccatcctggctaacacagtgaaaccccatctctactaaaaaatacaaaaaaaattagccaggcatggtggcacacgcctgtagtcccagctactcaggaggctgaggcagaattacttgaacccagggggcagatgttgcagtgagccgagatcacaccactggactccagcctgggtgatggagcgagactccatctccaaataataataataataataataataataataataataataataataaagttttttttttaaaaattgggattttagaccaatgtgagggaagttagcagcatggccctgagaagccatgtttccagagtgcactgttaggactgctgaaacagtttaagtacagacatacaagtcagcacacaggaagcagagcccgggaggattagacctgacatttgaaccagtccgagcccctctgtctaggtatctcctccaatcctccagtcatccctggttaaatattttgatttcttttgttaatactgtataataattctaaatctttctgagccaacattaaggtgaccaaacatcctggtttgcatgggacacaggactttcagtgctaaaactgggacagttctgagcaaactgggatgcttggtcctagcggacaactgctttgtgtgtctggtacaggtgagccacagctgtgtatacatgtgtagtgggttgaatagggacccaccaaaaaaggtgtgtccacctagaatctcagaatgtgatctgatttggaataaaggtcttttttataacaatgacaacaacaaaatctaccctttcaactaattttaaagtgtacaatacaatattgttaattatatggacactgttgtacaatagatctctagaaatttttcatcttccataaccaaaatgctgctcccaccgaacggctcctctccccctcctcctcccacccaacggcccctctccccctcctcctcccaccgaacggcccctctccccctcctcctcccacccaacggcccctctccccctcctccctgctctgtggctgccaccattctactttctgctgctttgattttgactacattagctacctcatctaaatagaatcacacagtatttgtattctgggactggcttatttcacttagtataatggcctcaaggttcattcatattgtagtgacaggatttcctttttttgttttttgtttttttgagacggaggttagctctgtcgcccaggctggagtgcagtggtgtgatcttggctcactacaacctccacctcctgggttcaagtgattctcctgcttcagcctcccgagtagctggaattataggcgcctgccaccacgccaagctaatttttgtatttttagtagagatggggtttcactgtgttggccaggctgatctcgaactcctgatctagtgatccatccaccttggcctcccaaagtgctgggattacaagcgtgagccaccgcacctgcccccaccccctgccacctttttttttaaaggctgaataatattccgttgtctgtatagaccacattttctttatccactcatccatcagtggatgttcaggttgttcccactgttttgctatcgtgaacagtgatgcagcgaacatgggaatgcaaatatttctttgagattctgttttcaattctattgaataaatacccagaggtggggttgctagatcacatggtagttctgtttttaattttctgaggaaactccattctgttttgcatagcagcagcattatatattctcatcaacagtgaacaaggatttcagtttctccacatcctaatcaacacttactttctgctgttcttttttcttcttccttctttccttcccttccttcttcctttctcttccctcccttcttcccttccattccttcttcttttcccttccctttcttcttcccttccttcttcctttccctttcctttcttcttcccttccttcttcctttcccttcctttccttctttccttcccttcccttccatcttcccttcccctccttcacttcctttttcctttcccttcccttcctccttcccttcccttccctttttctttcccttccttctttgtttccctttcctttttccttccctttccctttcctttcctttctttttgtgtttctataatcatggccatcctaacaggcatggggtgatacttcattgtggttttgatttgcatttctctgacatttgtgatattgagcatcttttcatatacctgcttgtcatttgtatgttttccttacagaaaggtctatttaggtcctttcctttatgtattttaaaaattggtttatttgcttttgctattgagttgtaggaattccttgtatattttagatatcaatctcttttcagatagatggtttgcatgtattttctcccactgcacaggttaccttttcactctgttgatgctttcctttgctattcagaaggtttttcgtttgatataatctcacttgtctatttttgcttttgttggcatatccaagaaatcattgccaagaccaatgttttgaaactttccccctatgttttcttctaggaggtttgtagtttcaggtctacatttaagtcctttaatccattttgagttgaggtttatgtatgcgtaagataaggatccaatgcttcttttgcatgtgggtatctagttttcctagcaccactttgtgagacaatcctttccccactgtgttgtcttggcacccttgctgaagatcatttctctgtgtatatgtgggtttacttctgatctctctattctgctccactggtctgtgtgtctgtctttatgccaatgtcatactgttttgattacagtagctttgtaagatgtttcgagatcagaaagtgtgaaaattctagctttgttcttttttcttcagattgttttggctattcagggtcctttgtggttggttccatgtgaattttaggactgtttttttctattcttcaaaaaatgccattgggaatttgctaggaatttcattaaatctatgactcacttcaggtactatggacattttaacaatattaagtcttgtaatccatgtacataggatgttgaattttcatatatggactttattatgttgactttttatatatggactttattaagtcttgtaatccatgtacataggatgttgacttttcatatatggactttattatgttgaggcaatttcctttttttcctggtttcttgcagttcttataatgaaaggatgttgaattcagtcaaatgctttttttttttttttacatattttgagatgatcatattatttttatctttcagtcttttaatgtgatgtaccacattgattgacttttgtatattgaaccatctttgcatctctgggataaatcccacttgaccataatatattatctttttaatgtccttttgattcagttttgtattttgttgaaaatttgtgtatctgtattcatcagggatattgggctgtatgtagttttcttttcttgtagtgtctttgactttgttatcactataatgctagcctcaaaaaacaagtttggaagtgttcccttctcttcattttttaaggagagtttgagaaggattggcattaattctttaaatatttggtagagttctccagtgaaaccaccttgtcttagacttttctttttgggagatttttggttactgattcaatcccatttctagtaaaagatctgttcagattttctgtttcatcatgattcagtcttggtagtttgtatatctctaggaatttatccatttcttctaggttatctaatttgttggtatataattgttcactgtggtcttttattaatactttttattctgtggcatcagttgtaatgccccctcttttatttctgattttatttatttggaccttttctccttttttcttagttagtctgcctaagagtttgtcaatttttgccaggtacagtggtgtgtgcctgtagttccagctatttgggatgctgaagcagaaggatcacttgagctcagaagttcaagaccagcctaggcaacatagcaagacccgcccccttcatctctttaaaaaacaaacaaacaaaaaacagatcattaattttgtttttcttttaaaaaaatcaagtcttggtttggttgtttcttttttctattgtttttatattttctatttcatttctttcaattataatctttattataatttccttccatctgctaactttggcttagtttgtttttttctttttctagtttcttcagttataaagttgggttgtttatttgagatctttattcttttttaacataggtgtttactactataaacttctctcctagtattgtttttgctacagctcacaggttttggtgtgttgtattttcatttttgtttgtctcaaggtattttctaaattccccagtgattgttttctttgactcagtggttaagagtgaattgtttcgttttcacatatttgtgaattttccaggttttcttctgctattgattttcagtttcattccattgtggttgaaaaaaatgtggtatgattttaaacttcttaaatctgttaagtcttgttttgtgccttaacatgtgacgtatcctggagaatgttctgtgtgtacttgaaacgaatgtgtattctgctgcttttgggtgaaatgttttataaatgtctgttgggtccctcgatctgtagtgttcttcaagtcctctgttttttttttattagccttttgtttggctgacatactgtactctatacattattgaaagtgggatattgagccaggcacagtggctaacacctgtaatcccagcactttgggaggccgaggtgggcggatcacttgaggtcaggagtttgagaccagcatgggcaacatggtgaaaccctgtctctacttaaaaaaaatacaaaaattagctggatgttgtggcacatgccagtcatctcagctacttgggaggctgaggccagagaatcgcttgaacccaggcagcagagtttgcagtgagccgagatagtgccatggcactcctgcctggggaacagagcgagacttatctcaaaaaaaaaaaaaaaaaaaaaaaaaccccaaaaaacaaaagtgggatattgaaatctcctactattgttgtgttgcttcctatttctcttttcaattctgtccatgttttatatctttgggtctctgatgttggctacatgcatatttataattgttgtatcttcctggtaaattcactcttttatcattaaataatgttgtttctggtttcttgtggcagtttttgtcttaaagtctattttgtgtgatataagtatggtcatccctgctgtcttttggttaccatttacgtagactacctctctttaccctttcattttcagcctatgtgtgtttttaaatccaaaatgagtcccttgtagacagcatatagctgaagcttgtttttaaaatccatttagctactgtatgtcttctgattgagggatttaattcacttacatgaaaagtcattactgataggcaaggacttactattgccattttgctcattgtttttatctaccttgtagctcttttgtccctctcactgtcttcctttttgtttccctcatttttcttctagcaatgttctttgattactttttcattttctgttgtgtatcgcctatagatattttctttgtggttaacatggggattacataaaacattttatagttatattaatctgttctaagctgacaacaacttcagtcacatacaaaatctatatgcttttctgcacactttgttattgatgtcacaaattcatgtttttatgttgtgtatccattaacatattttacataattattttttatacttttgtctttttttaattatactttaagttctgggatacatgtgcagaacctgcaggtttgtttcataggtatacacatgccatggtggtttgctgcacccatcgatccatcatctacattaggtatttatcctaatgctatccctcccctagccccccaccccacaacaggccccggtgtgtgatgttcccctccctgtgtccatatatcctcattattcaactcccacttatgagtgagaacatgcggtgtttggttttctgttcttgtgttagtttgctgagaatgatggtttccagcttcatccatgtccctgcaaaggacatgacatgaatgcacctttttttatggctgcatagtattccatggtgtatatgtgccacattttctttatccagtctatcattgttgggcatttgggttggttccaagtctttgctattgtgaacagtgccgcaataaacatatgtgtgcatgtgtctttatagtagaatgatttataatcctttgggtatatacccagtaaggggattgctgggtcagatgatatttctggttctagatccttgaggaatctttatagtagaatgatttatgatcctttgggtatatacccagtaaggggattgctgggtcagatgatatttctggttctagatccttgaggaattgccacactgtcttccaaaatggttgaactaatttacactcccaccaacagtgtaaaagcattcctatttcttcacatcctctccagcatctattgtttcctgactttttaatgatcgccattctaactggcgtgagatggtatctcattgtagttttggtttgcatttctctaatgacctgaccagtgatgatgagctttttttcatatgtttgttggccacataaatgtcttcttttgagaagtgtctgtttatatcctttgcccactttttgatggagttgtttttttcttcttgtaaatttgtttaaattcattgtagattctggatattagtcctttgtcagatagatacagtgcaaaaattgtctcccattctgtaggttgccttttcactctgatgatagtttcttttgctgtgcagaagctctttagtttaattcgatcccatttgtcaattttggcttttgatgccattgctttggtgttttagtcatgaagtccttgcccatgcctaggtcctgaatggtattgcctaggttttcttctagggattttatggttttaggtcttacgtttaagtctttaatccatcttgagataatttttgtataagatgtaaggaaggggtccagtttcaattttctgcatctggctagccagttttcccaacaccatttattaaatagggaatcctttccccattgcttgtttttgtcaggtttctcaaaagatcagatggttgtatacttttgtcttttaatctgtataccagaattaaaagtgatttaaacactactgttacagtattatagtattctgtatttgtctatatgtttacctttggtagtgaactttatacttttatatgctttcattttcctatctagcatcctttcatttcatcttgaaagactccctttagtaattcttgtaaagtcagtctagtagcaaggaactcctctgcttttggttatttgggaaagtctttattcttggaaagtatccttcgttgacaggtttttattctttcagcactttgaatgtattgtctcacttgcttcttgcatgcaaggtttatgctgtgaagtccactgatagccttttaggggttctattgtatgggaaaatttgcttctcttttgttgctttaaaaattctccctgggccaagcacggtggctcatgcctgtaatcccagcactctgggaggctgaggtgggtggatcacctgaggtcaggagttcaaggccagcctggccaacatgggaaaacctcgactctattaaaaaattagccaggtgtggtagcaggtgtctgtaatcccaactactcaggaggctgaggcaggagaatcacttgaactcgagaggcagaggttgcagtgagttgagattgcacccctgcactccagcctgggcaacagagacttccatcttaaaaaaaaaaaattctccctgaaaagctagaactttgaatacatgctccaactcttttcctccccagggagaagtaaggagttaggggttttctcctgtttattttgtgctgagctagagggcatggactatgacaaataagtacatgctgatctaaaccatttcctttattctcagcatcccttgacctggcgccctttcctattctaaaccatcccttgggcagtccccttgaaaagcctggacattggactatgatccagtctactcttccccgctcccgggagaagcgaggagctggcagtttcctcttgcttacactgtgctgacctgggggagggactatggtgaatggatgccatgaatttccctgccagctttgatcatctggttttgcagcagcctgagatgcaggagcctcttaactggtttccgtatttctcacaaagggaagtagtctatgtatttttgttgaattgctgtctctgtagggacaaagagggtcttgcagttcctattttgccatgttgccgaagtcacttcctggaatgaaggtctttacagatgtaattaaggtaaggatcttgagatgagatcttcttagattagggtggaacctgatttcaatgataagtgtcatgagagacagaaatggaggagacacaaacacagaggagaaggccatgcaaaggtagaggcagagactggaatactatgtttataggccaaggaatgccaaagattgttggccaccagcagacactaggagagaggtgtggaatggatcctctcttaggctctccagaaggaactcactttgctgacacctttgattttggacttttggcctctagaagtatgagagaatgaatttctgttactctaagccagcaggcttgtggtaatttgttacagcagccccagggacatgggaagtgagtttgggagttttactacaaaaatctaggaggaggattttagacctttattggtcaatagccttatctatgtcttcactctctgtgagcccacctgtatctacggctgttatccacataggtgttttgactagggatttctgttcagtgaggtccaaactgccttcctcagtgccctggggcttcctgaaggtgctcttggtgccccctgcaggtgccctgtgggctgctttgtggggagtgtgcgaggtgaaggctgagcctgtgtggctccagacccctggcctcattaaccaaaacaagttttagataagttatttttagggggattaatataggattttgtttgaaaacaaacaaacaaaaaccacttaaaaaaaaagtaaaagaaacgtcctaaaagctacaggttgcattcttgccttctttctcttctaacgtgattctttgtgcagccattttctgccaatgctcttcttgggtgcagcagtgtctgcagtcatggtgactgggaagtgggaagggggcttggagtagaactgcagggaggatgggggttggaagaacccctggtgcatcaggtaaaaccacaaggaggtatgctgccctcattcttatccctgaatatctattgtagcttcttgtcccctttcatggtcaacatcttgcaaataatttcgtcataggctggtatctcaatttcactgacggctcatggcaaagcatggagggaaaaaattaggaaggggtggggtgaagttattaaatactgggagtgagtaaaagtgggcaggcaggaaaattattctaaaagggttaggggaaagggaggtggcataataacaaaaggaagaactgtacctgcattagagtgctataattttccccaagtattgccatagaaatcgcacttcagactctacaccatgcatcaatttgaggagaacaatttacctgtattgtttcccatgtgtcatcagcgtcctctttctcctgtttcagtcagcaggactcatttcatccattttcatctggtactgttgactattcatttctttgcactgattttgctgccaaagtccccttttcaagtcatggacattattaagtataccctttattttacatcacttgccattttcagaactcctttatttcattactttgcattcagaatttccggcctaaatcgatagccttgacataaaggcaggtctctgctttctcttttgggcatgaacagttcctttcctgaatcagaaatttatttttctttctagaagtctagtgtggggaatagtcagcatgcttactaagtcttaatttgttagaaggaaagatgaagataaatattggtgatgggggttccctagaaaataaattctacctactcctaccctcacacgtttacactctgcttttgatgcatctcttgtattctgcttttcctctctaaagaagggaaacttcttcctgggaccagtacattgggctcattagttccagccccagctctgccacacgcttgctgtttagcttttagaaagttagctcatctttctgttttctggcctatgaaatggagactcactgatctcttggatggatgaagtaccaagtaaccactatgggacttgcccccatgcaggagtaatgaatgaatcaatttcaaaacagctggacactaagcccacagcccaggctctcctcagattcattctatttacagcccagctttcacacaacgtgtctgatagccagttccttacgaagcctctgtcatgcttacggagcacgtgaccctcttgaaggagatggggaaggatcatggaatgttaaccactgttcccatgcatggaactgtgctaagaaatgtgctcccaggtagttttggagccatatgtgtctgaaaagaactcataattagctgaagtcaagggaaggggtcttcttatcactccttctgtattgttttaggcactcacactcatcagcagacagagtgcattcactttcttttctttccttttttctttctttttttttttttttttagagaggaggtcttgctttgtcaccccaggctggagtgcagtggtgcaattatagctcactaatgccttaaattcctgggctcaagcaatcctccagcttcagtttgctgagtagctgggactacagacatgcactatcacacggggctaattttgtaaattttttgtagagatgcggttttgccatcttgcccaagctggtcttcaactcctgggctcaagtgatcctcccacctcagcctcccaaaatactgggattacaggcatgagtcaccgtgcccagactacatttactttcttgattgcactttgaggtttaggggctaatgcctgatgctttttttttatctgtatgaagcagcggccacacagatcttcatcaaaagctgactgttctcatttctccccaagtaatcactcttttttttttttagcttgtgctaaatcattttttaaaattgtagctctgaggcattttattatacaaagttagtactcatatacataaactaataggaacttaaaactcattatacctttgcttcattttttttagcttgactccctcgtaaatctttagcttcattgatttggctgctatgtaagcttcattgatttggctgcttaaatcactccgttgagtgatttaagagcataatttagaagaatggtgtgtccatgtgtggctcagtttacagtaccatttggagtttgattgcttctgtgagttgggtgatctctcctcttgaggtccagatcaaccccaggaggagcctagctgctgctccccattgggcgccccatttcagcagaagtagccaggagtcgtcacccagaaccccctaacagcagttagtgtggcatctccacagtggggaatgttgtaggagttattaagaaattattttggccgggtgcggtggctcacgcctgtaatcccagcactttgggaggccgagacgggtggatcatgaggtcaggagattgagaccatcctggctaacacggtgaaacccgtctctactaaaaatacaaaaaatacaaaaaaaaaaaaaaaattagcagggcatagtggcgggcgcctatactcccagttgctcgggaggctgaggcaggagaatggcgtgaacctgggagacagagcttgcagtaagccgagatcgcaccactgcactccagcctgggcaacagagcgagactctgtctcaaaaaaaaaaagaaaagaaattattttaggcagataaagaggaaaaggggtccttgggaagttttcgttttttttttttttttttttttatactttaagttttagggtacatgtgcacgttgtgcaggttagttacatatgtatacatgtgccatgctggtgcgctgcacccattaactcgtcatctagcattaggtatatctcccaatgctatccctcccccctccccctaccccacaacagtccccagagtgtgatattccccttcctgtgtccatgtgatctcattgttcagttcccacctatgagtgagaatatgcggtgtttggttttttgttcttgcgatagtttactgagaatgatgatttccaatttcatccatgtccctacaaaggacatgaactcatcattttttatggctgcatagtattccatggtgtatatgtgccacattttcttaatccagtctatcattgttggacatttgggttggttccaagtctttgctattgtgaataatgccgcaataaacatacgtgtgcatgtgtctttatagcagcatgatttatagtcctttgggtatatacccagtaatgggatggctgggtcaaatggtatttccagttctagatccctgaggaatcgccacactgacttccacaatggttgaactagtttacagtcccaccaacagtgtaaaagtgttcctatttctccacatcttctccagcatctgttgtttcctgactttttaatgattgccattctaactggtgtgagatggtatctcattgtggttttgatttgcatttctctgatggccagtgatgatgagcattttttcatgtgttttttggctgcataaatgtcttcttttgagaagtgtctgttcatgtccttcgcccactttttgatggggttgtttgtttttttcttgtaaatttgtttgagttcattgtagattctggatattagccctttgtcagatgagtaggttgcgaaaattttctcccattttgtaggttgcctgttcactctggtggtagtttcttttgctgtgcagaagctctttagtttaattagatcccatttgtcaattttgtcttttgttgccattgcttttggtgttttagacatgaagtccttgcccatgcctatgtcctgaatggtaatgcctaggttttcttccagggtttttatggttttaggtctaacgtttaagtctttaatccatcttgaattgattttttataaggtgtaaggaagggatccagtttcagctttctacatatggctagccagttttcccagcaccatttattaaatagggaatcctttccccattgcttgtttttctcaggtttgtcaaagatcagatagttgtagatatgcggtgttatttctgagggctctgttctgttccattgatctatatctctgttttggtaccagtaccatgctgttttggttactgtagccttgtagtattaggaatccaacttacaagggatgtgaaggacctcttcaaggagaactacaaaccactgctcaatgaaataaaagaggatacaaacaaatggaagaacattccatgctcatgggtaggaagaatcaatatcgtgaaaatggccatactgcccaaggtaatttacagattcaatgccatccccatgaagctaccaatgactttcttcacagaattggaaaaaactactttaaagttcatatggaaccaaaaaagagcccgcattgccaagtcaatcctaagccaaaagaacaaagctggaggcatcacactacctgacttcaaagttttcgttttttaaagcatctccggaaaagtttctcgtaaagcccagtctcttagagccaggtggcaacctttgatatgcaaatggaagccgttagaaactgggtccacccaaacatggcgattcccacactttcttggcctttccccacctgttcctagcaacatggccgcccccacgtatccccaagtgtgtagaacatcatgtgtcctgcatttgcatattagaaggctagggtgggagggccagctttttccagggctacatcaatgacatgcccaatcaaaccaatcccctaagccctatgcaaatcagacatcgcctcctccagcctctgtatacctagctggtatctggggcaggtgggtttccctgtctccgctttggagcccccgctccctctgtctctatacaggggagcttcttccttctcccttcttgccccttcttgcctattaaactctccgctcctttaaaaaaaaagaaaaagagcataatttgtctgtgagcagcaattattttcccttattggcagtcgggcatacatggagtattaatgctgcttcccattttgtcattttgggttcaaacccacctctgtagtagccaccaccgaaggcagattttggtagactttgaaaaacttgttctgcttgaggctccatgtgcttcatggcttgcaacacctaatggcctgcaaattctacagctacaatggtgagtccagctgctaccacctactagccatggctccagcctggctccccctgccaccacctggagcatggaccatcccagcccagaggtcactgtcaaaaacaacacgcctttaccggagagcaacacagccactgacagcaagctcaatccgcacaagtccaccgacagcaagcccaatctgcccaagcccacccaccgcgagcccaatctgcctaagcccacccaccgcgagcccaatccgcgcaagcccaaccacctcaagcccaatccgcccaagccccgactcatcagttcttcacaccccatatgctttctttttagagtgttgccccctaaaccattcatgatgagtacctttcaccatctgtttttttctttttaccctcttggaaaagaggaaggtcacctgaaggtcaccactggaaaaccttgctggctctggggagttattggtctgtgacactgttcagacttgggctgtaggcagtctggtacctgtgcagcctctcttttatttgtttacttttattgtaaaacctgtgtgcaaaaaagtatatgtagtgtaaagataaggtttaaagaatagtggtgaaaaagaacatccatttaccctccaccaagcttgagaatttttttttttttttgaggcggactctcactctgtcgcccaggctagagtgcactggcacaatcttggttcactgcaacttccgactgctgggttcaagcgattctcctgcctcagcctccggagtagctgggactacaggtgcccaccaccatgcctgggcaatttttgtattattagtagagactgggtttcaccatattggccaggcttgtctcgaactcctgaccttgtgatctgcctgccttggcctcccacagtgctgggattacaggcgtgagccgctgcgcaccgcagcttgagaatatgagcagcacttttgaagtccctacgcaatgcggcttccctcatccctcctttccctctctagcccatcagaggcaaccactgtgctgaatttagtatcaatcaaccccttgatattaatgtagttttttaaccacatattaaatatttaaataatgtattgcttagtcgtgcttccttttgaactttttatcaatggtatatagtatgtatttttctcaacatactgattttctaaatgttacttttaaaaaggtgtatctgtgttgatttagctacagtaattttaaaattaggattcatattccttataattttatctctggggaatttttgaggatcttcttccagaaaggactggggttttatttctccagatacctggagtattattaccagcccaaggcctcctacaaatacattttgggtttttttgaaaacgcaggtggtgtaaattctgactccagccctaaactcaggcaggcatttcttcatttcatttattgcacccagaacaaagtctgagaggggcctgtatcctcagttcatttctgtggggcaggtttttgtttgagtaaacccactgagtgtgttgacctttggggaatcctagtttttgtagagttctctcatttagattcctatacttctaaaaatgtaaagcaaataccaataaaatagcataccagatattggttatcttttgccctaatgtggtgtaacaagtcaccacaaaacttagtgatttaaaataataatttggccgggcgcagtggctcatgcctgtaatcccagcactttgggaggctgaggcgggcggatcacctgaggttgggagttcaagaccagcctgaccaatatggagaaaaccccgtctctaataaaaatacaaaattagccgggcgtggtggcgcatgcctgtaatcccagctgctcaggaggctgaggcacaagaatcacttgaacctgggaggtggaggttgcggtgagcagagatcgtgccactgcactccagcctgggcaacaagagcgcaactctgtctcaaaaaacaaacaaacaagcgaacaaaaacaataatttatttttgctcttgtgtctgggagtcagttagggtctgctggtccaggctgtgctcagctcagcttggtgccccgctgtgggctgggttcagcctgctccacacgtctctcatcctcctcagatccatagagcatgttctcctcatggcagtggcagaatttattccaagagtgcctagcagaaacatgcatgagcagaaacatgcaatgcctcctaaggtctagacctgatgcacttcctttctgcccatgctccgttagctagagccactcatgtggtcctcagtccaataggaaacatattctgcctctagtggaaggagcggcaaagtcacatggcagaaggtctagatacaggtagagaatcttgatcattaattcaatttgccacagggaaattgctttcctttacctctgcttgctagtgctgtggatctgtgctcactgaattccattctcaaacgtttacatttcctgagggtttgatttattactcaagtatgttcatctctactcctgaagtctctcaggtgggatattccagatgagatatttcctaaaattgaaaaaaaaaaaaaaaaaggccaagtgtggtagtggctcatgcctgtaatcccagtactctgggaggccgaggagggaggatcacttgagcccaggagtttgagaccagcctggtgccccactgtgggttgggttcagtctgctccacgtgcaagcaacaaagcaagactccatcactaccaaaaaatttttaaaaatgaaaaataaaaattagccaggtgtggtggtgcgtagttgtaatcccagctacttgggaggctgaggtgggaggattccttgagtccaggatttcaaggctgcagtgagctatatggcaccactgcactccagcctggatgacagagcaagaccctctctctaaaaaaaaaaaaaaaaaggaaaagaaaaaagaaaagaaaaagaacatcaggagaatgccaactcaagaggttcactgcttcccccagctttgctactttggcagggtagggctcctgagaacaggagttcctgtgggagaatcgtttcttacaacttactcatcatacgtcaggatgtcacctggtctctgggggtacctgtggataacctgtggccgggatgggtaggacaaggtaaaacaaaactcaaactcaggtgggtgtggtggctcatgcctgtaatctcagcactttgggaggccagatccacttttgggtggatcacctgagttcaggggtttgagaccagcctggccaacatgtcaaaaccccatctccactaaaaatacaaaaattagccaggtgtgattgtgcacacctgtaatcccagctacccagttgggcgaggcacgagaattgcttgaacctgggaggcggaggttgtagtgagccaagatggcaccactgcactctagcctgggcgacagagtgagaccctgtctaaaaataaaaacaataaaacgtgtcaaactcacacattttaaatattgattcttaagccactgaagaactatatcctcattgtgctgaaaaacaatgggatacaaacttgttctattttcaagacatctagatcttttgttatatttacaagaaagataaattaggtggtggctattcataaattaatgaaagattcctcactttataaaaggagttggtgcaaggtaaatttaagtagcaaacttttccaaaacattaaaaatttcatgcaatttgaaaattttggctgggtgcggtggctcacgcctgtaatcccaacactttgggaggccgagataagcagatcacttgaggtcaggagtctgagaccagcttggccaacatggtgaaaccccatctctactaaaaatacaaaaaattagccagctatggtggcatgtgcctgtaatcccagctgctcgagaagcagagacaggagaatcgcttgaacccaggaggtggaggttgcagtgagccgagatcttgccactgcactccagcctgggcaacacagcaagactctgtctcaaaaaaaacaaaattttttaaaaaattttcttacaacttttcagaaacctgtttatcacatataacaggaaatatttgcaggtctggggctatttttccattgtggtgatcagtatatatttttaatgatttcatttcatttttattaaacttttttttaaggattcatatatggttcatttcgtgtactggttaatgtttgttactttaagccattaaaaagcagaatttgagtcttacaattggacactgtttgcatattgttttagttatttctagttttttgtaaagtatataaatgcgtttttttcttccaaattattggtcggattgtgtaattattaagagcctttgatctgagggtccctgtgtgtctcatctctctctctctttttttttttttttttttcctgtggcggagtttcgctcttgttgcccagactggagtgcaatggcacgatctcggctcaccgcaaccgccacctcctgggttcaagtgatgctcccgcctcagccttccaattagctgggattacaggcatgcgtcaccacgcccggctaattttgtatttttattagagacgggatttctccatattgatcaggctggtctcaaactcccgatctcaggtgatccgcctgccctgacctcccaaagtgctgggattacaggcgtgaggcaccgcgcccggcctgatctctttactgacacgtgcccacaggggagcaaggaattcctaacttcagtagtaacttgggaatttcattgaaaagtgacaactcctttccatctttcatacttatttttcccaccatcttctgggttttgataattatcttttaggtactccaagagtactatgataggcttaaaaaaaaaaagaacagaaaaggagacagctgggaaatccaccagcagaatcaagttccatataccaaattattttttttcatattttcttacatattgtttgtaccatctcttcatcccactctactttcggagcgagcattattcctggaagaacttttgtattttctcggagtccatctgctctgaatacttatctcccacctgaggccatcatgttccattcggagcatcgtaatcattttcacagcaactaaacatgatttcacacacagcagattatgacttctgtggggagtgagcagtgtaaaatgattaaccccttaggacagggaccccatttcacactaatctccttagcaaccaacagaagacaggaaaatggacagcataaatggattgaggataatgcagcatcccatttaacgatcagttctaaatgcctccggaacatacttccaaccagaaatgatagctgatgccaaagagtattgagcaaatgtccctggaaaaggtggcactcgtgtggaagaaggacatgggaacatatgccgtaaagattgggggtccatcagggatgaagtcttgcctgactgtggtgggccgctgggccagtaggactcccggagagacagcatcacagaatgcatggatggtggggttccgaatggcttaagtctaaatgagttgattctacttttgtctagttccgttacgttttggggaagaagagctataccatgcataggtttgtgaattagttcttataacctccctataattacagaaacaaggataacccaaaggtcttgatttttttttcctaaaatatttctttttccctaaaagacttcatggcaattgaataccctgttttcagtttactattgctagttcaaggaagggagtttttactgggaagaagaaagtcaatctaaacaatgccacaactgtttgtttttttttaaataaccttccatgcctatgacacaggcagctaacataatgggttccattgtatttgaatgcttctgaagttaatgctacctttttctgcatgacttacatatagaggaagtcgggttggtttgtagccaatggctgttagatttgatgactaacagtaggtatctcagtaacaaaatgtttctctctccatcaccattaattttggaatcttcaccagagctgattgatcaactcagacaacactctttataaagtataatgaaattagaattttgatttagtcgtaaatgtggttacagggtgggatttgaaagcatcttctgtcattgaagagaagactatcatcaaagaaattaccggcatgctataggaatccaggcattgtggaaccttctgttaccccaggcaattattattattgtgattttcgactcggcaagtgtatggacttgaaaaaatcatctaataaacatttattattagctaccctttgcctgatagcagaaaatgagaaggaaccagatgcacccactttaattaattggtgtaatcaggagtggtatgcgacatcaagggtgaaaattgctgacttaaactgtggctttgtggctccaatgaagtcttgaagtcttttttccccttgaataacaacagaatcagagcctctggattttcctttctcatccatctgaatttctttccttttttgggggtggaggtgtgttcaattgaaacttttgatgtggtgataggattcccaatttttctgcaggagagttgggagtttattcctgagttttctcagttcattcaaaagaccaacaaagagaggaacaacatcaggaaatgtaatggaaacaatacatgttatcctccttttgcctgaacatggtacagattgaagtagcaaccctctgcttagaaaaaccttttctgttgttcccgactaagcaaaccatcctttaggtctctgcttagacatcactttctctgagaagtcttcccaaaataccctccctcccaaaccaccctaccctccatccttcctccagctctgttaggcttccttattcccgtcttagcacttcatccactttattttagaattgcctatttattgtctatatcctcttttacttggggtcaggcactgtgtcttgtcacctctatatctccaggatctaatacagagcctagcattcagtaggtgcttaatcaaacctttattgaatgaatgaatgaatgaatgaatgaatgaatggaagtagtgtctgtctcacctaggtataccttactcatgtctgcattttcagtacctactgtcactggaaaggagttccgatccagactccatgagagggttcttggatcttatgcaagaaagaattctagatgagtccataaagtgtaagcaagtttattagagaagtaaagaaacaaaagtatggctactgcacagacagatcagaaccgagggttgctggttgcccacttttatggttattttttcatgatatgctaaacaaggggtggattattcatgcctcccctttttagaccatgtagggtaacttcctgatgttgccatggcatttgtaaactgtcatggtgctggtgggagtgtagcagtgaggacgaccagaggtcactctcgtggccatcttggttttggtaggatttggccggcttctttactgcaacctgttttatcggcagggtgtttatgacctgtatcttgtgccaacctcctgtctcatcctgtgattaagaatgcagcccagcaggtcacagcctcattttacccagctcctattcaagatggagttgctctggttcaaatgcctctaaccctacttggtgtatcagttatctattgctgcataacaaaccactgcaaaacttagtgtcttaaaacagcagctatttagccatgattctgcagactagcagtttaggctggcccagctggtcagtgctggtttcagctgggctccctcatgtgtctgtggtcagcttccaggccgttgagtgctgggtgttctaagtaggcctcagctgggggtgttgtctcttttccctgtgatcttttatcttccagaaggctagcctgggctttttcaagtggcaactgggcagggctgtaagaaagggagcagaagtatgcatgacctcttgaggcccaggctcaactggcacatcatcacttctgctgtattttcttggctgcagaagtcacagagccagtcctgacttaaagggaaggaaaactgacttctttgagaggaggaactgcaaagataggttttaaagaggcagggatacgtggaggagagtaattgaggacatttttgcaaacaatctattattcttggcatagtgtaggtactctaaagcacttgactactttgagtccaacaagtattagatttagcccaagtcttggaaagtcttccaaagaagataaaatttctctttggttgcattctgaatccctgcccttccccatctcctattccctgatccctccactgctttgtgacccaagcatgcaggccttgtgtggctgtcagcgcccaggtcctcctattcaatgggtgatacatcctggacacctactgttctcctgagcatcttgtataaactagaccccacacccgacgggaccacagcagtgagcaagaaagacagattcctgttctccactgggaaagatggatgtttgactagaaactacgaaatggatgtttgactagaaacaggtaacagaggggacctgccttgttgaggacctggcatttaagctgcgacctaagaggtgggtaggaaggggtgttctcgccatggaggaggtggcggtgacagtgtggggcccagagacggtacggtggagcacttttcagagagagggagtgtgcagaagggccctggtgcaggaaactgggagaggacagaatggcttcagctcaggggtgagggatggcagaggtgtgccagaccgggtctcctggggctgggtgagccaaggcactttcccaagagatgactggaaagctgttgaagggttacagacacaggggaggtgacccaatttactttttaaaatcatcctgggctgcatagataatacatgtagaggcgtgcaaggctggacatgaaattccttccattctccaccatcaaaacactctacccagcggggtgtgaggaagaaagcaatccgatgacatcgaattcgcactaaagttactgagaaccttgtcatggtatttgttcaaatcttgagtgtgcagtcttcgaaaccctctgagctctgttccagactgtcctctcagccttgagtgcacatggggcaccggaagctggtgcactggggaagagagggaaccgtcactgccagctgcccggtggtgcaacccccattcattctgatgtgggctggctggctggcaaggcggcagaggggctcagtgtcgccgtgtaagtcctcaaacggtccttgctagtggctcactttagaggggatggtgcacggctccttttcctcgggatctcagagcaggtgcttcacctgcctctacttcccccttgcccatattccccccattgggtactattttaccttttcattggatgtcatttaaaaaatgtggtaactcagcaacacctttcactgccttaggcatctggttttctgtgtgacacagaggccttccttctggcgctgtctcccgggagcatcttcaggcagcatttctctaacttcactgaatgattctggaagtggctggcagatcactgtcagtggagtcaaccagatgtgtatctgctaggccatttccctttccaccttccctcggttctcgctgggtcacagaagcaatgtcataacaacacagcttcctcctaatgaaacatctgcagccaccctctggctgacagttcattaaccttgtggcccaaactgcttcggtgccgtccctgctcctgaattttaacattcagagttttcttcaaagcccaggtctgcttatcaatcatgttcaatattaggttacttacagaatgaagtcattatctttaatgtttaataactgtgccacaaagataatataataaaatctgagaaatgtaattgagagaggcttttgactcaagtcttgtgtgtgtgtatgtgtgtgtgtgtttaatctttcctaatcctatccccaaggctaagaaaaaccttgttttcgctctgtcttctacttggtttgtctcttttgttttgtttttgcttggcaatgtcctgatcagtctgttttggtgatggctgagtctggggagctggcagcagagatgatgacactgggattgacactatgctgcaggagggggtggttgacggccacaggagatgttgtggggttggacccttgcagggcatggatttggtcaggtatggggaacaaatgaccagcgtggactctgctcctgacacaaatgaacaaagtgcccagatctgattcccccagccctggtggcttccaggtctttgaaggtagaattgagcctcacagcagatggctcctggtagtgaagagattcttgggcaaaagcctggtcattaaagaaggaagatttctttctttccttttttttttttttttggagatggagtttcactcttgttgcctaggctggagtgcaatggcgcaatctccactcaccgcaacttccacctcccgggttcaagcaattctcctgccttagcctcctgagtagctgggattacaggcttgtgccaccatgcccggctaattttgtatttttagtagacatggggtttctccattttggtcaagctggtcttgaacttccaacctcaggtgatctgcccgcctcggcctcccaaagtgctgggattacaggcgtgagctactgcacccagccgatttctttttatttttttgtttaggaaaatgtataaaatggaatgtagtcattttgctttgtcttcttggaagaagcatcaatatgaataagtctttgaatttgcaagttaaaactctgattttccatgggcagaatccgggtgagaaataagtctgtttgactgttttgagttcttcctttaaagaatatagaccatgatggtggcctgtgttgtgtcctgaggggctgtgtacacggagtctatggcaaggttcataaaacgcttagaggtttttcagagaaaggagctatagaaatggaaggtggcacagttgtgttggaaacctcccacggggtctccaggctctcatttccctccaagtcataaagtgagaggatctgtggtaagtctccccctctcccctcccctccctctcttattctgttctcaaggcaagaagcaaagcatgagggtctaactatacaggacaatccttccacggttcctctgcgcagtcccatcttacatctttggaggagttggatagcttttctttcaaaattttacaataattcctttcctttttctgaattgctttatgagttgacttgtcttcctaaggagtcaaagttaacaagactacccttgaacaatgtgaaactcaaccaggtatgtagcaggcttttggttttttatctaaatggttgaatttcttttttggtctagctgtattaggaatagagagaagagaatttctggaagtggagaccaggaaagggttcagactagttcttattattattacttttttttccctgagacagagtcccgctctgttacccaggcttctggagtgcaggggcatgatctcggctcactgcaacctccacctcccgggttcaagcaattctcctgtctcagcttcccgagtagctgggattacaggcacccaccaacagacctggctaatttttgtatttttagtagagatggggtttcacgatgttggccaggctggtctcgaactcctgatctcaagtgatccacctgcctcggcctcccaaagtgctgggattacaggcgtgagccactgtgcccggctgggttcttgagggagccaggctgagttctgcagatgcttctgtttttgactgctctcatattttctaaagtacatcctagtctctttcaactcatggggaaaattgcagagagttagggcccgtatagtatgtgacaccaatcaagacataaataatgaagcataaacatgtttttaaaaaacctgttatttgggatggagagaaaataacccttttcaaacattcgatataactttatacatcctagggaaatgtttacacacaccattggtttaaaattttagctgaattattttgatacttcagttcaacaaatggtcaattcagtcagttttttaattgatttttcacaaaatggaaccggttgactgcttgactcaactagtcatttgtgtgatacagacgcaggcttagaagaataaggttgaactgggcagtggcagatggctaaggtcgagtttaaggaagacacagagaactctacccatgggtccgtatcatgggttcctgtcctcacatccatatcatcagttcatttagtgaatgaaatcataatccctgcctctcaaggtctcatttgatttcacattcagtggcgttttcagtctgtgttgaaagcacatgagatgttgacgcatttgcacacatggtgagccaggaaggaggtgacgagagtgaactgggaagagatcatttgaacattagagatgacgattctgtttactattttcttaagtccttactggaaatattacttttcatggactagaactaattggaagtaagatatcctgtaagtccatttagaaaaaattcttccaactagttctgagcacgctggatttgcctgagaaactctttgggctgcattctgagggtggcttgggtggatttgccttgacttgatggccttgaggaataaggaggcctgaatgggcgtgaaactgtgtttagaacttgagttggcctgacacagctctggttcacacttgaacttatgtggacacttctctgcctctccattattcatctttgtacctcctgcatctagcgtaatgttgaacacatgacagacgttcattagatgttcagagtctggttgtttgccagcctaaaatgcttagagtttattgaattgggttgtacatgctactaggacctatgactttggggaaggaagttttagggttcagcaacctttcacgttttgtctttttttttttcttatgggctaggatatttacccaaggtaaattcagagaacaggggtgcgcagtgttacatatggcattccccacttaggagcaagtgactaatatctgtgttaactgaagtctgtcttctcacaggttctgtgctgaagaaccatctcactggctgacaccccttaataagacattctgaatctccatgattacaagattggagtgtgttcagaaccagaggcaagcagaatagttcagagatgtgggtcgtaatctgagtggggatataagggccccgacacaggtgccaccgggcagctgctggaagtgggtttggagccgcacagtgtgcaccaaggtcagtcctgggtgggggacgtgcagccaaaggaccatccctgcgggattcagactccagatcccctgctttcccatcgccatgggatgcccagaatgttaggaacaaaatccttgctcacgaagtcggcctcacttttccctgcccagctactggcttccacgtcctcgtctttatgaactttccatcatgtgtctagaattccatcccctctgctccctgctgattcatgcccgccattttcctagggagctcagtcaacattcagctcttcaaaaattctttttctggcctcatctcaggactgtacttcattttgtagtttttccacacagaacttgtaagcactcttgaatcatttcatttatgtcccgactttttagctagcacgcttaagagcaacacaggccttgtttttctgtgtatatgctgaagcaagcagaactgacctacccaaacttaatagtatgaactgtgttaatataaattgtcagctctggagattttatttgattctcaaagtaactctgtgaaggccaggcatggtggctcacgcctgtaatcccaacactttgggaggccaaggtgggtggatcaccagaggtcaggagttcaagaccagcctggccaacatggtgaaaccccatctctactaaaaatacaaaaattagccggtcgtggtggcacacacctgtaatcccagctacttgggaggctgaggcaggagaatcgctcaaactcaggaggtagaggttgcaatgagccgagatcacgtcactgcactccagcctgagtgacagagtgagattctgtctcaaaaaataaaaaagagcaatttttattatttccatgtttacagatgatgaaactgaaattcagagaggccaggtgacttaactaaggtcacacagccaagtggaaggcagaggtgggatttgagtctttgctgattccatgtctattattctttctactgccatacactgtctttctggtttgctgattcaataaattttgccttgaaaaattagagtcacaattgtcttttgaaagcctttctttggaggaaatatcctctgagaaactatgattttttagaaaataattggacttagagaaaaggagtaggctctgcctaaggaaaaaatgtattacttagtcctttatcaaacatttatgggtttactctgtactgtgctagttgatgggagtgggactagggtcaaatgaggacatggtttctgtcctccctgaacccatagcctcgtggcttggagatgggacaccatggtggcagatgttgtgtgtgcttgtgaatctgaaagactgatgcctgatgggcatcagtttttgtttgtttgtttgtttgtttgtttttgagacagagtcttgctctgttgcccaggctggagtgcagtggtgtgatgttggctcactgcaacctccacctcccaggttcaagtgattctcctgcctcagcctccaaagtagctgggattacaggctcccaccaccacacccagctgatttttgtatttttagtagagacgggctctcaccatgttggccaggctggtctcaaactcctgacctcaggtgatctgcctgcctcagcctcccaaagtgctgggatgacaggcatgagccaccgcgcccagccctaatgttctaactcataaggaaattttaccttcattcactacgagtaggctcatactatacaaatattagtttctagagtccattgatggatgaagagataaacaaaatgtggtctatgcatacaatggcatattcttcagcgtggagaaagaatgaaagatacgtgctatagcggtaacatgaaccttgaagacattatgccaagtgaaataagctaaacacaaaagcacaaacattgtatggttttgctcatgtgacaggcaaaatcatagagaaagaaagtagaatagaggttgccagcagctagagggagggagaatgggtgccgagtttcagtttgggaaagtgaaaaagttctgggcatggcgattggtgatggttgcaaaacaatgtatgaaccactgcattaatgtacttcatgctcttgaatagtacacctaaaaatggttaaattgataactctcatgttacatataccacacagaaaattagttttcagaatagctgacaagctatgcttagatatgtctttaaggcaggaggaagatggcagtggtcatagcagtgtgtggaaagcaggagagaccccacatgtcaccaattagctctccaaatccagaaaacatcagggatgaacagcctccgctgcccatgatccgcgagctgtttcgctagcattccgaacaattctggcaaaggcggaaacactggaccaggatctgggtgactctttcacagttgattgggtaaggagaagcgctgttctcagagaaatgagaacatgtgtcttggaaggctgcctttgcttaatgttctacacgatccaggaggccagatggcattttatgtggttttcacaactgtgattttggattgattactaaacctgtttgtgttcctaacccagctcgctgcctcccgcctgccttttagcttaacgctcattcccagagctcagtttgaacaggcgcattgtttttattctgttccttattattattgcgttggtgccagcctttactaccttcagccctatttgctgcccagagtctagtgcagaaaatgaaatcctttttccaataagtgtgatcaaatgaaaggctgtcacactgcatttacatccaattctgggtttttttttttttttttttttttgagtttgggtcgcccacatgatgggttgtaaaaggataaaggataatttctgatgtcgtgccagcttttcctcacccagctgaccttctactatcagatggtattttcataggaaaggcaaattaattttatatctaatgtaagaaaaacattattaggaagattgtaatgaaaattaagtagtttgcaaaatgttttagaattttcatattacttttgcataaaaaacttctttcagttcttacaacagtcctgagacagagttcagcaggtgtccccatctcatgaggaaacggaggctcagagaagttagggggcatgtccaaggttgcccagctaacattggtcagagctggatctggagagcttatctgcggggtccacatccagaatgctttctaccgttctgctgtaccagctggaaaacaaaatcccattcgagtaaataatatcagcaatagccaccattttaagcaacttaccaggccatttactaaataagtctccttgtactgtagtaactctcatgactaaggtctgcagacgacccatttaataggctggcaaagtgagtcagagattgcgaggagaggctgagagcttcctgggaacatctctgttgatgtcttgaactgggttcccattgttccagcagggaaactgaggatagcagacattgcaaaatgtccttctgtgaagagacttctagtcgttttggtgaaaacacagtgtcctgctgcctagctgaaatcctggtatggataagtttatcttatcatctttctatttctagtacttggcccagatcgtgacctaacagcaactatttgttgagtggaacctccaaagatagcagtttcttcttgtggggaattacagtctattgatttgctcaatgcaagttcattttattaagatttcttcacctgtgtgtttatataaatagacagccaggcagtgcatgaaagtggctgcccggccagagtctggctgggctgcttcgttctactctggggattggacccagtagaattcttggacttggtgtggagtcccaggtcaagccaactcattacttctacctctcctttttaaaaagggttttctgtctttggttcaagttcctcttaaaacacaatcatcatcccttcattgatagaggcacaaatgaattattttttttcttttttcttttttttttttgaggcagagtcttgctctgttgcccaggctatagtacggtggcacgatcttggctcactgcaacctctgcctcccgggttcaagtgattctcctgcctcagcctcctgagtagctgggattacaggtgtacaccaccacacctggctaatttttgtgtttttagtagagacggggtttcgccatattgaccaggctggtctcgagctcctgacctctggtgatccacccgcctcggcttcccaaagtgctgggattacaggtgtgagccaccaagcccggccgaatttttaatttttttattgaaatggagtctcactctgtcacccaggctggagtgcggtgatgctatctcagctcactgcaacctctgcctcctgggttcaagcgattctcctgcctcagccccccagtagctgggattacaggtgcgcaccaccacacctggctaatttttatatttttagtagagatgggggtttcgccatgttgaccaggctggtctcgaactcctgatctcaggtgatccacccgcctcggcctcctgaagtgctgggattagaggcgtgagccaccacgctcggccgaggcacaaatgaatttaaacctcattgaaatgacagcggatggccatggctctactgtggtttccctgggccactttcttctcccgccttcctgccgcatgcaggagtggaggccgaggctccctggccaggctgctctgggttattacagtgatatatcttggaactgagcttgagcagggatcctcctgtttcctgttggaattgattttctgtccaactttcatttcctattgtgcattcctttggggtcagagcagctttctcagacaaaagcagggctttctgttttggagatattcctggcgtctcttcagctgcgtgtttatagaaatggacagcccggcagtgcatgaaagtggctgcctggccaaagtctggccgggctgcttagtggtactctgggggttggacccagtaggattcttggacttggcgcggagtcccagatcaccctgtcattggccctgtatcttaacttgtaggcacgtcttcatctgtcagatgggctttgttctctgaagcccgcatcagagagctcttcagaagagaggaaatgttatattgctgttatcatttcaaatgcttaccgctaagtgaatctggttcaaagcttaacagcctgtgggtgaaccgcaaaagctcaattggatctcaaagaaatccctggtcaagccctgtgccttctagtacccaattatttatcaataagtgtgaagattgcaacctccagattattcagccattgttgagatgtgtaaaaacggtatccccagcaccttgaaaggctaagtaggatcaaccccccagttgttgttcactttctgtgtcctcagaatccacttttgtttcagtccttctaacccattctcattgttttctgtcagtgttggaataagtggaatagcagggtccataaactctaccacttgattgtcaggaatgaagaatttggttttctctgttgtcataacattcgtgagtacatctgtaagcaggcattttcccatcatctttcccgcatttctaatgaatgtgacatcagtctatttgctgcttcataatcaaggtcctgtttgttgatatgtaatcaaagcaaccggattatgtttgtcagtacgagtcagaaaaatctaatatatatttactctgatgccataaggagtgtcagcctttgctggcctcaataatctcgtcttgggagagaaagctcataatgtggtgaagataccgttttgggattatttctagaacgtgatagttgtgccgtgcacatacatgtccaaatgcattgagtcatgtgatagcatccagttttatgcaaccaaaattggacattatattgtttggatagagtgctcaagatgggtggttcctggatagagtgttgaaggcagtggtgccatcaattcagcagcaaggaacttaatagctttctcatcacagtcctcacctcctccctcctttttctgtgtcacagaagcagtaagaaacatcgaggaatttcccaacatatcagggaatttgttatttcttctaaaacataaggaagtacgtggcaatataaatggcaaatgtgcggggtgcggtggctcacacctgtaatcccagcactttgggaggccaaggtgggcggaccaagaggtcagcagtttgagaccagcctgcccaacatggtgaaaccctgtctctactaaaaatacgaaaattagctgggcgtggtggcgggtgcctgtaatctcagctactcaggaagctgaggcaggagaatcgcttgaaccttgggggcggaggttgcagtgagccaagatcgtgccattgtactccagcctgggcaatagagcaagactctgtctcaaaaaaaaaaaaaaaaaaaaaaaaagaaagaaatggcaaatggacatttacatggtgattagaaaattagaatacaccgggaaatctgggttctgttctcagtcctacttgtaacacatccactgaccttaaacacatttctttactttgctgcacctgaattcccttatctgctgtaaaatgaatttgttgaactaaactaaatgttctttttttttttttttttttgcgacggagtctcgctttgtcgcccaggccggagtgcagtggcgcgatctcggctcactgcaagctccgcctcccgggttcacgccattctcctgcctcagcctcccgagtagctgggactacaggtgcccgccaccacgcccggctaattttttgtatttttagtagagacggggtttcaccgtgttagccaggatggtctcgatctcctgacctcgtgatccgcccgcctcggcctcccaaagtgctgggattacaggcgtaagccaccgcgcccggccctaaatgttcttaaagatcctttccagccctgacattgaactcagtacatcaacttacatgatttattcgcacaatcttagcagaattaatttggatttgttaattgtttgcatctggctaattattgcctgcacaccgtaagactatctaacagtagtagtttcttatattaactaaaggtgctgtgaaggaaacatggaattcccccaaaatcaaaactaaaagaaacttctgctttagagcaaacactgataaaatatacataaggcaccctagctgcactgggcccttctgccctcttcagcaagtcctgcctgaggtgcacacaattattactggctcttgtgccacaaagtgacatcgtctttggctgtgacaccacatgaagagggaaggaggtgtgagactgtgaagacactcagtacaggtgcagcctcctccacagagtaaatgtgatacttctcgagttaatgactatgttgggaagttttccaactccaccatcttccctgcttcaacgaggatcccagggggaagctcacagatttgcagatctttttacactaaggaagaataaagcagcattccagttgcaggagtataagccagccacagacccagggggcacatcttacactgtctttgggagaaagaaaaagtactaataacaaataaatctgatgggatttcagatggattccagtctcattcttttgtgatagcagggagtgaggttttgatatattccctctagagatggttctaaacatggagacccatcgatatccaggtatacctcctctcctctctgatcaatccaattgctaaacaagaccagagcaaggctcagtagttgatggcaagtgcttctgctaattgccttgcgattggggaatcaggaggatgtttttattcaggaaggcatgtctgaccaatgaaacaaaatgcagttggtatcattttagatttggctcttgaatcgtcagaaatatgtgccttcactaactttgaggaggaagtatcccttctctttgggtatctctgggaagttgctttattgatttttcaccagtttgcagacaagcccaagtctaaaaaaaattcagatgtagcctaatactgcaagcctttcttttatctgtctatctatccatctgcctgtctgcctgtctgcctgtccatccatccatacgtccatccctccatccatccatccatccatccatccgtctacctacatgcctgcctacctcagcctcccggatgtttgaggctgcagtgagctatgatcacaccactgcagtccaaactgagtgattcatgattgcaccactggactccagaccaagtgacagaacgagacagacccatctttaaaaaaaaaaatgattatgagaggtctcagtgcagaaatggcttcctcctgcccattgtgccagcttgcccaggcccagaggttgagtcatgatatgaatgtgctgtgtagtgtccagcaccagaagtgtgggtatagtggaggaaaaagatacagagccagaaccaggacatggaaacatttttaagctatatgtttttaaaaatcaccacccccatgctagagagaggactgaattaggtttctgttttctctctaaaattgatataacaaaattgttgtcatgtgaagagaaaatcaaagagtatgctgacaaaatatgtgggaaaatctaaagcacagggacaaacgaaaaaaatagatgacttgggactatatcaaaatggaaagctttttttgttgcaaatggtaccatccagaaaatgacaaaagcaacccacagaatgggagaaaatttttgcaaatcacatatttgataaagaacctgtacccagaatatatgaaagactcttgccactcaataataaaaagacaagtcaattataaaaatgagtaaaagatttgaatagacatttctccaaagaagatatacagatggccaataaacacatgaaaagataattcagcagcattagctatcagggaaacacaagtcaaaactacaatgagatacccctcatttatactcgcatggctagaataaaaaagataaacaatatgaagtgttgatgaggatgtggagaaattgaatccttatacattgctgttgaaaatgtgaaatgaggccggtcgcagtggctcacgcctgtaatcccagcactttgggaggccgaggcaggtggatcacgaggtcaggagatcgagaccatcctggctaacatggtgaaaccccgtctctactaaaaatacaaaaaattagccgggtgtggtggcgggcgcctgtagtcccagctactcgggagactgaggcagaagaatggcttgaacccggtaggcagagctttagtgagccgagatcgcaccactgcactccagcctgggtgacagagcgagacgactcctcaaaaaaaaaaaaaaaaaaaaagaaaagaaaatgtgaaacgatatagcccctgtggaagagaacttggcactttctcagagagttaaacacaatgttatcatatgacccaacaattctacccttgttatgaaaaaacatgtatccacaaaaccttgtacatgaatgtttatagcaacattattcataatagcccccaaatagaaacaacccaaatgtctatcaactgaagaatggataaacaaaatgtggcatgatctatataatggaatattacttggcagtgaaaaggaatgaagtgtggttcattcattgaaatattatggtaagtgaaagaacctagacacaaaagatgacatattgtatgattcctttgatataaagtgtctagaagaggcaaatctgtagatacagtatgtagattcctcattctcaggggctgaattgggacgttgcagctaatgcatatggaatttattttaggagataatgaaaatgttctaaattcgatgatggttgcacaaccctgtaaatatactaaaaagcatagaattgtacaatataaatggatgaattatatttcaatagagctgttttaaaaatattgaaaaccagagatacctgtctgtgctctaaaatgtatccactgccttctagatacagtctaaactctgcagcttggcttttaaagccttttatttatatggaatcctccccaccccccaccatctatacatttgtaaaccttacatgttattcaaatgccataattcgtcaaactggatatgttttctccttccagaaagatattccttcatccctcttataagccttagcactgtctgccttgcgttatatttatttctgtatctgtcatatgatctctatctgatcgagagctctttaaggccgggatgtcggcttgctcatattggcatccttcaggacacctgacccctaaacttatctgattggtacgtgatacatttttatcactggatagaatgaatgggttgtgaaattattagatgtgatcccagataggatactgtttttactaatctctttcacaagggtctttcaagaacaatgcaggatcaaacttataaagagatttttgaaactctcaaaactctgtgcagggtattattattatctgtaatcctggtaactattcaaattagtgtcaattaacttttggctgcactcttaagattctttatcatctacattagtttgtcagatgaggtaatgcactttttctgggtacagttgtctttgaagagattggcagcgtttcatagttgtaaacaaaaccgtctcatatgccggaccgtgacaaagagggactaggacgccagaagctctgtgaaaacacttaaatccatttcagcgaggaggaattgtgatctggtaaataaattagtgttctgctctgttccttggctcctctgctaatgaatgggccccagagatttttttttgtcttgggtgataagcccctaatatctattcaagttcagcataaagctcattttctctagaaatctttgtttaaaaacagaatttttccagtaaatatatttatcaaattaaaagtatttcagatacacagagagtgatataacaaacaaaccaccgcctgtgtctaacaaatgctggctttttgtcatatctgctttggatgtttttttagttgaaaaacatttcgaagatagttgaatcattcctttccttcccaaatctcattgcccctccctccctttcctctgaagccacaattatctctaccaggaatctctctctctcttttttttttttttttgagacggagtctcgctctgtcgcccaggctggagtgcggtggcgcgatctgggctcactgcaagctccgcctcccgggttcacgcaattctcctgcctcagcctcccaagtagctgggactacaggtgcccgccaccacgcccggctaattttttgtatttttagtggagacggggttttaccatgttggccaggtctaccaggaatctttaactggttaatctttcagtccaactttgatatcaattgttaactcttgagaccattttctatttcaaaactgtccatctgactcgtttctattactctgaaataatagaatctcagaattctgtgatctaccttcaagccgattaaatgggaatttttcccagagagagtttaaaccggcctctgggttaggggagaagtatagaccccaaagacccttacagagaaatacttgtcatcacgctcctggaattctgggagagggagaggcatgagaaggctgtgtggccttgtctttgaaatacagaagtttggtgacgcctggaacattttttacatgacaaatatggtgaaatttaacaggctatcaaagtgcagatcaggccaactgaatagcagttttggggaaaatgacaaggtgctaggtagtggagagaggaagattaaataacctacttgggtctatgtgctcgtgaagacacgctcatatgtcttccttgcatggatacctgccttgctctaaaataaacttgaagtgtgtttttaaaaaaagcatgtgtgcagcctgggtaacatagtgagaccttgcttctacaaaatacaaaataaaaagagtagccgggcatggtagcgtgcacctgtagtcccagctacatgggaggcggaggcgggaggatcacctgagctgaggaggttgagtttgaggctgcagtgagctgtgattgcaccacttcaccctggcctgggcaacagaataagaccctgtctcaaaacaagacaaaacaaaaacatgaatggaacaagaaagaatcatgaggtgaggaaatgaaggttaagggaagatgaggatcagagggagtaacaggttcagttctaagatgaggtccgcatgtggaatacataccattaggcacgaagctcgggctggaagtaccctacagactgcaccatgagcttctcaacagacagtgggtaaaggagtcagtgacagaatctagggcttttaagataaaagcaaaccagttggccaaggaagaatggctatttccagcacagatgcctgagggccattttttctgaggatgtggctctcacccttgatggacaatcaggacattctagcaaatgtgcattgtgctctagaggggtgtgtgcagggagcatagctgagggatggaggggctcatgtgcatcaggattgcctggaataccagggattattagtgccaataatgctgtcaatgacgttgtgatggttaattttctgtgtcaacttgactgggccgcgggatgcccagatatttggtcaaacgttgttcttgggtgtgtctgtgaacaaatagccctcactggtgcaggtgagtctcatccaatcggtcgaaggcctgagtagaactggccttcccgtgagtcagatggaagtcctcttgcctgactgctcgatctgggacatgctgctttgggactccagctgaaacatcagttcttcctgggtctcaaggctgccagcctttgggatggaatgacgccatcgggtctcctggttctcagccctttggactaccactgggactgtggtgatagtctctcttgggtcgccagctggccaactgcagatcttgggatctgtcattctccatcttatgataaatcaataaatacctctctcattatatatataatatataatatgaaataaattaataaatatctctcactatatatagtgatatatatatattaggtatattttatatatatgtatatcctattagtcctgtttctccagagaactctggcgaatacagacattccatatgcaaagagaggccgcgtggtcttaggtactagttgtaaaattataatatatattatattatatataatatttaatatatataataaatcaataaatatatatctcactatatatatctcttactatatatataaatcaataaatatctctctctcactatatgtatatatatcctattagtcctgtttctccagagaactctggccaatacaaacactccatatgcaaagagaggtcacgtgatcttaggtactagttgtaacattataatatatattatatataatatttattttatataataaatcaataaatatatatctcactatatataaatatctctcactatatatacatatcaatcaataaatatctctctctcactatatgtatatatatatatcctattagttctgtttctccagagaaccctggcaaatacaaacattccatatgccaagagagatagcgtggtcttaggtactagttgtacaattattttacatttgaagaggtaaacctttgggttcataggctttctaactgatgtcatggagtggtgggagggttttgttttcccttatccattaactttattcttaaaataacaatatcactaataacatttatggcatacttgtaagcacttcacatatattctctcacttagcatcatgacaatattctaaggggactgaggcactcagagcttaggaaactcgttcaaggtcacctagctaggaaacgatgtgctgttttcaaggccctcatctgaataaaactatcttccctttactctcagcggtgaaaatgggggagagatctgtattggaagctcattcagatgttgccttcttttgcactcgaaggctttgctctctgaaggcaggaagcagcaggcacgtgtgcagggaaggctgtgtatgtggcatgtgcaggcagcagcagcaacgcgggacgatggggagagagcccaggggagggaggatgcctgcagaagcggctgtgatgtgtgggaagccccgctgggccggcactgtggaaaggtgacctgcagagccacagctgcaaatgaaccactaattttcccatctctgcttgcaatttacaaagcactttcctggtgtcatgagtagctcccaagtatcagagcagggattgaaacttaagttgtttgacgctacactctgatttcctcaccccacctcactgtcttgccagttccaactgtacccctcaggaatttctatcaggagtctgtgtcaacatcagcatgaagctgaagaaggagaaaggaaatggggcaacaaagcacacagatgttcctaaaaagcaaaagcggaagagagaagctagactcgcctgtctctggtttttctcaccgcctgattgttcctttcagatgacccgcatctctcggagctgacctcagctcagcaagggtgcctgtgacccatggagcagtggccactatctctgcattgtgggagggtggtccgtgttgggtctgcagggtcgttgtcacagcgatgaatgtgtagatctgtgcttgctgaagctcaggctggtcgctgtcttgtcatcgtctcctgttacacagctttcaggctgcttttttggggaagttagactcgcctgctcttttttggggaagttccacctcactgcagccgggtatggtggtttgctcctgtagtcctagctacttgggaggctgaggcaggaggattgcttgagccaggagttcgaggctgcagtgagcagagatcacaccactgcactccagcttgggtgacagagtgagaccctgtctctaaaataaaataaaataaaaataataaataaataaataaatcaccccttggccaggcgcagtggctcatgcctgtaatcccagcactttgggaggccaaggtgggtggatcacctgaggtcaggagttcgagaccagcctgggcaacatggggaaaccctgtctctaccaaaagtacaaaaattagcctggtgtggcaggcgcctgtaatctcagctactcaggaggctgaggcaggagaacggcttgaacccaggagacagaggttgcagtgagccgagatcatgccattgcactgcagcctgggcgacagagcaagactccatctcagaaaaagaaacaaaaaaatcaccgtttaactcagaatcagccacgctgaattgaggtgaggttttatgcatatcagattgaagacctcctccggggagtggtaggctgatggcttagtcatcctataaagagcccagcatctgactgcacagctgggtctacctacagcatggagatggctatctgggaataatgggcactagaattggaggatcctgatgaaccacttcctggccccttgcttgtgccacctcccttcccgccaggtaaatattgcttagacacccagcttctgattaaagccacatgatggaacttgtcctaaggatgcaactgatggcccgtgtcagcttgttggagttaaaaaatatattttaatttgtttagctctctggggaaattatctgagcctgcatgtgataatcaactttcacatgagctttcaagagacctgaaatgatttgagcaacaaaatgagatttttaatctacataaatacaggagtcgtttgcctctctttttgtgtgtatgcgagaggaggggagcttaaaacaattctaattcattccttttcttctcccctaggacactcattagcaatggtaggaaaatggtcacaggagtggtaccttgcctcacattctcacacacattttccctttggactttaaacttcacatcaactcttaaggtgggggtgggcggtagcaagtgttgcttcccctttttatggaaaaaagtaggtctcagagaggttacgtgacatgcccaagttcatgtgctggtgggttgcagagtcagttctagagcccagttctttttggaaactggatcaatgctctttctacctcaccagctgtctcatattaatactagagatactaatgcaaaaacactaccataatagtatctgcaagagaacaaattcaagggaagatggatggatactggccgggcgccgtggctcaggactgtaatcccagcactttgggaggctgaggcgggcagatcacgaggtcaagagatcgagaccatcctggccaacctggtgagacccgtctctactaaaaatacaaaaattagccaggcgtggtggtgcgcacctgtagtcccagctactcgggaggctgaggcaggagaatcgcttgaacctgggaggcagaggttgcagtgagccaagatcatgacactgcacttcagcctcggcgacagagtgagactccatctcaaaaaacaaacaaacaaacaaacaaacaaaaagatggattgacactgcacctgcctgcatcagccaggctaagctgggttaagttgtggctacaccagatgtctatggcttcactggtttatgcaaagtcccctgtggggccaggtcactctccagggaagatctcatgacttccatgtcagcaggacttagggtgcactgaagagggaaagcagactgaagagctttgtcgaaagggtgtttaagtttggcagcccaaaaatgacagagaagttcatagccagtcacagcctgtgggctggctctaattgtgcagccctgcccgatgcacgggcggttgtgaaactgtgtcttccgagtgtgtaagaaggggagaagacccggaaatactggtgaccactagccatgagcaccacatggtctgcaggtctgagcggtcaaaagatctgttctgtggagcaggctcccctttaaccatgtccctgtcacagatcccgcggcaagcattcacaccacctggaattaatcgggaagaaagtcgcagtgtttagcagatatttcacagatataaactgtgcggtcttcctaagtctctgcacatgatcagctgaagattgggcttcttgtggtgcacataccattttcgtcattaaatccccaatgactcaccttgtcctgaaactgttaaagctccttagcaagactgaggcccatcctgatttgggccccgacaccctccccagtctcttctttcatggcacccctcctgtcatctgggtttgtgaagctcctttcagtcctctcaaaagagcgtttctctcttccccctctcgctctccgcacctgctgttccctccgctttgaggtatttcctcctcactcacgtccctctttgtccaggtctcaggaggcctgctcttgtatgtgagtccctagctagatggcaaaccccttggggtcagagacagggactcctggcagcacttgcccttaaaaacttatattcaggcggggggcggtgactcacacttgtaatcccagcactttgggaggcctaggcaggtggatcgcctgaggtcaggagcttgagaccagcctggccaacatggtgaaaccccatctctactaaaaatacaaaaaaaaattagccaggcgtggtggtgggcgcctggaatcccagctactcgggaggccgaggcaggagaatcgcttgaaccccagagggagaggttgcagtgagtcgagatcgtgccactgcactccagcctgggcgacagagcgagactctgtctcgaaaaaaagaaaaagcaaacaaacaaacagcccttacattcagcatagggcttagctaatacatggaagcaactgactactatgtgttcaataagcaaatgaatggtcgtgtgaatggataaatgaggtctgtgaagttgaatgcttgtctgggtgaggggacgtctcctggctcaccctcacctctgttggctgtgctgcaagctgtagtcaggatggtcattttccagctttgaccatgattgctcttgcttttggtgtcagcgcctacctgtatggtgccctccattcgtcagttgccttatatcccagcacgcttcctcaagagctgaagaaacgtcttacattttcatatgaaatcattttcaagcaaggtatagattcacataatacataattaatggtaaaatgctattagcattatgtacttaaattatttggctttaaggccaggcgcggtggctcacgcctgtaatcccagcactttgggaggccgaggcgggtggatcacctgaggtcgggagttggagaccggcctgaccaacatggagaaaccccgtctctactaaaaatacaaaattagctgggtgtggtggcgggcgcctgtaatcccagctactcgggaggctgaggcaggagaattgcttgaacccaggaggtggaggttgcggtgagccgagattgtgccactgcactccagcctgggcaacgagagcaaaactccatctcaaaaaaataataaaaataaaaataaattatttggctataatccccattggagttactgtttaatgggtagagagtttcagtctgagttgatgaaaacgctctggagatggatggtggcaacagttgcacaaaaatgtgaatgtacctaatgccactgagacccacacttcaaaatggttcaaggtacattgcttgagcctaggagtttgagaccaggctgggcgacagagtgagaccttgtctgtaaaagaaaaaaaaaggccgggtgcagtggctcatgcctgtaatcccagcactttgggaggcctaggcaggtggatcacctgaggtcaggagttcaagaccagcctggccaatgtggtgaaaccccgtctctactaaaaatacacaaattagctggacatggtggcgggcacctgtaatcccagctacttgggaggctaaggcaggagactctcctgaactcaggaggcggaggttgcagtgagccaagattgcaccactgcactccagcctgggtgacagagtgcaaaaaaaaaaaaaaaagaaaaagaaaaatatcagtcgggtgtggtggtgcacgtcgtggtcccagatactcaagaggctgctgacgtgggaggattacttgagccccgtagatggaggctgcagtaagccgtgatggtgccactgcactgcagcctgggcaacagatgagagagtaaaaaatggttcaaatggcaaattttatggatacttcgccacaataaaaataaatttctattaaagtacatatcattaattccacaaatgcaaatagaataccaatcaaaggaagtcctcagaacacagactgcacagtaaagtgtgggcctaactagaccacagcctgtttcatgtcaccaggcttagtggatgaccgcactgcaaggaaaattgctgagactgagtcatgttttggttctctggctgcttctattttttttttttttagatggagtttcattcttgttgcccaggatagagtgcagtggtgtgaacctccgcctcccaggttcaagcgattctcctgcctcagcctcccaagtagatgggattacaggcacccgccaccatgcctggctaatttttttgtatttttagtagagatggggcctcaccatgttggccaggttggtcttgaactcctgaccccaggtgatccgcctgcctcggtctcccaaagttctgggattacaggcatgagccaccgcgtccggcccctgggtgcttcttattttggaaaattcttccccaaatgagactaattttggctcagtagaaaaattctctcacctcttgtcccgaaggtgaaaatccacctcaatgattttcaatttttttttaatcatcatcggcctcttttattttttttctgatagaatgtgctttaagagatagttgtagcctgtttcctattcctgcatttataaagtaacaattcatttatccttgccagctgtctgcaagcttaaaatacctagacacatctcaccacccagtagtgtccttgactggcttggatggccagtttccctatactgatttggtacaattgctacattttatagaatacttaaatatgaatacaagtgtgatttctgtggggcttttgacaaaccagaactagttcaaggaccctcacaatcaccttcaagggacaaaaacctgcattttgtgtgtttcctggtgcgtttcctttaagagtcctggcgcctgggctgtccagcccgggtggagggactcccgagacctggtgatggatgctgtagtcaggagtgcatattggatctgttacacggtggtgatatacgatttcaacatttcagggttgatttggattttctgtactccctgcctggaattttcctgctgtgttgttttgtgctttactgttcaacaagaggaaaataaatctagaaacctgcttaaaaatagacatcctgttttcaattctctatcattaaaagatcttaaaagctagaatttagttctcttcccggtagaaggaaggagttgcgctaaggtcccttcttagaaattagctctagaaatcctaaaattctagctaaccaaccacagtgttcacgggcctaatatcccttacatttttcttgtctgacaggcccagagggctcactgtctgtgagctttcacggggttgttgctatcccccagggttgattgatctgtttattctaagcttgaggccagagctggaagggaggccgtttgttttgggcactgctgagaaaaacagactaatcacctaaataccaccttggggaatgaagttacttgaaaagaaactgaatggagcctgggcttttatttggaatgaggaggcaaacctgggaagctgcatgccgctgaatgatgatgaaaagcacaaagctactgaatgcctctggcttggccgccaaagagaattggtttctgtaagtgtcggagagggaagacccgcattccagagctgcacccctttcttcacatttccggtccctctcccccagctcctgcacaccctgatgctggaccaaggggcctgggcagaggtgggtgtgctgggcgggaaagtacgtcatggatgcctcaacttgccatggatggcaggttgacttccttcccagcaacttgcagatgttcagatgcgcagagttaaggtctaaaacaagaaaagtttgctaacgtagagtggccgctgggtcttatctttccgtcttcaatggccttgaaaaatatggggcacgcatggggatttcacactcttaacaagctaatgtctctaacactacaggttacacttcacctgatttccaggttagtgcagcgcctgacctctctccagaggcaccctcgtttagaagcatagatgatgcaaaaacatggtttctcttctcagttcagattgcctctgttgcaaggactgagaactctgaggagatctaggagatccctaagtatattaggttttaattctgggtcaaatcagcaaatgtttattaagtacacacaacagacagggcactgtaagacaaaacaaatcaatcagtcaacgtcaactcttgtcattgcttggggggtaaaggcaatacaaggaatgactggcaaatacaggtgtgaattccacttaccctcagcaagacgagggaagaagaagattctggaaagggagaattctgccagcaccaacctgatcatccttctgggcatggccaaatgcctccatttttcctctgaggggcttctttgccctgaggaatatacaagttgatagggctacttgccttcttgctcattaatatctgcttggctccggatctgcaggtagagcagtgctggaattatcccagagctgtgttgtgacctctggatgctagcctttccaagcagggactttgctgcgactccctaagttcatagggaaagcagcaaggatgagttcgggagactctggcatatgcatcagagttccagagtgaaaggtggctctgaaaactttgcaaactgtacataactcaattccccaggctgctgtgtgtccgtcatccctgaaatttcatgaggccagagtaggtcaacaggggctaatgagacaagatctaactaaacagagtaaagagtttctcggtcacaagggaaacttttactatttgaaatcagcctgagccaagattgatgaggaaaaaaaaacaaaaaccaaaatctactgcattttactcctatttaggaagaagtaaacttttgtaaacaggaagaacacagggatatttgctcttagctagaatggggcaaattggcaacagttttgggtgcctacggctttgggtttgatggagtcaacctgccactaaggaaatagacccaaggaggttaaactcagtagagagctatgggtattcctttcctttaagttacagctcccaggaaagcaaaacacaagctgaacaaacattatacaagccatgtatatgtgtagcatgtgtccagatccaattcacttatttgctcacgcttctaggaactccatccttgtgcttttatctcctgggctctctgactttgagacttttcacagctgtcatcatttagcataaataacagcctgcggaagagtgggtgacaatgtggcattttgctgggccacttcttgctcagcatttgtcgtggagtcttctgccattggccatgtgccaggcctgacaaacagccatcaacacaacttgtcaccaagtgattttgaaaacttattgttgaggtgacttcattcttacatctttcgtgcttggcaaagtaattactacgccaagttttttttttttttaatcaaaataaaacactgattaaatgttttcctgtatctggattacaaactattccgtgatctccaaactttgtcctctcgtgtgtgtgtgcatctcacacaatctctgtccttcttggaaaaatgtctccattaattactggggatgaaagttgattaaaattgtaggtcatttcccagggaggttttatgtgaataactttagtactgtgatgcactacttatgaaatctctggtctctttctaaaatcaggttggagaagaagagactgtgcatgacagtgcagccatgtggcttggagactatgtgagtggaagcattttgaggatacgatttctgagtccatgctatttctctgttgtagcttagctgtggattccttacgtgcgaatgatttgggagtataagaacacagactcagtgtcatcattttgtctaccattaccctttcctttagaaaatctgtttgtgtcattcatttagaatgttgccgttaacaaagtattttatgtatactattttatttggacattatgatggtccacgctgtgaggtcagccagctattgttcatatttgttccagatgagagactggaggttcagagcagcaatgtgccctgcacacctccacacagttcacacagtgctcagaacagcaatgtgccgtgcacaccacacaccctgttcagtgcagaggcagcaggcaggaccccaggacttctgagtcctgatccaaagctacttcctcaaaatccctttactactttattattattattttttaaatagactttttaaaaagcagttttcagcttatagaaaaaaagtgaatgaaaagtacagaattcccatgtgccgcctctcgttctcctcagtttcccctgttattagcatcttgccttagtgtgctacgtttgtttcaactgatgacccaatattgatacgttattgttaactaaagtttatagtttatgttagggttcactctttgtcttgtacattgtatgagttttgacaaatgaataaagacccagtgatcatgatcaagtgtgatttccccaaagtgagatgtgttgtccttcacagagcacacttagtgcagtggcggtcaatctaactggttttttttgttgttgtttttgttttgttttatttatttatttattttggtggcttagtctcctctgtcacccaggctggagtgcaatggtgtgatcttggctcactgcaacctccgcctcccaagttcaagcaattctcctgcctcagccttctgagtagctgggattacagacacacgccaccatgcccggctaatatttgtatttttagtagagatggggtttcattgtatcggtcaggctggtcttgaactcttgatttcaggtgatctccccgcgtcgtcctcccaaagtgctgggattacaggcgtaagccaccgtacctggcctgtgtttttcaaatgtaaacaaaaggccatcaagcagtgacagttcatctcctgacttcatttttattgtcacaaaagtgttctggttagaaagaaaaaaaatcacatatccaccattacagtatcacacagagtcgtttcactaccctaaagccccctgttctctctctattcatccttcccaccatccaccctcatccctggcagccagtggtctttttctgtctgcacagttgtgccttttctagaatgtcagatagttgtaaccatgtactgtgcctttaccaccatgttgagccttgatgtgtttccttcgttggttttatcaataacaacgaacattcactggtttctttccatcgaagttacattttttcatgaaggtaaactcttaaacaagtgtctctttttgtcaccctctcctaggcctattcttgctattggttagaatgtggccaatagattcacctcatggtagcaatgtccttgctgaatataacaaatctgatggttgtcatctaccaagaattttgtttctctgaggaaaatcagcaaaactctcatttcagttctagtgtagcctagccatgctaggctgttttgtaaatgatgactattaggagatatttgtatccattgagatggagaacaccgaagcttcgaaggaggaaacagcttgcccaagtaaagaccattaggagaacacaaaataaccaccaaggcttccttattcccatttgagatgctgctgattgagccgcaattggccagtgctctaaaaccgaggcctggaaaggacaggccatgccagttcgctcagccattcaacccagcagccctgactattgtagccaaggtgatggacttgattcccatagaaagcagcatcaccttggagctcacctttaactcctggaggctggcagggcccctgtggccacaactagactgtgagaggaaccaagaaagtacgttgagatcttggaaccaacccaaatgcccatcaatgatagactggataaagaaaatgtggcacatatacaccatggaatactatgcagccatagaaaagaatgagttcatgttctttgcagggacatggatgaagctggaaaccatcattctcaacaaactaacacaggaacaaaaaaaccaaacaccgcatgttctcgctcataagtaggagttgaacaatgagaacacatggacacagggaggagaacatcacacaccggggcctgtgggggatgggggataaggggagggagagcattaggacaaatacctaatgcatgcggggcttaaaacctagatgacgggttgataggtgcagcaaaccaccatggcacatgtatacctatgtaacaaacctgcatgttctgcacatgtatctgagaacttacagtataataaataaataaataaaaatcacacacaaaaaggaaagtacatttagatctcatctccctctcaccccaaatccaagaacagaacaactcagacacatgtcctacagatcagcacacaatttttttgtgattgaagaaacgaatactaacattggttgatggaagagacagtactctaaagtcagcatgataatggacagaagaacaaatgatgcatctagtaactgatgtttaacaactgattacctgtttgtatggcatatttaaacattattgtgttttctgctgtttgggtagtggttgtttataattattaaagatgccccgagtgacaaagagacgaaggatcatgaacatcttaaaacacttcttgctttttaacaagggcagagcaaagttgttaaaaaggtaaccgagggtcagataaccaatgattcattgatgatgaatgctcattcttctagtgccaatgtggtaaaatgtggatgtttttaaccttgtaagttaggtggcagcatagtctagtagaaaacacctctagctcatggatgaacgtttctccaatttgctcccaagtctcttattgatactatatttgggtgaccctgggcaagtcctattgatagttggctttgacttaggacaaatgaggttacacagactgagagttttgtgttggacttcaagtacgcttctagactaaaagcattatgccattaatatttatgttatatagcttgtatataagtatctctattcctattatcttattaatgttcacatgtatggatgtgtatacacgcatggatttgtgtagatatgtgtggttgtgacgtatgtattttgtgtcttacagttttgcaaagctcttttgcagacattacctcatttgatctttcaacagtctctcagaagggggatgtccttgctttcattttataaatgtggttgagagaggttatggttcctgaaacttgatacaattaccaagtttctgaaatataggaaaaataacttcattgtagacaaaggtcacaatttcaagaggctttgtaacgaaattatgaacaagtttggaaaaactgcaagaaattcattgaacaaaattaagaagatcagccttttgagaaaggtctctcttgatggcaagaccgagcagcatctttcactgagccacagatttgtatggcggattggatttctggggaaggttctcctcagaacagtgcccttcagtccaccggaaagtgccactccaatttttagttaagaaaggctctgaaaagacccactctcaaaggtaccacctgttcatgtagtcattaatttgttaactaattaatcgacccatctatttattcgcttattcactcaaaagcatttaccaagctcctactgtgtgtcctcaaggacatccagctgtacgggaataaacaggggaagcatatggtggacttgaaggtggagttggtgtggaccctgccgtgggtggatggaggtggaggtggggtggtcctgccatgggtggatggaggtggaggtggggtagacccttatgtgggtggtgggaggtggaggtggggtgggccctgccatgggtggtgagaggtagagttggtgtggactctgccaggggtggttggaggtggaggtggggtggaccctgatgtgggtggttggaggtggaggtggggtgggccctgccatgggtggtgagaggtagagttggtgtggactctgccaggggtggttggaggtggaggtggggtggaccctgatgtgggtgattggaggtggaggtggggtgggctctgccatgcatggttggaggtggagttgatgtgggttctgcacagcttaggctgagcaggaagtgtattttcagacctggaatagactccctatggtggacagagttgctggaaaaaatatcagaatatattgtttaggacatctcatcttcaagacatagattccccttcttatggaattttgagatgtcctagctggaggaagaagaattctttccatggaaacaataaacagtcaaaatgtttactatgaaattcatggaaatgctctgccagaggctcgggaatctctgcagagaacattttctgtactgcaggatgacagaggctgtcgagaataaaatgaagctgagtgcttgtggttgggattccttctttttcctcttttattgtttctccttagctttgtgcccaggtcatttgtctatcttccttcccttgaaatccctcctgctttggggccctgcactgcctctggagcatccagttctgagattccaatcacagggccaggcatgaaacacggccatccctcaggcacacggctgctgggatatggcaagcttgttaacacggcaggacaacccaagatgccatgttcctaaagaaaatgggggccgggcacggtggctcatgcctgtaatcccagcactctgggaggtcgaggtgggcggattacctgaggtcaggagttcgagaccagcctggccaacatggtgaaatcccgtctctacttaaaatacaaaaattagccaggtgtggtggcatgcacctgtaatcccacctactcaggaggctgaggcaggagaatcgcttgaacccaggaggcggagcttgcagtgagtcaagatcacgccactgcactccagcctggacgacaaagccagaccttgtctcaaaaaaaaaaaaaaaaagaaaaaaagaaaaaagaaagaaaatgatattcattgcccacctccttacacacatacccagagtggagttaatcctttccatatctgtgtacccatgcttctttatatatattaagttgaaccatatgaaattgccaggattcacgatcttgacctgcaaaaataggcagtttcatgtagttgcacctgctatgtgtggcatttgttctcactttcaccgtgagcgtcatttgttgactttagcttaaaaccaaccttattccactgcatgccaccttgtcctcagagaattcataaagacaggcttaagaatccatttcagctgggcgcggtggctcacgccagtaatcccagcactttggaaagccgaggcaggcagatcacctgaggtctgagttcgagaccagcctgaccaacatggtgaaaccccgtctctactacaagtacaaaattagcgggcgtggtggtgcatgcctgtaatcccagctactcaggaggctgaggcaggagaatcgcttgaacccaggaggcagaggttgcggtgagccaagatcgcatcgttgcactccagcctgggcaacaagagtgagactccatttaaaaaaaaaaggaaaaaaaaagaatccatttcatccagccttctgattctaggaataggaacgtcaattcaatccaatgaatcctgggacagcatttggtgtgccaggtagagcgtgtgtggcggagggggggtggtattgtttgtgacgtaggttttctgattggaactactgttgcaggcttgaccatcacctcccactactgcgtgtgaggctaaatgctgctccctcgcttattgctaaatggagagaatacgagggagacaatggggaacgtgaaagcaacaacattgtcaactggatttgatgcagggcagtgggcagggactcagaactccactccccctactcagacgggcaatcatgtcacagtcaagatgagaaatacccatcgagatttgagtgcatgtgactcttctaaaagtaaggcgtgttcttcacagcgcacactgagcaccgttgcagtcaatctaactgatgtttttcaaatgtaaaccaaaggcctcaagcagccacagtttatctcctgacttcctttttattgtcacaaggtgttctgtttagaaagaaaacaagccgttagaatattccaacagaaacagcattaacatgatttactaggtgggttatttagggttactcagccaagaaatggcatttctggacagtggtagatttgttcagcctctcacaaattgagggaagtggctttatttcttcccacccagctagttcccctgtcctcagcccagagattcaaatgccaacggctgccaagtttaccccaggaccgccaggcaaaggttccggaccactgtttgttttccatttctgtggcctcatcatgctcagaaatgctgacttctacgaagagcccagaaaagttcagatgtgtgccaaggctttggttgtaggcttggcacaaggagcagcagctggtaaggaccaggagacagcccggcctcctccatggtgcctgcctctcatagaagcagtcaggaggacaagcttttggtttccgcagacttagcagtcattcctgtgttcctaagaatcatactcgggattttaaaaattcatgtatttagttataactgtgaaatatcatagaaccgggaggtgatgtccaagtcatctggccagtccagtttctccttttgcacatcaaggatcaggccccaagaggccaagggattagtgggaacccttcttcttgccttcacatccatctctcagtctttgtttcctatcgcttacagttgtttttcacttctctcttcttttcctactccttaccatctgaagaactgaaaaaattattccaggttcagcaatgttggaaccaagttttgtaaacggacctaagccttttacaatctgggggaccttctttaggaaatggaacacagatgaccatgtatacatgttgctggcgcccctcctatggctttggaaggcacccaggcaggtgaggagccctgaatctcgagcttcctttagctttacagtgattcagtctctggttaggaccattacgatttctttctttatttcccccttacttatgccctatatgaaatgaaacagatgtgagtgtttgaatcaaaaagacttccctgatgtagtggtctcattttagatgctcagagcatagaataagtggcagcagaccttacttgttccatctggtttttgcatagactgctcgagttgtttttcctttctcatttgttttcctcccttgcattttggtctgtctgctccccaaacttttagctatgaaacatctctagaattcgacatctgtcagaggaggcagcggaagttctttctctgggatccatgagtcctgactcccctgatactgtgtgctgagagagggttttgttttcataattatgacaattcccatgtattgaatgcttcctacatgccagatatttccagagctctgtgtccctggaagagtcaagaaccactgtttatagcattgagaaggaaagagtctagcctctgacatcttttcttctaaaatgactgcaacacatggacatatttttagctattttttccatgaaatgtattttctaatgacttaagacattagatcaatgggaaaagagagcgtttatgtttttatgaaggtaatattttcagtggcaaaatgagctttatcagacctcaggaacttgtgacttccagaaaacaagaatggttctgacctgggatcgtgagaatgtctttatcctagacatgccaatccacacttagccagtgtgaagggaagagtctgcacttagccagcatgaagggaagagtggcagagaggggactatctgagtcctgtcacggcctgtcaggagagtgacaggtgagggtgggcaggaggtctccgaatgaactgctttgctggtaggctgtgtttctgtgtttagctgaggagagggcgggagagagacccaggctgggaggtgggggtgcctgagcctcctgtgccatttggagcatgtcattatgggggagtcacttattttgcaggggggaggggggtcccaggcctaacatttgtaaaattagggaatatgctgggactaagggttcgttgtggcctgcagtctgtttctatttatttattcatactcataaacatagatctctaatataggccaagattttgaaagaattagtagttgcaatttcaccttgtaagactttctcttttaggtaccttatattagttttacttgttagttacccagatatgtcaagcatagagctaaactgaatgcctgtgtatttgctgtaagcattgcctgccttaattcatgctgtgatgtggtgtggtttgcggaattcctagagtggccagtgcaccatgaccaccaactgacactaggctccttctagcaaagaccagggaatgtggtgatgcctttagttggtttataaaggactagcacccatgagcaggaaagggcacgacactcattttggcactgtgaccgccctcctggtcacaacgcctggtctccacactggcagggctgttcttttacaaggagggacacagggtttgagacaggtccagttgtcgctcatcgagaactcgtgaagacagacaggggagcagtgaccctggaaatcagctgggagagtccattcatccacgtagtgagaccgtgtctctgttgcggttcttatgtccacccacattctgtgattcattgtgtgttcttattagtatattataatctattagagggtatttttctctaattttctgtcattttgtagttctgtgcaaaaggcatgaaattgtggattaaaatgagggcatctggatattgctagaaaacaccagctgaattcacaggctcgcaaagaggtcgtatgtttggaaagctttagccattgctgtggttttctattttctggaggtggggacaggataggaggtggaccctagtccctagagactatttccaaagtgtgtttcccagttgggatcaattattgtttgttgacttggtctcaggattgggctgcgttctaactcgagaattgccaggcctcagggaagtgtctgcttttcagggaagtccgcccatcatctgccactaacacaagtcagagggccacggccatcaccagtgctgcaagtgggaagggcagagtggacttacataaacaccgtggcattcctgcctgcagctccggagctccaccctcatcgccactatctctccttggacttgaaccacaggcagatgaggccccaggaattagttgcacctgagagtctggaagtatagcccaaccctccatgtgtggaaggacagggtccagacccctcccgtcctgcttctgcagtggctgaatggctggaggccgccatgacacccctcatacacattcactcactcaccattcactcccactctcctgcccctgcccctttccaggctcccaactctctctctcatgtgtaccttgaaggtttgctagatgatatcatagtagacgctaacgaaatcgttgttaaataaacaatagagtgacatgtatacaatcaataagaccaaaaaaggtgtttaaaaaaatcttttatttttattttttaagagacaggcctcactccgttgtacaggctggagtgcagtggcacaatcactgttcactgcagccttgaactcctaggctcaaattatcctcctcccttagcctcccaagtagctgtgactacagctaccgtgtctggctaattgtgaaattttttggtaaagacagggtcttgctatgttgcccaggctgatcttgaacctctgggctcaaccgatctgaagtgcaaagattacaggagtgagccactgtgcctggcccccaaaaaggattttaatgttaggagctgagttatctgagcagacacagtccactgtctggtcccaaggctccatgtagaattgtctgcttttagcacacaggcccacctgggctggcctgaggaggaaattcaggagtgggagatgccatcttttcctagccaggaggggctgcagagcgtgtgggctgagactcttggggagggggtgtgaggggcagtcacatggcctcatgtgaaattctccataaagaatcccaggcagaaggccatggacaggcaggctggtgcaccgcatgtgtgaagatgagcagcagggacaacgggtgggtggggggagggagtgggggagggagcgggaggactagagggagtgggaggactagggaaagtggaagagggagtggggggagagtggggaaagagtgggggagggagtggggacggagtggggggactgggggaagtgggagagggagtggagggagagtgggggagggagtggagggagagtgggggagggaggagggagggagtgggggagggagagtgggggagggagtaggggggtaatagggggacagtcgggggagagtcggggagggagtgggggaggaaataggggggtaatgggggaagagccgggggagagtcggggagggagtgggggagggagtggtggagggattgggggagggaatagcggggtaatggggggagagtcgggggagagtcggggagggagtgggggtgtcggaggatgtctgatatattcactccttcctttaatgatttcaaatgaagtgctttttttaaaaggcaggctcaccaatgaggtgcgggaagtccccgcagagagagagcccacgtagtaagtaaggaacgggggcggttagagattctggagaggccggatggaaaatgcacacacggtgagcagaaaccatgatcctgagacgctgatgtccaggagggagcctcagagcaggaacgcagccgcggcagggggcggtgggagtctgcggtatgacgtagggtacgaagggcctgggggtggcagagcagagcctgctgcggaggcacaggcttctcattccgcgcgagtgaccgagacatggatcgcgctcttgccggaggagggtgcacgtgcggaccagaggcttcccagcgccacggtgccaagttgtgggggtgctgagccaggagcttcagaagagcctcacaagcagggcacaagctgagaaaaatgacagctcacgacactctttcttcatatttaaaccagaggaccaaacaactcaaggtgctcttaagaaaagcccgcagtcgtccaagactttaaatgaaaacgcggatctgaaaatgggtgaaggaaatttgaggtacccacatttgccagaacatcgcgtccaccctgaagtaaggtgctacctgtggtggacacctttgtgacacttcgtctctaagtgagataggatttccagggagcgtgggactgtccctggattggtggctgctgaggaaggatttattttccatggagctctagttggctgtgagattttaggtcaacaactggctacagatgatagatggagagatagcccctgtacaatattcactgtggactattattatatagtgcatagtaataagacaatgtacaaaatgtgatagcgtacacttctttcgtatgtagaaaatgcagggatttttaaaaagtgagatttactttggtctgaagtcctcatcaggaggccaggcgtggtggctcaggcctgtaatcccagcactttgggaggcgaggtgggcagatcacttgaggtcaggagttcgagactagcctggccaacatggcaaaaccccatctctactataaatacaaaaatcagccgggcgtggtggtgggtgcctgtagtctcagctagtcgggaggctgaggcaggagaatcacttgaatgcaggaaatagagattgcagtgagccaagatggcaccactgcattccagctggggcgacagaacaagactctgtctcgaaataaataaatagcaataaaaaatgaagtcctcatcaggaaatgcagtaagcagatggttatgaactggattacgctgctgcagaccgtcttctaagaccatttgtgtatcagtggttggaggagtgtgtaggccaacctctctttgaactgttgtaaattcattcaggcagatgactaaaaatgacataacccccacccgtctcccaagggggcaggtgagaggtgggtatagcatttcaggtcagaatgggggttctcacaattcatcagtgttcgctccccaaatctggatttacagtctgaaatgttctttctttagcctctgaatgccagaagtaagcacttccttttaatttttatttttccctagcaaattctttagtgagcaagcttttgtctgatctaacctttctctcccctgttggtttcagcctccacctttgtcttgcctttccccccaccacttactcccacccccactgctgacatgttgtgagtcgtctcctggaagccacagccctgctggttttcactcagggtggtgggtcccttatgtgtgtcatgctttgcacaagacagcgaggagtgctggctggtttgctggcgcccagcactatgacctggcttccgttcatggctcataagtttccagtctttggggtatctgtggcttttatgtcatctcactgcctctcctcggcacagggactggctttgctgtcgatggcagacttaaggcaagtgcagaagggaagaggactgctcagaaacatctcctggagacactgtattttcaatgggtctctccaaatccagcagaaaaagggcaaaatgtagggaaggggtgccaacatgaagccatcatggtggtgccaaggatttattgggcagcaagaatcaaaggactggtgggaaagaagaaatcagagtcagcatgcaggagaaaagcagaacggagacagtgtggctggattgatagaatactggaaggcccaacagatagtcccacacccatgttcacagcacattagccacgattagccaaaagagggaagcaacaccagggcctgtcaccgtataaatggataaacgagatgtggtctctacatacaatagaatgttgtttcagccgtaaaaaggaatgaaattcggacacacgctacagcctggatgaaccttgaagacatgatgttaagtcgaatcagccacagtcacaaaagcgcaaatactgtgtgacgccacttaggtgaggcacctagagcagtgaaattcatagagacaaaccagacgaagtagagtggtggtttccaggggctggcgggagaatgggcagtgagtgtttagtgggtgcggagtttcagtttgggaagatgcagagcgttctggaggtgggcggtggtgacggttacacagtcatgtgaatgtacttaatgccatggaactgtacacttaaaaatgattaaaatggtaaatttatgttacatttttacacacacgtgtgtgtgcacatgcttgtaactctccattttttatcttttgatcctaaccttgaacctctccagagccttaacttaaatatctcctcaggccgggtgtggtggctcatacctgtaatcccagcacttcgggaggccgatgccagcggatcacttggggtcaggagtttgagaccagcctggccaacatgctgaaaccccatctctactaaaaatacaaaaattagccaggcatggtggtgggcgcctgtaatgccagctactcgggaggctgaggcacgagaattgcttgaacttgggaggcggaggttgcagtgagctgagatccgcaccactgcactccagcctgggcgacggagtgagactccgtgtcaaaaaaaaaaaaatctcctctacgagtggatgtcgggtgaggtgggctggggtgggcgatttatttggggcttagaaggaagcagaaaagttcagtcatcttctgttacccatacagcaaggtacaagaaacaatgtgtgtgggagcagcaatggcctctctctctttttatttttcagaggaagtggtggtaattccttttagtgtcttgcattctacatgcagctttaaaatctacactgacatgtttcaagcaatctcataggtggctactaacttaatttgtgttttgctcattcctaatgcgcaggaatgttatgaaaatgttcgttcctggtgttaactaactctgttcagtccttgtatcctggttgattaatggcaaggtaattgcccttcatttctttgccttcaaagcagtgccacctaggtctttactgccctcaaaacagatgtcttctgcaaagagtgaaattccgatcagtcagtccctcctcataaaacatgtaggtgagaggccacttggatgcacaggaaggttgcaaagccagctgccctgcaggagccttcagaagagtgacctccatctggggtcagaccccggctccctggagggtcagcagaggagaaggggcatcttctggagaggagtatgggtgcggggcagacaaaggaacagaaacagaaacaatcaagaatgaggagtgagcctgcagtgcaccttagagtgtgtgtctattttctgccaagggtgagatgttctgagcattttctctatgtctacctccgtcaagtactttccataactgctgtcatgtcagcctcctactaaccctgtacagtaggtatgactgccgttccattttcatagatgagaccgaagggtaaagagggtagataactggaccgagtctacacatgtattaggtgtcggagttgggatttgaacccaggtctcatgaccttaagttgggcgagaactggatgtaatctggagtggccagcatgttccgctggggctgtgatttcagttatctgtaagaaagcatgaggcagctaaaaccactgaggcccagcaccagtgcagcatctctgatttccttttgccctgcttgtgtctggggacttcagactgtctgtctgctctctggattctgtggtccaactggcacttctgtgctaaaaatgaaggcataattgaggcatcacggaccccagatgggccctgcagcctggggcaaggctcagctgacctcatggcacccgtctcagtctaatccagtcttggattgccacttcccctttttggctttgccttgtcctcccctggcctggcatcccaggctcctgcttgtggtttacctgtgtgacacacacagacacatatacgcactctagtgccaaacatgacagaccaggaggttggttttcttagcctgagaatctgcatcatctgaatgaggtagaatctggaggagtctggactgtgagggaggaagcttgggaaggagtcaggatgggatgtgctgcccatcaacgcctgcagggaaagaagagtcccacgcagggaaaggagagtcccacgcgggaaaaggagagtgccacgcggggaaaggagagtcccacgaggggaaaggagagtcccacgaggggaaaggggggtcccacgcggggaaagaagggtcccacgcggggaaagaagggtcccacgtggggaaagaagagtcccacgaggggaaaggagggtcccacgcagggagagtcccacgcagggaaaggagagtcccacgcagggaaaggaaggtcccacgcagggaaagaagagccccacgcggagaaggaggagtcccacgaagggaaaggagggtcccacgaagggaaaggagggtcccacgcagggaaagaagagtcccacgcggggagagccccatgcagggaaagagggtcccacgcagggaaaggagagtcccacgcagggaaaggagggtcccacgcagggaaaggagagtcccacgcagggagagtcccacgcagggaaaggagggtcccacgcagggaaaggagagtcccacgcagggaaaggagggtcccacgcagggaaaggagggtcccacgcagggaaagaagagtcccacgcagggagagtcccatgcagggaaagaaggtcccacgcagggaaaggagagtcccacgcagggattgctgttccactctgcatagccgctgggctttctgctgcacggatgccatctagaagaagcaccatccactgttctcagaaagaagagagaggaaggagacaggagtgcgtagagtgagtgggccatcagaaaaaggactgctctggggatgcaggagacccgcttgtaggatttaggggcaccgtgcaagacaggggtcatggtatgcgggtgcctccgactggcggctgcgtggtggatctggccacttggtgaaggtcgcagtgaccttgatctgctctggggagggatgctgttttgcctttcttcacgcacgtggaatcaggactagctggactggcaggaaaaggttctctctggaataatggtttgcttctctgcaggctcgtgcggcggctcgtgcggagccctgtgagcactcattcttgggagagcacctgaagccgcctccaggtttagtcatttcctgctttttcctatacataccttccgtatcaacatgctttttgaccttcctcacctgaatacatctgataccctatgaattcttacctttctttttccaaagtggccaggaactgaaaatgcaacttcattaaactggaaagactggctctttgctaattagtccatttgaaatgaaactaggctaggatttttggttcacctcccagatcacaggaatgtattgcctcattaacagttgaagaagcagttttaaatgatccaagaacaagctgaccacttggattcctgggtagtcggctgggcctcctgtctttctgcaggtttgtgacttacctttgcttccatgggaagaaaggaggcgggaaatgaggtacaaagagaaaattggagtgagtgggcattttggtttatcaagtagaagcaattctgtgtgtatgtttgggaggatgtggagagcatttagaagttttatttatttatttatttatttatttatttatttatttatctatttatttatttttgagaaagtcttgccctgtcacccaggctggagtacagtagtgtgatctcggctcactgcaacctctacctcctgggttcaagtgatcctcctgcttcagcctcccaagtagctgggattacaggcacccccaaccatacctggctaatttttgtattttaagtaggggtggcgggggtcgggggttcaccacattggccaggctggtctcgaactcctgacttcaagtgatccatccacctcggcctcccaaagtgctgggattacatgtgtgagccaccacgcctggccattcatttagcctggtgacctagaagtacttaggaaatgtgtgtgtgtgtgtgtgtgtgtgtgtgtgtgtgtgtgcacccgtgtatgagtatatgtgttttggttttccaatctttggttcacgaatgtagtccatattcttagaactgactcacatataggaattcaataaatatttattgaattaataaataaatgactatggtgtgtgtgtttataggtgcacacacaaacacacacacagagtaacatctcacccataagtcatttatcgagcaaccataagtatttaaaataaatgacaaattagaaagtccagaagaccatgcagtggctgcataaaggtgacaaagctcatgcttgtgtttctttaaaagaaacttatcacccttcgcagccaggtctcctttagatagcgtgcttggccgggagcagatcagaaatggcaaactaaagataaagacaatcacaaaggcaaaaccaacaaagcgacagctaacagcttgacaggaagagaggggacagaaagcagacacagagtctctaagcacagccgtctggtttggggcaaacaactttttgcactttaccgtgcctgtggaaactatgtcatgcggcatggaatgaaattaattaacattcgtagtagacgctgaatcatcaaaagcttgaattatatctcataactttgtaggaagatgaagttactctagcaagattccttcaaaatggtttacttgtttcttaaagagtacaggcttccattatgtacaccaggaggcagaaaactgtggtcagcagaccaaagccagcctgctgcttgtttttgtaaataaagttttattggaaacaaccatgctcattcatttacgtgtttctgatggcaacttcctccttcccctcagcagaactgagtagttgagacagaaaccatatggcctgcagagccaaaaatacttaatggttatttatagcagaagtttgccagtccccaatccagatgttgggttcctcttgaatgttggtttgtgcttatgtatacatctgattcacttgcacgcattaccaagtgatccatatacacgagtgtgaacacatacgcatttctgtgtggtagtaagcacaactaagtgtgagcaccacattctcagacatagctctagaagagagtttctaagaaattagctctgagtcttttctgcttcagtcagctgatggcatggagcagtatgttgtaacctctgacccgaagggcaaaggccttctggaggaagtgtacacccctcagaagcctccctgtacattcaccatccccaaaatagctccttgagtagaggtgcatcgatcacccccaaagcttacataagatcctagcagtcagaaggattcagtgattaggtatcccagactacatagggtcttgtgggatatttcattggtactagaagttgactgcaatggcaagaaaggtatgcttcatagggtagaattttgcttttagggttttttttttttttgagacgtaatctcgctctgtccaggttggagtgcagtagtgctatctcggctcactgccacctccgtgtcctgggttcaagtgattctcctgcctcagcctcctgagtagctaggattacaggcctgtgccaccacgcctggctaatttttttgtatttttagtagagacggggtttcaccatgttggtcaggctggtctcgagctccttacctcgtgatccacctgcctcagcctcccaaagtgctggaattacaggcatgagccaccgcacccggccttttaggctattcttgtggcctttgtcactgacttaatggataaagtttcttctgctaaggcggccatgttggtttattattctgtacggatgtggctgataccacattagtgtgagctttcactagtgctcactttgatagcctccttgcacagcctagctaatatatgtcactggactccattaattttatagtgtcagtagcccagaactcattaaggaagacaagtttctgagattgtagattcctatgggtaaaatatgtatattatcataaaataggtactaaaacgtgatttggatttgggatgtggaagtaagtgccattttattattgagatattcatataccataaaattgacgttttaaagtaatttttagtatagtcacaaaatcatgaatatatattttcaccttgttttaaatataagaagattggttcattttgaagaattctgtgtgacccatatcaaagtagctgttgcagttgtgtagagattcacacatgtatgctctgtcaagatttaccagttggcatgtgtgccataggatttactgagtgtggattatgacagtcctaggtcccttgattttattttatatacatatcaaattgctcttccccattgggccgtgttggagaacaccagggcccagggcccaagcctctagcctaccccaggcccaggggtttgaacaacctccctaccttctggaaacccatttccccccaatactggctggaaggtatgaggagtcgtctttcttactgtccttatcactacaggaaacagggaaagcataagaaaaatgacaaaatgttccagctgagctagagtctcattggagggtacaattgtctctgagtatcagtggaagagtgcctccaggactcctacagaaactaaaatccacaaatgctcaagtccctggtataaaatgtcatggtatttgcgtataacccaggtacgtcctccggtatatctgaaatgatgcctagattacctataatacctaatacaatataaatgctatataaatagttgttattctgtattgtttgaggaataatgacaaggaaaaaaactctgtacgtgttaagtacagacgcaaccatccttttttttttttctgaatacttttaatccatggttgtttgaatccataaatgtggaacccacggatacagatggctgagtatgtactaacatataaatagggctagccttgcttttctgcagcccctgtccctaacatcttattctaagtggccctgggcaaagtgaccattcatttattcactcattcatttgtaggccctactgagagcctacgatgtatacggcaccatgtaccaggccctgagaacacagaggtaagatagacagggtcctgctttcatcgggtttatattccaatgaagataagaggcattcaacaactctttatctaatgagttgtacagcaacccttgtgatatgtgcacttaaagaaatgtgcaggggttttggatagaaaggctcaatgtggagacagacttggtctggaggcggggcagcttctctgagggtgcgacgtttcagccacgatctaagggagggaacagggaaatgcactgcggtcatccaggtgagaaatgatggtggcctcagtgcccaaagtggggacgtcagtggatgcagacagtggatttgagacgtatttaggagatggaattgactagcatcattttattgacacttttcatttctacagtttgagtccatcctcccatcctcctttcccaatcccagtgcctcagatgttctcgtttttcccttggggtgagtctatactgaagccagatggtttcactcaaacccattcagtgctccagagtcaagtgctggtcatcgcaggggagctccggagctgcgtctgtaatgttagtgaccctgatttctaaagggaagtcttcttcagtctgtttctgagattattcctgggagctttaactggaaaagccaagggcttaaaaagatgcagtttttttttttttttttttttttttttttttttttgagacactgtcttgctttgtcacccaggctagcctgcagtggcacagtatggctcaccacagcctcaacctcccagattccagagatcctcccatttcagcctccagagtagctgtggctacaggcacacaccaccactctcagctaattttttaaaaatttttgtagagacaagatctcactaggttgcccgggctggtctcaaactcctgggctcaagtgatcctccccccttggcgtcccaaagtgctgggattccaggagtgagccactgggcccagcacggtgcagtcttcagagaaggtgaactctctgggcacctagagaaacttgtagggaaacaaaagcttgtttataaacttggttcaacacaggagactatgttctccacattgaaaagttccttcatcttttttaaagcatctaaatgatctgtgtctcacttcctaagcaggctggtgggcagggagggtcaccagttggggcagagctcagagggaggtgcacagctgtgcagtgtctaagctcctgcgtctcctgtcacttggttcccgtggcaccatctacgcccatctccctcccccttaagggttagcatgacattgtatcacagggatgttgattttcttttcacttcagttctggattttcaaattctcagaccacataccaagttgaaagcaatcctttgtttcctcttgaaccgtaaaccagaaattgtgcttgggaaaccataccaggtgactaactggaaaacatccccaaaccttgttagtctttggccgtagacatttaattctgagccctggatggatggtgatattaaatacagattgtgcgcacattagtagtagaatgtacccctgaccaatttttcacacatttaaccaagtaaatggcttcttgccttcagtgagtttttatttcaagaccagcaaccattgcaccaagatgaagaagtgagccgcgtggttttctccatccaggggtgcagaaagaaaagtgcagagacagtcttcagtgtttttatataaattcacttttgcaaaaagtatgttgctgtgtaattaagagtgttaatgatgctgcctaaagcatctagggagagcagtctggacaaggagagaatgggaccgtcacccaccggtggctcctccgtctatggcctctagtcattttgctccctacctttcttctgaagtcaattctggtttttgtttttgtttttgttttttccctatttttcccaaagacccggggctggaggcctgtaaagggaccatgctacaatttctgagcaatccagtctggtttaccagaattagaactcagtactgcagaaccctgggaggtgatgatgcaggtcaatgaggccttggcaagaagaaggggagggagggaggatggagacgtcaacctgacataggatttggagaagagtcagagattaagaatttagattaatgtgccaggcgccgtggctcatgcctgtaatcccaacactttgggaggctaaggtggcagatcgcctgaggtcaggagttcaagaccagcctggccaacatggtgaaaccccgtctctgctaaaaatacaaaaattagccgagtgtggtggtgggcgcctgtaattccagctacttgggaggctgaggcaggagaattgctttaagctgggaggcggagcttgcagtgagccgagatcacaccactgcactccagcctgggcaacagagcgagactccatctcaaaaaaaaaaaaaaagaatttagattagtgtttattttggaaagggagagccataaatatatatttcaggtgtctgtcttcactataagtttgtttatggttgaatttgataaatgacttcctttggtctgtggagtgtattagttatttgggtgtgatgtgttggaagaagatagttaatgcatttacaggaggatcatgtgagatttcagatcagggccacctcatgcctttaatacataaaaaccatttaaaacattaaaaagttccatgcaatcttttttttttttcctaccacaatttatgtctttatgaggaatatctccattctgcctctgctctgccagggtaattattatcctgtatacactcaggtctgtgttcaaatcagcataacgaaggctgctatgaaaatgaatatagaattttcataaagttcatgctaaattcttaaactttagcttttacatttttggcagtaggttataggtaggagtcatctttgtaattgacatttaaacgcaatttttcttctcataattgataacgacttcattcgtgccagccgcaaaacccagtgtattattcttgtcagtgcttgacggttttgacaggccagaaaaattgcaagtaaaatagatatatttgggcgtgagatgttgacttataattcatgaagctgcaaccttccacctgtaaaggagaagaattggcagaggtatggttttgatttatgtgttgaaagacagaaaacaaataagaaaacctttgttctgctgtcacaactgatgaaggtaacagtgttaaaaaataatgaaattcacaatacttcctacacatccagtcctctgtagctgcaattcgggggggccaagggcttccttagcagaatctctgggctttcttggggtgcaggtagggctctggccttgctatgctttaactagaactactgtgattttttttccttccttccctccttcctccctgcctcgctgcctccctccctccctcttttctttctttccttctcttttttcctttctttctctccctgtttctctgtctctccttccccctccctgtctccctccctatctctttctttccttttcttttttctctccctgtttctctgtctctcctcccttcctccctctctcctttctttatttttcttccatctcttaatttcattcattcattagccttctgtgtaagattttgtttggaaaaaaaagagtcatatccccctttaaaaacagttcatagaaatgtatcctctagtagtcccagctgctcgggaggctgaggcaggagagtggcgtgaacccggagggcggagcctgcagtgagccgagatcgcgccactgcactccagcctgggtgactgagctagactccgtctcaaaaaaaaaaaaaaaaaaaaaaaaaaaggaaatgtatcctgtacatgaatgtggataatgagctttcctggctggaaaagggcaatcactctggcttctgggatgaccctggagtccttctctgcttcagtaattgccacactcctgggctccgccacttctctattgcccagttcttctgctgggatgctggccttccgccaggcagccttaggttctgcttagacgcacagataatctttaccagtgtgtgagaagcctgaggatacagacagactgcataccgcggccatgtgttgtgtgagtggtatcaggctggacgtatcccttgacaacttgactttttagctcacagttacatttttcggactgatctacgttgattcgtggaaaaacaggtgataccgcttctttccttctatcccccggcttcagttgagttcattctataccccacccgatgcctccgcgtacacactgtagctaattctgcaggagatggagggttccatggtatcttcacacgtggagatggcactacattcgtattctgagctattccccagcagcaagggtaaattttcttctcttgcattctctcgctcagtcaaccttgtgaccattgactcatatttgaatgtcatgtttgggccataggcgcaagtgaggagatgctcacgctggttaccttgcaggtgttttctataatgaagagcccacaagccctcaccccacccctgccctacccgcagctggagtgaaggtggcgccccagaggccactcctgggagaaacctcatcccctccctccttctgcgacttcacagcctcacacacagttgtctgggaaacatcagatctaaccacctcgagccttgcgtctctgtttatgcctctcccaacaggaagctgagactcggaaaatcctcgtccccctccgcacctctctcctactcaccacgcctttccacgggaacacacagcacgttatcagcaaaattccccacaccctcagcgcctttcctgagaggtcctcgtgatggtgtggatctgtgtccctgcccacatctcatgttcagttgtgatcccagcgtgggaggtggggcctggtgggaggtggctggatctcgggggtggtttctcacgaatggctaagcaccgttccccttgctgctgttctcgtgatagtgagtgagttctcgtgagatctggttgtttacaagtgtgtggcgcctccttccttgctctttcttgctcctgctttcacggtgtaaactgcctgctcccactttgccttctgccgcgattggaagctgcctgaggcctccccagaagcagatgccaccatgcttcctggacagcctgtagaaccgtgcgccagtgaaacctctcttcttgtaaattccccagtctcaggtatttctttttctttctttctttctttttttttttttttgagacagagttttaccctgtttcccaggctgaagtgcagtggcatgatctcggctcactgcaacttctgccccctgggttcaagcgattctcctgcctcagcctcccgagtagccgggattacaggcacctgccaccacacctggctaatttttttttgtgtgtgtgtatttttagtagagtcagggtttcaccatcttggccaggctggtcttgaactcctgacctcgtgatccacctgcctcggcctcccaaagtgctgggataacaggcgtgagccaccgcacctggccctcaggtatttttttatagcaatgcaagaacagactaatacagtccctttaccttatcttcctaactgctccccgaagtcctctcaagccacatctgctttgtccccacaccctgaaccaccacgtttggtgctagcgcctcatcactgctccatgatcatccttccctcctcctggagacccctggctttgcatctctggccaccagatcattgttgcagtcatctattcatctctgatccatgccaccttgttccttgtggattgacgctcctggagtgctatcagtacaccaaccctacttgtcagacagtaacacctgtgatttcagtgttcttgtagacaatccttcggtactctggcttctcaggtccttaatctcctcttctccgatgaccttgttcttcactcaacctcagccccccatttccgtaactataccctagagcttattaccggttgtaaagactgataatgcagtcattatctgttatgctccagctccatcatctcatttcaagcatcccattctctgatcaccacctctttcttctctcctaaaaccttgactgaaaacaattcttccacctcactgaagtgcaaaatccatccatcctatcatcttttccccctttctcacctacctcatgtcttcatgtctctcattgtctagtttggagtccttgattatctaatcattaccttgctttactatcttataacattaacttctttacccatctctctcttcatcccactctccttgcaaaactacagccttggtaaaatccagttgcccatgtcctctgtacctgtctgtgcccagctgagcctgggtggaacagaacacagccgtggtgactgtttccagtttatgaccattaacttctagtgggctcgagcaccctctggcagagcgttctcctctttctgtatcatcatttcttctctcttgattgaatcactccttttagcatacaaaaatgctattataactcccaacttaaaaaataaatttctcttaacctcacacatctcattaactactgtcccctttcttttctttctttctttctttctttttttttagagacagggtcttacctgtcacccaggctggagcgtagtggcgtaaccacagctcactgtagccctgtagccttgaactcctgggctcaagtcatcctccttcatcagcctccaaagtagctggtattacaggtgcatgctaccatacccggctaatttttaaattttttttgagagatggggtcttgctacattttccaggctggtcttgaactcccgggctcaagcaatcctcctgtctccccctaaacggatagcaggcgtgagccactgcacttggcctgttccatttctttgattatctttgcagcaaatttatttttaaaatgcgtgtttatactctctgtttccagtttctcatctctatcctctcttgaacccactccatttatcttttagctgccaccactcaatcaaaagctcttatgaaggtcactgatgataatcaagactaaataacatttgtaatagataataattgtaatctgatcattataacacgttcattcattctacaaatatttgttgactggcacctactatgtgccagttactgttctaagtgttttacgtgtattcacttgcttaagccctaaggcgggtaccgttattttccccatgttatgggtgaggaaactgagaaacagagaggttgaagaatttaccttctatgccataagtggtataaaatggtcagttctcagtcctcattttacttgatctatctgcagcatttgcccgtagatcattccctccttcctggatgactttctttgccttgttttctgaacatcactttttgatttctcctttgagctcactacctattccttctcaataccttgtgctggtttcctctcatctgctctaaataaatcgtggaatgatcattcatcagacctttgctctgcctgcactgactccctatgccatccctcccaggcccgtaacttccaatgctatcagtatattattgatttgcaaaattgtatccctagcctggaccttgaccctgaacttgagactgttggtcttagtctgctcaggctgatataaaaaaacaccacagtctgggtggcttataaacgacagaaatgtatgtatttcttacagttctggagactgggaagtccaagaccaaggcaccagcaacttgagtgtctgaggagggccctcttgttcatagatggcacattattgtgttttcacacagtggagggggcgaggaagctctctgggtcccctttctaagagcactaatgtcattcctaatgactccaccctcatgacctgatcaccttccaaaggctttacctccagccatcatgttggggactaggtttcaatatatgaattctgtggggcaacaccacgttcagtttacagcggtctctctggcctcatgtccaaccatctcccctcctcattcatcccactccagccacgccggcctcttgctgttcccagttacgccaactcgcccccacccagtccttcatgtctgcctgctcccctgcctgggtcgcttccccacgatgcctgctgtggctcacagcctcactgccttccggtctctgctccagtgtccctgaatagagtccaactctgagcatgctgtggaaaagggcctcattccaatacacaaagtcccttttcccatgccctgccttactgttctccataggtcacatgtgacgtgacctgtgtgtgcttgtttactggttttgcttcagaagagacctccgtgagagcagggaccttggtttgttcatggctctatcgcacaactgggtataataggtgctcgataaatattctgttgaatgaatcaatgaagttgccacagggaaggcatagacatatgtctttcaaaactccatgtgcttggtctttttaaaagtaaatttctttgattgtaaatagattcacattgatacttgaataaaatcataaaggtatgtcttctttcctcttcctttaagttttaagacacttataaatgtacctgaaattgtaataaaagatcccagaggattttacagcatgttttccgttgatggtaatggatggaaataatttaaataataacattaacaggttgttttactacaggaccacaataattttaaaagacaaacttgaataatcctgttttaccacatccctaaacctatgaaacacacagtactcactcattaatgttgatttgtttaagagaaataaacttcaaaaaaaaaaaaaaaaaaaagccaacaaaactcactctgatattaactgcctcgggtttaaaggttttttcagaatgcctcagtaatactggcttaatgaattaggttctaagaaaaatggccaggcatagttaacaataaatcaggttatactatttgcagaaaaagcaactaaaactctccttgtaaataataatgtggaaagatctggtattaatcaagccactgtctacagctgagctctgttttcagcttctgaacacagtggagttaatattgagcatatctttgtttcaagtataatgaacacaattctgcagtcctttgagaacaggcttttgtgaaaaatcagtaaggaattgcacctaaaacccatttacaagatcatactcccaaaggctttgtcttagagcagtttttaaaatcttgttggtaacctcctgaccacatcattgggagtacaaaaaagtgcagagagtatatatatatatatttttttttcataaatacttgcacatcacatttcccctacggaaattcaaccagcggttccaaagactgctgggctggagttgtccgggttggtggacccgcctgagtctggggtagcttagcttgttcagaggtgtgcacagggctgaggaccttctgtgcgtagcagagtcattcatctggtcaatggccacatgaagacacagatcttgccatatcagattctccttctttctactggaggtctggtgactttacctgtgttagttcaggcacctctggataacttaaggactcaccaagcggcaggtccttatgtagctccacagaccaccatgaaacccttcgaccttttctgaagtctgccttacgtcttgggccactgaacattctgccagtcctgaagaacgtgttgattccagtctcatcccagtgcaaagtgtccttctcatctttgggctgctgtcccctgagcaggaatgccgtccccacagctgatctttgaccatgggtagactctggtctaccatatgacctgggaccatcaaagcccaggttaagctgcatcccaagtgtttttctagccagccatgccctgggggtactttccattttattggtcacggagcactcaggccctgctccaggatcccaggtatggtctctggggaaaactgaccacaggttgtgcaggaggaaccaccagacctgcccgagaggggacatctcttctctttggtctgctgctttgagacaattccaagatcgcagtgtatatatgtgtgaagtcttcatgggtaactatctccaaagcatttaatgattctctttccttggcttataagtaggctgataatggaagttcaaatgatgtgggactctgttggtttgtccttctggaaaatcccactcctcttcctggtcaccaaagcagtgaggggaggagggcaaggaattgactcctcacatgtattctaacaagcatggaacagagcacacaagacatggatcttactgtagaccggggaagacactgagccacttctggctttatctcttctgacctatgcattgggataaacttagctgagcgcgtttccctgtccgcatggagggtctggaaaatgagccggacattgagctgggcttcatactttcatctttgcctctctctagagccaaacaaaggcttacctgggtgggccctttttggtcctgtttttctgtcatcgctgttgatacgtgggccttgagctccctagttgcaaactgggaagtgcattgaatgagaagtgtgtggcttcttccctggctatgccttttcacgtgttaaacatagggaaaactcagctatgccttttcatgtcttaaacaaagagaaaactcagctatgccttttcccgtcttaaacatagggaaaactcagctatgccttttcacgtgttaaacatagggaaaactcagcatttgtaataacatgttatgtttatagagctcttcacaaagtgctttgatgtctgtgattccatttaatctttacatcagcagcaggggataagtgttatcccagtcttactgatgaggaaaccaaggctcaagaagattgaatgatttggccaaggctgtgacactagaaaaggcaaagcttggactaaaacccaggtcttcagaattcaggtccagagctctggccagtctgttgactccttcatcagctcccaagatgaagatgaggagctattttctgttttgagcctttgattacagcttgttttgtaatacaccataaaggttgagaccatgtttgtttctagcacttacaaaaagacctggcccaattagacacttaataagtgttttataaatgaatgaaattagtgagtgaagaggtaaatgaatggatatattgaatgaatagattaactaggcaaaaacctacctgtctgcatttatattggaaagcactacatgaaaaaatgagatttgaaagttttagaatgtggctgtgtgtgtgagagagatcgtccctcaatctttcatttcttctgattgtctatcagtagggaaggtccaagtcccacccatactgtgtttctcaaatattctcaaattgtattgaaacctgtaaccaaaaccaaagttaaaattgattttaaagtgtcttctaggtttttattctaccattcctacctccagttttttgtttgtttgtttgtttgtgttcctttttgagacagagtctcattccttcactcagactggagggcaatggtgcgatctcagctcactgcaacctccgcctcccaggctcaagcaattctcctgcctcagcctcctgagtagctgggattacaggcacccaccaccacacctggctaatttttgtattttcagtagagatgggttttcacaatgttggccaggttggtctcaaactcctaactgaaagtaatccatcaaccttggcctcgccaagtgctgagattataggcgtgaaccactgtgcctggcccacctacttccagtttaaagtcacctgggaaatacttggagtacagttttgtcattttaatccttttttggaccacaacaatcactttacgaacatttttttaactttttcagaatcgattcaaggaaaagtgatagaggcaggtggggacggggaggtgagttttcttcgcatttttgggaatctcaactcctgagcctgtcttactagtacgggttccccaaccccacgactagaactatcttagtggtttcttcctaaagagatgtacacgtgtgtgtgtgtgtgtgtgtggtgggcgtgggtgggtgtgtagagtagggaaaaggtgagaagtggctctcttgctatagacttttgctttttactcttttccactgagtctgctcatattattcatacgattatcacgttagaggttttggagttgtagtggctatcgttttaagtttcttgtagaattaatttatataagtagacaatgtatatgaattgattgattcaaatctgtatcttacaggatctgttaaagatagtcagaaggctgtcttttaaaatgtgaggacaaatcagtttaacagtatagcagagaagtacagctgtgctctgtcaaactctaggctcctgtgtgttggaatgactagaggcagcagggagaggggtcctggtttactcaccccctctccctctttcacatactagcttgggcttgttgtggttgaggtggtgtgggaacatctagaaggttcattcaaaaaagacagcctcagcctttgctcagacgctcaagatgttctgccggctctccctaccatgaaagttctctgagaagccagtaaagatggcagcctctaaagaggttagctttatttggtggaggggcggtaggggtggcacacaccgaggaagattcggatcgtggcacatccttgtggtcaggcccagaaatcctcattgccctgcagccacccaggtcatgattcatgaggtgggggtctaagctgagaatggctggccggttctctgacttcgtgggtgtgtaatagttggttgcaactgacttctcaagaatgacagttactgactggagctggcagagaggtgtggccaagttcctggagaaatgcttcctgctcctcccgccctccccaccaccatcctgctgtatttaaagctgctttggtgatgctttgctcatctcagtgaattttcagttcagaccttttcactaaggatcattatggaagaaagaggggtaagaagtgtggctgagtagcctaggattaattcatcagtccccaaataagcaaacacgatgtctcaggatggacggtgaaattctggacctcacaggtaggtcttggagttgttagttgtgaatgtagacccccaagttcagatgttgccaggattttacatcctctgcttaaggctgtgttgttatttctgatgtttatgagtgaaaacaaaaacatacagctcaggtccttatcctctgagggtctcctcagcctggggcacctcccgccaaacgcttcatgactcccccaccaagcacatcctggcacaatctggcatgaggtctgagctacataaatgtggttttatgagggaacaaagcaagttttggttttctttagaattgtacgaaattataccttcaagatgactttgccttatcgtggcttttgttttgcttctccgagaaggaaactacaaagttaccatgatgtaaatccggccagaggcttgaagtgatttcatagtaaaagccacctcagccgtcccctctgaaacccaggccaagaggcagagatgccaatgacaggctctgtgaccagcctcgtaagccatgaaccagatccacggtttcacatggccaggacctcagggccgcatcagcctcttccaccacactctctcgtgaacagctggtgacactgtcagcggcgcctctgtcacaaggaagggcaatgtcctgtgtagccagatggcgggggagttggaggctgggccaggcggtcaggatctgcattccaccagcccgtggggttttcatagccaggggcactgtgtccaccttgggcgtggccatacacagccaccacttctaaccccattgccagctacaacggaagagagcatgctgtttagagttcagtacctccacataagggaaactgaggtagaggagagccggcattagcttctgggcttagaacacccaccttgccctcctgcatcgagattcatctccagtgagagcaggtgagaaggaatcagaggagagcacctaggcccgggtgtcaaccttgaccccacggacatctaggactggatgatttttattttattttatttatttatttatttttgagacggagtctcgctctgtcacccaggctagagtgcactggcgcgatctcggctcgctgcaacctatgcctttcaggttcaagcgatcctcctgcctcagcctcctgagtggctggggctacaggcacccaccaccacacctggctaattttttgtattttgtttagtagagacagggtctcaccatgttggccaggctggtctcgaactcctgacctcaggtggtccgcccatctcggcctcccaaagtgctgggattacaggcgtgagccactgcgcccggccagtgattcttttttcaggtgctgggatgcggggtgctgctctgtacagtgtatgatgtctagctgcatccctggcctctactcactagacgtcagtagccctctcccagttatgacaaccaaaaatgtctccagatatttcctaatgtcccctgagcatcaaaatcaccatctccagcctgggcaacatggcgaaactccatctctacaaaaaatacaaaaatgagccaggcatggtggtgtgcagctgtagtcccagctatttggaagcctgaggtgggaggaccatttgagcccaggagagtgaggctgcagtgagctgtgatcacgccactgcatttcagcctgggcaacacagtgagaccctgtctcaaaaaaaaaaaaaaaaagaagaagaagaagaaagaatttaaaaaacttaccagcggtcaagaaccattggagtagagagagaatttggtgaaaagacatctgcattctacctttagtctctgggctatgtctccggggctatttatcattgtcttgaattattttgtataataagcagcagcccccacgctcaggtgtttggaggagttgcaattcactgggtggagggtagagcgtctcatgaaatcctcggctcctgtctgaaggccacagctggggtgaggcccttgaatgggagaggcagatgtccctgtctacttcttccttctccctgcctcctcttggccttccttcccatcccctcctctgtgacagcacaccacaccgtcacctgggtgctcgtcagcacgcagattccagagcccggctccccagagattctgatacagggggtctgagaggggacctggaaacctgcctcactgtgagcttcccaagtgactctgcgcagggggcgtggtgaggtcacactttgagaaacaggccctagaggcttttctgaacacacgagccctcccagtactcccaggacactaaagtgtagcagaaacaagcaaaaaaacacaactatactagcaaacgtgacaaaagcaaaaagggataaaaattcctaagaaaggccaggcacagtggctcatgcctgtattcccagcactttgggaggctgaggtgggtggatcacctgaggtcaggagttcgagagcagcctggccaacatggtgaaactccgtctctactaaaagtacaaaaattagctgggcgtggtggcgggcgcctgtgatcccaaggtactggggaggctgaggcaggagaattgcttgaacctaggaggcagaggttgcagtgagccgagattgcaccattgtactccagcctgggtgagagagtgagactctgtctcaaaagaaaaaaaaaattaaaaaattcctaagaaagatgaagctattcaatgtgggaacctctctcactgaaaatggattcatcgagtcattgattgattcgacacatggcttctgtgtgcctacttgacttcaggcattattctaggcatgacgcattccgcagtgaacaacacagacaaatgtgcctgctgtcacctagtttatattttgcagggggagacagacaatgaacggaatgtagttagaaggtggccatgctgtagagagaattaaagcagagaaaggtggttagggagtgttggggctagtttgcagtatcactagatgatccaggaaggcctcgttgaaaaggtgatccttgagaccttgaaggcggtaagagatggccaggcagatatctgcaggtgagagttttctgggcaggaggaacagcaagtacaatgtcactgagctgggagtggacattcctggtgtgttcaaggaacagccagaaggctttcatggctggttcaggctgagtcagggaacaagtgtaggagctgagggcagagagggaccaggaggccgagtcctgcagagcccatggcagggacattgactttgactctgaaggaagtggggcgggggccaggggaggattttaagccgaggactggcaggatcagatttaagattgaaaaggatcaccttgtctgttttcttgagagtggactccaggtgggtaagagtagaagttatcattactattcaaattatggcacggtttctgccccctaggaattcactgtgatggtggagatagaacatgtacagcttaagtaaggaaatgtttgctaagtgctatgaatgacttagagaagtgctgtgtgagtcagtgaagggagacatcccttctgggagtcagacttcgcggaagagcggggccttaggatgaatgaacaagactttggtttttttagtgtgatacataattcaccatgcacatccagtgaatggtacacatttaaagcgtacactttgatatttttggacatatgtatccacccatgacgctatccccacaattataatactgcacatatccatgacccccaaaagttttctcatggttgatgagggagagagggagttatcatcagggcaggaaccaaagtgaaggtgcagaggctgggaaatgtaggggcttccatgagacagagggaggctggtgctggtgctcctgggggaagtgagggacgtgtgacaaggtggcctgaagaaaattgtgtggggcccaaaacactgggtcacaggggaatggggcaagtacttaaatttttgtaggacatggtcaaatgatgtatttgttaaaattccatcttttttcttttttgtgttgagacatggtctcgctctgctgcccagattagatggcagtggcgtcatcatagctcactgcatcctcagcctcctgggctcaagggatcctcccacctcagcctcctgagtagctgggactaaaggcatgcaccaccgcacctggctaatttttgtattttttgtagttgggatttcaccatgttgcccaggctggtctcgaacttcagatctgcccacctcagtttcccaaagtgtggggattacaggcgtgagccaccataccctgccaaaattttaccttttaaaaacaatggcaacaccaccaaattttaggtatttaatctttttgtagtaagtttaagaaaacacagccaagggcggatcatgaggtcaggaaatcgagaccatcctggctagcagagtgaaaccctgtctctaataaaaatacaaaatattagccaggcgtggtgatgggtgcctgtagtcccagctactcgggaggctgaggcaggagaatggtgtgaacctgggaggccgagcttgcagtgagccgagatcgcgccactgtactccagcctgggctacagagtgagactccgtctcaaaacaaaacaaaacaaaacaaaacagccaagtacatttatgcagcatttcatgaatatgaagtcaattaaaagaaaaagaaacattaagcaattttataattagataattaacagaatccttgatagccttatactaatacaactacttgcagattgaaaataattccatttgctgcctgctggcacattaaagcctacatgtaaaaaatacatcaagtctagatgggcttcagtcatttgaaagtaatattttagtgcattctagtataatcttgattagtgcttacatgcgtatagttcagcactttattttgtgtcatgttgaacatgaactttaaagttaagggaaacattttaagtacgtagtaggaatctactttcccatcttaagctctgaatctatttgtgaagggatcctatttcccaacagccaagggatatactggagaacaagattttcagggttgaagatacgctgatgtgaaatcaggtttctctctctttttttttttcttgagatggagtcacgctctgttgctcaggctggagtgcagtggcgcagtctcggctcactgcagcctccgcctcctgtgttccagtgattctcctgcctcagcctcccgggtagctgggattacaggcacgcaccaccacacctggttaatttttgtatttttagtagagacggggtttcactatgttggccaggctggtctcgaactcctgacctcaagtgatcctcctgcctcggcctcccaaagggctagggttgcaagagtgagccaccgcgtccaggccaggtttctctttctacatcttctgggaaaaggttggcagctcctaggagatactgaccagttagttgatgggtctgtgattcaaatcgaacatctagcaaagcccctacgaagcattagtcactcttgtgggagaaatgaggaagcgttttcagtaggctgttagagtgagaagcatcagattcttagttccatggaaatgaacgcctcttggagtgtttcatcttttaaaatagagaaggaagctgagagtcattcaggccatgctcagagatgtcagctcaggaactccaggaacccagtattattttgattccttccttccttccttcattccttccctccttccctcctttccttacttccctccctcccttccctccttccctcccttccttccttccttccgatatgggttttcctcatgttgtccaggctggtcttgaactgctggctcaactgatccacctgccttgctttgggctcccatagtgctgggattacaggtgtaagccaatgggcccagcctattgtgatttctttctttctttctttcttttttttttttttctgagacagggtctcactctgtcacccgggctggagtgcagtggtgagatctgagctcactgcaacctctgcctcccaggttcaagtgattctcgtgcctcagcctcctgagtagctgggattacaggcacctaccaccatgcccggctaatttttttatttttaggagagatggggtttctccacgttggccaggatggtctcaaactcttgacctcaagtgatccacccaccttgacctcccaaagttctgggattacaggtgtgagccactgcacccgggctgatttaagagggctttgacttgaccagatgtggtggttaagtgaatatgatatgttcccttctttatcatcctctctgttcttaattgcaaaagcgccaaatcctcctagataaaagacagccctaagatcattgtcaccatcctccttatcctcatcccaacattatatgaagttctaaatttatacaagttactgtattagatactgagactagttacattgataataattactaccatttatttaagggtgataataattactaccacttattcagcatttaccaagggccaggtctgtgctaaaaatgttgcacatattatcacatttaattcttacttaactcaataaaataagtatgattattgactcccatttttacattaaggagactgaagcttagagagatttgtgaaaaatggctcctggtcactcagctactaagtaatagaagcaggacttgaacctcccatacccttaaccaaaagttttcaaaatagtcaacactgtccataccatctagttggaaaagatgagacctggacataaaaactggccaggcagagtggctcacgcctgtaatcccagaactttgggaggctgaggtgggcagatcacctgaggtcaggagttcaagaccagcctggccaacatagtaaaactccatcggtactaaaaatacaaaaaaattagccgggtgtggcggtgaacgcctgtagtcccatccacttgggaggctgaggcaagagaattgcttgatgcagtgagccaaaatcacaccactgcactccagcctgggcaagagagaaagactctgtctcaaaaataaataaataaaagcattttcaggggttgtgacgagaaatgcctcacccattcttttgagtcatttatgaactgttcttaatcatgttacgttctaattaaacatctcccttttcttttgacgtggaaaagtctttaccttctgcaatacctttttcacatgttgcagcaagcagccctattaatcgcattcccacctgcctttggccctcccagctgcctcgcttgcagaacacgatcgttcaaacggaagtcattcatgggatcgcctctccctgcagtaatccagagcagaatcacttaggctgagcacagctgctacatcccagggtaatttggtttcttatgtagaaaaactgcggtctgacatttaacatttcctcctctggagagtgtttttttctttttttgtctctgtgaacttattacccagcatgtcttcacgcctttacattcagcgtgttcacgtgctcagcgcggtgttcatgcccgcaccattgtgtgatcaccatcactgggtgaagggctgtgggcttacaaagcagactgggaatcacaatgacaaaccttgggttcagactccgggtaggacagaaggaagtttctacctgagtttcatgctaatcaagtaggggtgcaggcgatcaagcaggggtgcaggggtgcacctgcgatctcagggcatggcctcgttgctgtcactactgcggttgttattttggctgtctcaggcctcacctggagcaaaccctaattctaacacactctgtgttctttcagatatcactcccctcttcttttcccgtctttccagaatgcgctgtgcttgtgtcctctttgccaatcagagtgagccgcttggggactttagtccatgcacatgtcgtgtcagtgcagatgatagaaccttgagggtggtgacttccccacccggagccatgggtcgtgattcctttgtcaggcgttctgattggttcctggcttccctctgcggtggtcgtataccttgtgtgtggttctgggagctcatgaacaacaggaatcaaggacactgacctttcgccatcagcaaactcctgctgtgtagattcaggggcgaagagagtctcgcggtgagaaatactctgggtgagaatgaccctctgtgtctccttggtccttcacaccccatcaagcacaggcggatcaggagatgtaaaggtcagggagctggtaagcatcgacgaacaaaatcttcctgaggaagggccgggtgcggtggctcatgccggtaatcccagcacgttgggaggccaaggtgggcagatcacgaggtcaagagatcaagaccatcctggccaagatggtgaaaccccgtctctactaaaaaaaaaaaaaaaaaaaaaaaattagccgggtgtggttgtgggcgcctgtagtcccagctactcaggaggctgaggcaggagaatcacttgaaccagggaggcggaggttgcagtgagccgagatcgcaccactgcgctccagtcttgcgacagagcaagactccatctcaaaaaaaaaaaaaaattttcctgaggaagaagtagcatccccgagctggcatgttgggagtatccttcaatttcagatgcttaaattctcctctctgacaatggctaattaagatttggccacattatctttatttctcttcttttgaaattagtgaggggacctgaccttgggtgatccgcccacctcagcctcccaaagtgctgggattacaggcgtgagccacggtgctccaccacctacgtgtcttcttgtattcctcttcatgggagaagtagggaaaaaatgatttggtatatattcctgaaagataagagtgttctaagtatcgaatccttacacttaaaactttaggttgaaaatgttgcccaagtgccaataaaaattgggaccttaaacatagaagttcaccttgtgggtgggcccatcgctgctcccgtgagactatctctgatccaggatggatcagagctaggtgatacagatgtctctgaagcccacgagctaggcagcacgacagactggatgcttcttttggtgccagctgatccagaggacatggccctagtccatctcctagggccactgccattctttttgtgtccatatcaggaaagcatggtataattcgaggcatctatggctctgaagacttcttttctctctctctctctttttgagacggagtctcgctctgttgtccaggctggagtgcagtggtgtgatctcagctcactgcaacctctgcctcccaggctcaagagattctcttgcctcagtctcctgagtagctgggattagaggcatgcaccaccaacccagctaatttttgcatttttagtagaaacagggtttcaccatgttgggcaggctggtctcggactcctgacctcaggtaatccacccacctcagcctcccaaagtgctggggttacaggcatgagccatcacgcccggcctccttttctcttttcttcctatttatgactaccctcccttaaagcagtatcttctttatttcagcacttacagaaagctatggctgttgaccattcctttttgaagttgtgagttgtactaaaatatttatgtataatgtgtggataagcacttgatttactgaggccttttgatgataagaactcacaaagggttttagatcaagggtggcttcattgaagaaacacctctgacatcagccagcaaccgcattttcattaaagactctcaatctcagcctttccctggacgagagaggaatgggttgttggctacttcctggctgtctgtggcggtcgtattgatgttgggcccagctgtgctgaatggctctgttggtgctcgctgggcttgctttggctggcacagctgtgagtggaggacagctgtgaggagcgggagttggtgctgattgatgtcttgtgaaccccggcggagcactgagctccatgtatgtacggattggtcctgtgagtcactacagactgggctagaggtggcagcagaggcatgtggcgttaggtagtacaggaaccaagaaggccctctggactgtgaactctcagagaacgggtgttgttctcatgcaccctcagacccccagcctggggcaacactgggcgtgcaggaaaccaaagtctccgcttgttaaatgtcagcagctgagccacaaatggcaataagctgaataaagaaggtggtgcttcaagggagaggagtaaaaacaaggaagaaaagagaagaggggccctcagagccagggatggctcatgcggtttctggagagtggttgtgtccctaggtcagagtcaaatccagactccaagggctagcgttggaaataaactgtgatgtgcagacatgacttctcaccctctctctctctctttttttttttttttttttttttgagatggagtcttgctctgttgccaggctggagtgcagtggtgtgatcttggctcacctctgcctcccgtgttcaagtcattctcctgcctcagcctgctgaattgctgggactacaggcgcccgccaccacgcccagctaatttttttgtattttagtacagatggtgtttcaccatgttggccaggatggtctcgatctcctgaccttgtgatccgcctgcctcggcctcccaaagtgctgggattacaggcatgagccaccgcgcccggctgaaatgacttctcttagagctgcctcctttctgtggcacctcttccatatgattgggttagtaaaaatattctaaataagcaattgatttgaggctttttgaagccaaacagtttggtgccttgagagcataagccattgcttatgtgaaaaaaaacaagaaactgtatctttgcatatactggggcccaaataaatcccgtttgaatgaatgaacatttcctagtgaaaacatggggctggaacccttctgtgtccgtgggaaaataggaatctattgatggatatggctctttggcttaaagtgaaaaatcatgaactggtggtcaagaaatctaggcatagtccacgcttttaaccctctgggacctgtttttctgtaaactgaggtgacgctctgttctggaacagcccctaaggggccgtttcaggtcctgctacacgctctgagttgtgattagagactctctggccctgtcatcgaggaggacgcctcgagacaggcctcatatggtttgcatcacttcctcaaccagactcgctcaacctgaacctcccattgcttcccatcattgtgtctggctgtcttgagtgtctccctcctgagccaccccttgctgctgcagtgtaaagaggcctcttgatttattaatcaattaatcagtgcgtgctgaggagctgttcggggtagttaaacagggaaaacaaacagctggagcctgcaatcaagatggatcctaattaagaaccaccccccaaatgctgatcttcctgccccgtcactgcctcacaactcccccccaccagcctacagctcagcaaaccgccttcagctctgatggggcttctaccccatgcaagctgacagtgaatttccgaagggcagattttctccctaatgtcctagaggtaaataagccttgagatgagcgttatcaattacctgcaacgactgttgagcccccaaatggcgtagtagccctgttcatataggcacagcccacactctcctatcccagttcccccacgaacggagtcatggagctggaaggtccttacgataaggagaggccatggcgctgtggacagacgagaggttcagtgaggttcagtgagttgtctgaggtcactgcagaactccaaggtcacaagtggcagaactggaaactatctgatactcaacgaacactcctggtgcttgtttctctgtgtaatcctaaagcaaagtaaataagagacattgttctcactgaatccattaaatgcttctgttccagtggtacttagcacacaatgctgagaaggccaagattttcttagaacagaacctctgttcgaggttgcaagttgcacctccatctgcaactaactttctgtggtaacagggggccaagggacctcagtgcagtggtccagaattgcactcaccccatatcatgcctggacaaatgtttgttccttctgattgaacaccttgggagagcccagggatggctataattcttcagtggatgtaagaataagaatgttcttgccaggcatggtggctcacgcctgtaatcccagcactttgggaggccgaggcgggtggatcacgaggtcaggagattgagaccatcctgtctaacacagtgaaaccccatctctactaaaagtacaaaaaattagctgggcgtggtggtgggcgcctgtagtcccagctatttgggaggctgaggcaggagaatcacttgaatccagaggtggaggttgcagtgagccgagatcgtgccattgcgctccagcctgggtgacaaggcgagactccatctcaaaaaaaaaaagaaaaaaaaaaatattcttgaccagcctggcgaagaagatacttagaagtcttatttatttttttaacttctttttgaaagttttcactataaaattcttacatttgtctaatgtgtttatcaaaaatagaggcttttctgccagtgtgtcttctcatttctgtggaatgccaatcaaactatccaactctttgagtacgtctcgggtttgactggtaagccaggtatctgacttgcactagcagccttggagttatagaatctcctctccctctgcttctgtgttctgtaggaccctgctttctcggctgtgattcacgacaaactccaggtccccaacaccatccggaaggcatggaacgaccgggacaaccgctgtgacatttgcgccactcacctgaaccagttgaagcaggaggccatccagatggtgctgacgttggagcaggcagccggcagtgagcactacgacgcctcgccctgctccccgccaccgctctccaacatccccaccctggtggggtcccggcacgtgggtgggctccagcagcccagagactgggcctttgtgcccgccccctgtgccacctccaactacacaggcttcgccaacaagcacggcagcaaacccagcagccttggggtcagcaatggggcggaaaagaagagcgggtccccaacccaccaggccaaggtcagcctccagatggccaccagtccaagcaatgggaacatcctcaattcggtggccatccaggctcaccagtacctggatggcacctggtccctgtcgagaaccaacggggtcaccctgtacccataccaggtaagtagcctgtgtgagccaggaagagcagggctggctggagtcaaagcggagaagtaggcagcacttccttccgctgcctcctcccgggaaccctgtaactcagagcccagtgtttccatgtggcccccacagagttctcatcaaggtgccccacccgggcctgcctgctttgagagggtgttgctacatcttccaaactttccacacctgccctttctctgctcttcagtgtctccttcctgagagaccctctttgtgtaagaggtccttgctggtccaggtgatgccagcgacttcccagccagcagatttaccacatggcagagccatgaagaggtaggccacacagatacttggactggggtccaagccccgacttgtccacttattagcagcgtgacttggcacaaggggtttgccctgtcttaggctcaagtccctcatttataaatggatgtgagtcacgagaattaaataaggtagtgtttgcatgacatgtaggccaacacctgccatatagtaggggatcattgttgtgcctgttaacagagattttagatattaagtgagagtgagatgagtgagatgcttttgaaccaaaggatattgtgagtcccaggaatcacggttttaaagcagcctgtggaagtgctggacattgctgagaataaaatatacgaaggaacagtgatccgtgttggcactctgccttccctgtctataccttccaaaagaggtgtagatgcccttcttaacctctcctcccttgacagacccaaattcttttctatttgcaactcaccttaagaactactgggattgggctgccaaaactgtttcttccttttcagttatttaaattagaacatgcccccaagtttctccatagaaataaaacacaggtcttaaatctcccagggaatctttaaagatgttctaattttgcccgggtgagttttctgttggatgaggactggatttttaatgtaagtggcctccatatcccctgcatcaggggtgtgggaagcagcagagagcattgaccgtcactggaatggagaggcggccacggtcaagggtgtattactcagagaagatagttggtacatacagcaaatgatcctggagacctcaggctttttctcacttgggtctgtcatggtgggtgtttggtaggtggccttctgctgcgatgtgaggactcagactagagacctcaggttatttctcacttgggtctgtcatagggggtgtttggtaggtggccttccgctgtgatgtgaggactcagacttcttccaccaaatgcgtcaccatcttccaggggcctcaagagtccttcaccagaccttctgtaaccagccaggaaatgagggaagatagagtgtgtggaggatctcacaggaggatttggggcccagctttgcatggaagtgatgtatgttgcttacatctatattccagtgacaagaatccagtctttgctgggcgtggtggctcacacttgtaatcccagcactgtgggaggccgaggtgggtggattgcttgagtacaggagttgaagaccagcctgggcatcctggcgaaaacccgtctctattaaaaaaaatacaaaaattagccaagtatggtggcatgcgcctgtagtgtcagctacttgggaggctgaaacgggaagatcgcctgagcccaggaggcggaggctgcagtgagccgagattgcaccactgcactccagcagcactgcactccagcctggtgacagagcaagactctgaattgggaaaaaagaagagtgagagagagagagagagagagagagagagacagacagacagacagacagtttagtctcttgatctcaccttcccactggtgaagctggggaagccaatctacccgtgagcccaggagaaaaaggaacaagtcgagtgaacacatagcatagttttgttacgccggacaagatacagggaaacgtggagtgagttaaatgtggttgataaaatgccgggtgactttctctagagcgtttgagagtgttcatgtctcttgctatcttgaaagaaagtgggaaacgttgatcattatcctaagatattagcattcttggacggtcgaaattttcacttaactgggtgctttctaatttacaaaatctaacatatggattatttcctttaaccccacagtaggcctatgaggtaggtggggcaggtgttagatcttccttttacagttaaggaatatgatgcttagagaaatggactgattgtggccacacagccagtggcagaaccagcaccagctctccccttgcccagggaatggctttgcctaccgcggtttcttccaactttcctaggctaccccaaagtaagctgccgacatcttttccagatatggttccttttcagacctggtgtcacaaagaaaagaactcgttttacctgcaggggcctcactgcccctagacttttggatagaatcttctgggatgtgtatataaatataatgaggaaccagtggcgtcctgtgcagtgcttcacattctaaccttggaagtaaccttctagggcaggaacagagaagggcttctttgcatcatgggataatttgcttttttttgtttgcagttttaaaatataccatttagaaaattatcaaaagtaacatatttgttgtaaaataaaatttaaaatacatgaggaagtttaaatgagactttaaaagtcgatgtcacccggatataaactatgtaacatttggggatacttcctcctagcatttcatacactcgcaatttgtaaaattgtgaccaggttcaattctgtgacctgcagttcacttaatacattgggtacatttccccatgccactatatgtttccctaaaatattatctttagcagtaacatatttcattatatgaatattttccacgctatggagatgtcctcatttattaggttggtgcaaaagtcattgcggtttttgtcattactttcaatggcaaaaaccgcaatgacttttgcacccacctaatatataaccaaacatcaattaattagaatttaggtctttgctactataaatacaatgctcaggtgaacatccttttacccaggccatagtttcaacacatgcctggcttgtgtgagccacatacttgtgttacacagacaactcacatttcaccttccaggactccgaagctcttgtcacacgtggcaggggccggttagaagactcggcggctgcgccagcgctgatgagcgaggacagaggagcatgaaactggtgctttcctgtaaaatattcaaagtgaggtgaaagtttgtgtgtaagtcggaaacactgaagatgctgcttaaacggccgattagggattatttgtgcgtttcttttatttgtgcaatgattctgttcttcctcttacttcccaaactcagatgaaagagaatttactgtacaagtatttattaatctctaaccaagtaccaggcactgtgctaggtggtgggtggggccgcagccttgggctggaaaccctggttcctgtcctgaggtccttgcagtgggacagaaggcaggtgagtgcagaggtgaagagatgccgcggtgctttgggggcatgcagacaggctcctaatcccgcccgatgtggcaaagccagatacaaccaagattcacacaagccaccaacttgtggtcatcctgggtatgttctgttgcttctttccaactccagaacagaccaattcatgcatttcccctcagtaatgaagggaccagaggaaatctctctgggataaagagatttggtgcctggctatgaatctgcgtcccctgtgttgtgactgtgtcgtcctgatgccctggggtgggggctctgggtctggccagactgagtgtctcctgttgcggacatctccctgcagtacatattgtacagttcgcagtctagccagctcgtcagagacggttgactgctctgaaagctgacctcatttttcctgcttacccatactcccacttccctccccacagagcagatggcctctggatcagtgccagagccattccccgggcagagaagcatctagaccttgtcactaccaagggtgcggctccacacccgcgggacccgagcctctagaaatgagggagaagacgactctgcctttctgcaatttagacgtcgcaaggatgaaaacgatgcggacaggctttccagcagtgagcctggggaaatctgcgtcacatgggcgacagaaggtccctcgaatccctcaatccccgtggcccgcaccactgtgtaataatctccaaaggttgcagtaggaagattcttgattctcgtttgctatatccttcacatttctaaagtacctccagaaagaccaggaacctgtaagcatcacagataaataggaatcgatccagagagattttaaaaagagtaatttaggaagtactaagatgacatcaaaaatgttgaacaaaccacaaagataattctcattaaatatcttagaaaattgatttaataggagattataagacgggctttcaaagaaagactttcttctgttcatctgcagacatttagcacaatctatacacacacagagaaagcagaaaattctctagcgcaggggtccccagaccccaggccacagattgataccactctgtggcctgttaaggagccagccgcagagcaggaggtgactggcgggtgggtgggcattacctcctgagctccatcccctgtcagagcagcagtgccattaggttctcctaggagcagaaaccctactgtgaactgtgcatgtgagggatctaggttgcatgctccttatgagaatctaatgcctgatgatctgaggtggagcagtttcatcccatctccgcgccctatttgtctgccatgaagctggtccctggtgccaaaaaggttgggaatcactgctctagaatcttcatcttttttcttccaacttttatttctggtttgggggtacacgtgcaggtttgttatgtgggtaaattgtgtgtcactggggtttgatgtacaaatgattttgtcacccaggtagtgagcatagtacccaaaaggtggttttccgatcctcaccctcctcccaccctccacccccaagtaggcccagtgtctattgttcctcgtctttgtagccatgtgttacagccttcatttgaccacatgaaattgtgactttgaaaggatgtgtctagattagttccttgtaatcaactacagattagttacctctttttgaatggcagctgcttttgcctgattaacatttattatagtcaataactgcaggaaagactgtacacataacacacggagttataggatgttggtgatgttggtgttggaatgcacctgtgtaggatggtaactgtcttttgcatcatggtaggagatttggagacagagtcttacctagttcaagcctgtggtcccaccaactattaaaccagtttagtagcttgacatcttagtctatttcctcacctatgaaattcctacctcatggggtgattatagggaacaattaagaagaaggcgtgaaaatattttatgaactataaagcaggaataccggtataaattatctatttcaaccttttcatttaccagaggagaaacctgaggctgagagatttgaagcttcttttgttcagagttttctaaatcctagtttgatctcttttgctaaatcacacactcttggacaacagggactcattttattctcacatccctcacagcagctaacgtgaaaatgttgttctttattagagacagctcctatctcagggatgcactacaattactttccatgactggccctagtttaggaaagaattccaggccaaagacctatctagaacccaaggatttaggtggaaaccaccaggtatttgattccaagctaatctttaacctgaagtgtcttaatcatacttaataaatccttagatgcagtggaaagaacctcgctggcatttcgatgccacactcaatacaggggcatttgaaaggatagaagagctttatttcataggatttcactcgattgaacttgtcaagaaaattcagaagatgttagcttaatctacaagtaataaatccatagtggaccgttgatgcaatgaaggtcgtccatgtgcattccttgagttgcaggaaaatgctcttgatacaatttttcctgctttctctaaaaacatgcattggaatgaatgtgagaggtaatgctggactgaacactggccgaagtcattatgaggtagtctctattacagctttagaaatgattgcgcctatgaagcacagccattactggactttacattttaagatatgagcacagtctgggcacggtggctcatgcctgtaatttcagcactttgggaggccaaggtgagaactgcttgaggccaggagttagagaccagcctaggcaacagagtaaaaccccttctctacacagaaataaaaaatcagccaggcgtggtggcatgcctgtagtcccagctactcaggagggtgaggcgagagggttccttgagcccaggagttccaggctgcaggaagatgtgattgtaccactgcctgtaacctgggtgacagagacccgagaacctatctcaaaaaaaaaaaaaaaaaaaaaaaaaaaaaaaaaaaatatatatatatatatatatatatatatatatatatatatatatgggcacaaaaggatgtaaaagcaacaccaacctcaacatatatcaaggtttgctaaatgacaggacctctgcggtgcataacacttgctcctccgagatcagaagccctgggggatcttggtgctagaggacttccaagcgcccctgcaggaggaaggtgaggctctgggaggcccaccaagtgctgttgtactcagaggctttgccgattgtggcttcgtggaaagcagaagcgtgtgttctagtatggctgatgtcgggagatgaggtatacacgtgctcttcccggccgaaccacttttcaagaaggaacaggggtgggtgtttccagcaggtcaggagtataggattttcatccacgttcttcgcagctcttgagggctcatccagccacttgtgccctgaaatatgcagcacaccccttcttgggccagcactggggtcacctgcttcccacttgctgctgtgtctacccagtcaggcaatagtgtaagatgccacgattagaccaattatgacgtggaagagattcttaagaccatgggttttgttttctcctgtttataggcggtcaaagggatattaggttatgtatctttatgctttttgacaaattatgaacatggaaaaaagaatcaatttgtatattcggtcatggacacacatttctcaaggctagagtgttcagggtgaaattccaaaagggtagtcacagcttatgaatatggatggggccgtggtctgaagggaacacccagacttcactaggaaacttcaaaaatacgttcaatctgggcgtttgcttggtgtggtagactgaataggggccccccaacgatgcccacaccctaatccccgcaatctgtggatgtgttaccttacatggtaaaagggcctcagcagatgtgattaagccaaggatcttgagatgggggatcatttaatttaattttattattattttttgagacggcgtctcactctgccacccaggctggagtgcaatggtgcgagcttggctcactgcaacctccacctcccaggttcaagcgattctcctgcctcaacctcgggattacaggcatggaccaccatgtccggctaatttttgtatttttagtagagatgaggtttcaccatgttgtccaggctggtctcaaactcctgacctcaggtgatctgcctgcctcagcctcccaaagtgctgggattacaggtatgaaccaccacatccggccaaggagatcattttagactatctgggtggactcaatgtaattacaaggatccttaaagaggaaggcaggaggatcagaaccagagagaggaggtggaaggacagaagcagaggtcagagaggagagagatacaaatctgttggctttgatgatggaagaaggaacctctagaagctgaggacggcaagggtgtgattctcccctagagcctccagaagaagccagccctgcagggccatttttgagttctggtctccagaactttaagagggtaagtttttgttgtttgaagctgctaaatgtgtgctattttgcttcagcagcaataggaagctattacaactggtgagccttctgttaactgaaaagcttggtaaggagaagcgggatggggtctacagaccaaggagtccctgcagaaacctgcaggacagcaagaacgtgggcttttcatctcacacaacaaaccccgttaccctgcggatcggccggtccatgcacaagtcagattctttcatctgggtgccaccacagaatgagaggttactcatactgcaccgctggtttgcgattgtctcagatttccctattgttatagaatcataataagtagcacaccacagcgactctccattggtagctagtcattacaattatgtaagtctcatactgttgaaactgcagaaatcattccaagctgggggtgggagggatggaaggaacgggaggggaaggagagacttcactgaatttcatgtagaaggaagttcatctttgctagaggccttttgatctgatagaaggagatctcacagaactgccccagcaataattcttacctcatctggtaaagatcttcataatgcatgcacttgaatgcactttggacgttgtagagcagcatgtgagtgtttgctggtatcacgttttatctggtaggcaggacacagtcaatggggattccggagcaggggaatgggaagatttctttgcctgaaagcaggaattctcaattttggcttcacactagaattacttgggagattaaaaaaaaaaatcctaatgcctaagccacaccccaggcgaattaaatgagaatatctgcaggtgggacccaggccttggtttgaacttggccaagtccaagaaccacagtgttaaggaagaatttatctggcactggcgtaataggtacagggaagagaacaatgaatgtgtgtggatagatgagtgataggctgagagacaggtgtttgtttcttatggctgccatcacaatttactactaactatgtggctttattttttattttttatttatttttttttgagactgagtcttgctctatcacccaggctggagtgcagcggcacaatcttggctcactccaacctccgcctcctaggttgaagtgattctcctgcctcagcctcctgagtagctgggattacaggtgcccaccaccacacccagctaatttttgtacttttagtagagacagggtttcaccatgttggccaggatggtctcgaactcctgacctcaggtgatctgcctgcctcagcctcccaaagtgctgggattacaggcgtgagccactgtgcctggctcactgcaacctctgcctcctgggttcaagtgatgctcatgcctcagcctcctgagtagctgagattacaggcacgcatcaccacgcctggctaatttttgtacttttagtagagacagggtttcaccatgttggtcaggctggtcttgaactcctgacctcaggtgacccacccgcctcagcctcccaaagtgctggaattacaggcgtgagccaccgcccccagcctgtggctttaaaagcaacaaaaatgtattctcatagttctggagactgcaagtctgaaatcaaggtgtcggccgtgctgtgcttcctctgaaggccccagggaagagtccttcctcgcccttctgttggctccaggtattccttggcttctgatgcatccctccaatctctgccttgggtctcgctgtgtcctcttcttttctataaggacaaaagccattgggtttagagtctaccccaatccagtaggatctcatctcaatccttaactactatatgggtgcaaaagcaattgtgggttttgccattaaaaatcatagcaatttctgcaattacttttgcacctatctaataattacatcttcaaagaccctatttccaaataaggtcacattctaaatagatagacagacagacagacagataactagctagctagataagatagataaataaaaagaagaaaagtgaagttgcagaggtaaaaggtacatgcgggctctttccttgctgaaccacttctgaagaaggagcaggtgcagcatccacggctggtcagcagtggaggattctcattcatgttctttgcttggaggaaaaaaaaggaacaagtggaaaagatgaaaacgggccaagtcgagagagggagggacgtgtcatacctgcatgcatccttatactggaggggagcctctcaagagccagacaaaatgaaaaaatgctcagggacaaagtcaacgatcaacctgtatgcgtgggtttttcatagaataacagcctcctcttctgaacttacagaataccttgtaagtcatttgtgctttcacagccacagacataaatgtaaacagcacctcttgggccaccacctgagagtagataaatttaagttgcgagcctaatcagactgctgctgggggagccttgttccttctctaccgatcaagctgataatttggtctgtattttttgtttttatctttagtaacatttctaggctctaaaaggaggctagaaacagcaggtaagatgctgtgtgccttcaaggggaatttcttagttactagtaatagttacttaccatccctccccctttttgatgtgggtgagaggggttaggtggggaggtggggggtggtgggaatgtggctattatcacccaagcaagggaggagttattttcccctcccaggcaaagcttgggttgggggcagagctgagcatccctgcacagggggtgaaacaggtgggagagaagattgcctagatgtagatgcttttcacagtcgtcttgtgtgttagaggtctgcccacatcctgtctcactcagccaccctccccagaccttgttccctcaggctgaattttcactttcctatgggttgaagaaaagagccagggagtatgcaggctccatggtgagcaggccaagggggaaacaacagctactgctttttttcattttaatgacaaagaaaacagatcgttttagaaagtctgaggctgatactcatcaatgattttatccaaatctcacacaatgagaggttggggtcatgctggatttgctgctcatgcaccagaaataaaacaccaggttccttgctgactgtgtgacctcaagcgggcttcttaactgctatgtgcctgaatttcctcctctgcagagtggaaacttccagagctgttgttgggatcatgtgagagggcgtgttttgcatacttagtgctgtgtgtgacacatggcgacttctccgtgaagttgactgaaccttgagcgccattttcttttactcaactcaagttcatgtgactcaagttaaatggaatcaggaccctcttttccattgtaagagccagtggcagatgaaaagacatcaatcaccaatttcataaagtgaatatcaagcacataaaataaatgttatcctgcaaatctgaaaacattccctccttgacatattgccaaaaaatcaactttccatatgtacatcacatctcgtgtgagaatgtcatattttaagtagatgtgatctcattttatcattagtgaattaataaaatactgaaaggctcattgaccagttttcccccatatttggggatctttctaagggaggagggaaagcagcaaatagattcgaatcatttaaaattttacagcgtagtggacaggtcacatttaaaataacccaaacaagtcaaacgttattattttggaattcatttgaaatatcaagcaattcaggcctagtttatgatttttttttttttttggtttgtgattcttaccgaactctttgaaacacaggactcagccctttcattcttggtttccttatctatatgcttatggtatattattaatatgtttgctttcctattcttttatgtatttataaaatataaacctttcttttaaaattattatataatttgcaagtttcgataaattggaaaattgaaatgtcctcggctggtcgcggtggctcatgcctgtaatcccagcactttgggaggccgagacaggtggaccacctgaggtcaggagttcaagaccagcctggctaagatgctgaaaccccgtctctactaaaatcacaaaaattagccaggcatggtggcatgtgcctgtaatcccagctcctcaggaggctgaggcaggagaatcgcttgaacccgggcggcagaggttgcagtgggccgagattgtgccattgcactccagcctgggcgacagagcaagactccgtctcaaaaaaaaaaaaaaaaagtcctcacctaccccaccccagacatacacctaattcatttctaattgagattttactgtgctaacagtctttagtgtgatgaattagcatgcctttatcttatagaggtatttgtgaggattagttaatgagtcatatatttcatatgcttaagtcactccgagggagtcatttaggtgtttagaagcatattagtcactaattttgggactctggagacttagtccatttctgcagcaccactggccccgaggagttaacatatccctccattgctcatctgagagcctgggcaatgacttgagacactggggagaaaaaaagattccatatgaaaagcaaagacagcagcagccatgtctatattcaaggctgtggctgggagttgtctaattagatgactcatctgagccagcctgatggtttccatcaccttcactaggctgctccccaccgtccattaggctgcaaggcgctgcgtcgccagggaggttgaccccacctgcttgttcatgacgtgctcccttttggttcaagcaacagacatggttggaagcaagactagaaggcagccctcaagaattacaaatgacaaaactgaggcccaggcctgtcaggcgacctgtgccaggtcacacggctaggaagtgacagcgatgggagtcaaacacaggtctcccatgcatttacccctgcccctgccccagcccctctctggagggaaggggaccgattcctcagataggtcagatttgcaggcctcctggggagggttacccaccgcacacactcctgacgtgatttctttgggggcaatttggggtgcctaggatttccaagccaggtttctcatcttattcctctgcatagcagtttagaactcaatgcgctgtattgtatctcctccctgggaggtggggaggttggtggggttaaaaccgaaagacactgatgggccaaaaagatgaaaaaaaaaaaaaaaaaaaaggctgtgtgggcaatgctgccatctagtgagacatactttagccaacctaagaagctgagtggtcctggtagaatcccaccgtaaagtatttcgatgtcctaagcttcatcaaaggagacagggccatctccctgtcagtagcgtggtctttaacacagtagtgaagggttaaattcagtgtcctaacatctgtccttcagaaaggacccgtggcctgaacagatcttctgtgagaatggagcttggttttggcctggtagaaagaccacacagatctgcatgtgagtgctggctcacctgcttagtagctgaggaatgtttgttgttgttgttttaattgtggtaaaatatgcctcatacaaaaaatgtgtcatctgaatcatttttaagtgtacagttcatcaagcttgtccaacccgcagcctgcagtctacatgaggcccaggatggctttgaacgcagcccaacacgagttcgtaaattttcttaaaacattgcgagatttttttggtgttttctttttgttttttaactcatcagctatcattagtgtcagtgttttttaagtgtggcctaagacagttcttcttcttccaatgtggcccagggaagccgaaagattggacacccctgactcttccatggcattaggtacattgacatgatgtgcagccatcaccaccatccatccacctccagaatactctgcatctccccaaactgcaactccacaccctttcaacactcactgcccattctccctcccaccagcccctggcaaacaccattccactttgtttccgtgaatctgactgctctatgtacctcatataagtgggatcacacagaacttcttctctggttaatggtctgttgcacttggcataatgtcctcaagtttcatccgtattgtgtcatatgtcagaatttccttccttttaagggctgagtagtatgctgctgtatgtatataccacattttgtttatccattaatgtatcaacattgagttgcttccatctcttggttcttgtgaataattctgctgtgaacatgggtatacacatgtttctttgaaaccttgctctcaattcttttggatatatccagaagtagaacggctgggtcaaatggtggttctgtttttaatttgttggggagccaccatactgttttccatagtagcggccccattttacactcccacaagagtgcatacgggttccaatttctccataccctccccagtacctttttcctcttcacagtagccatcctaatgggtgtgaggtggcatctcattgtggtgtggatctgcgtttccctcatcatgagtgatgttgagcatcttttcatgtctcttggccattggtaagctgagtaatatttggtaaattacttgaccactcaaagcctcaatttcctcttccatagaatggggatagtatctatcccctagtatagcatctatggcctaagattgctgtgaagattaagttcattattctaaaagaaataaattgtttttggttctgtacactgttctaagcacaggtttgtgtgtgtgtgtgtgtgtgttttgtttcttgttttgttttgttttgtttttgaggcagagtttcattcttgttgcccaggctgcagtgcaatggcacaatctcagctcatcacaatctccgcctcctgggttcaagcgattctcctgcctcagcctcccgagtagctgagattacaggcatgcaccaccacgcccggctaattttgtatttttagtacagacggggtttctccatgttggtcaggctggtcttgaactcccgacctcaggtgatccaccctcctcggcctcccaaagtgctgggattacaggtgtgagccaccactcctggctagcactggttttaaattatatatgtatattctatattgtatatatataaattatttttatgtgtgtcacaattttactaaatatatacttacatgtatttatatataaattatttttagtgaatatatattttatatatatacacacacacacatatatatatatgtatatgtatatatatatatacagagagagagagagagaggcaaactctgacctgagaagctctataaagtcaacccacacagattactcacagagcatggctctctgcttattgcagcccgaaggcaacacatttaaaggtgaggcagacatacctaaaataattaacatgcccctgaaaaacagcagtggaattggtgaatttagaaaaccgaggcatccctcacgtctgaacacggtatccctgaaaaatagcggtggaattggtgaatttagaaaaccgaggcatccctcacgtctgaacacggtatccgtgtgtttttagcagtaatctcatgatgaatatcctgaacacagccttcgtgcagggtccactctccagcttagagattcattcccagcctacttcaaaggcagctgagactgtgtattggagtttctgttcaagacaacggtgtcttgttttcctctaaagacagattgtactttctcatgtaaatagcctttttgatagaatgcaggtgcttccagggattaactgctgctattaggctaggtggcccactctctccaccctgttcaaacagccagtgcttcatcatagtttatgtaactggcaacttagaagcagcagcctctttgatgagtccattaggaggtaggagaaggattggtagcagagaaatgaaagttcttgcacacaaataatgagtagaaaggatgaacggtggttgctggtgctttctgaacaaaatgagggcaaggggtgctgtccactaataagtgtcatttagaggctttattcttctagaaaaagggctgcccatctgctctccactgagaaggtgatttgccgactgttcctgaacgtgtgcctgggttgctaaaacttgcggaacgtgtatcagctgttgaaatggcctttcctttgggaaaactgtgcagacagcaaagagagtacaaaacacgaaaatcttaattccattccctcttctgccactttcagtatgacctcgggcaggttttctacctgcacagagaaaaactgaagtcgcacgctgctcttggttttctcagcctggagcagatgcctttgagcagctaccacttcccgttcccctgacagtgtgctccggctttacgaggctgtttttctctccacagtcaccaagtccactgtctctccacagtcaccaagtccactgtctctctccactttgggggccatctgtgaatatcactaacttagcattacagtaccaaaaataataattatagctaccacttgtgtacttactatatgccaggcactgtgctgagggctttgtgtgtcttaatgcattcaagcttcataacattcctatgaagtaaattattcccattttaattagttagttaattaattcatcaagacaggatctctttctgttgcccagctggatactgtggtgtgatgacagctcatcgcagtctcaaactcctgggctcaagtggtcctcccactttgacctcccacagtgctggattacaagcatgaaccgccatgcctggcccattctcattttaaagataaggaaaatgaggtacaagttgatagaaacagacagtacctcaccacctgcatggaggaatcacgtatttatggagtcctgaacatttaatcaacaactgttttattgagcatttagtttgttattggttgaaattaagaagactggtaaataccatgaattaataaaaagttttatgttaatagtaaacttgtttaggaaatctggttttgtctgacttgaaatattaaggaaatatgtgtaggtttaggtaagaatatatatttggtttaggactgttcatattaagttacatagtcctcagccttaattcacctcacatctccccatacatcttatgtctttttctttcttctttttgctattaaattacagcatcacctcttgatcactctaagacctaatcatctagcttgtaaattattcatacttttccccctcacctcactcctctcttttggattttatccatttatctgcatctctgagaataggtgggcaacagaaataaaaggattcagtgaaaataagttcattctgtcatttattagcaacttacacaacaggtttggcagaaaagaaaatgggaactaaaatagagtaattaaaaagaaagtcacttatttaaacattgcatatcttgctacctcttctaagtagaaattaattagctcctaacagctaactaatagactaagtggaaaatagaccagtgcaacatttggggttaattggtacaaatatattgattacagtaactagtcattaaatgttttataaggtatatatgctattagtataatctctgtatggacatcatctactgagtgcatggatgccgtaaacacatcatgcttagaaccaggcgtttgaacgctgtctggagtacttttacattgtagtaccctgaatgtacatgcctgtttgttatcactgggagggcagctcaggacaggattataaagagatggaaagaggagcaaacctggggcggcgtggagctgtcatgagaatggtattttcgggagctggggaagaggcagagaaggaagggaaaacatttaaagagggcaaaacatggacttcatccgttagctctacagacacggcccttggtagttaggcgacgtgaagccacgtgtactcaggcaggtagtggggaaggctgcttctccaacagatggagacagggaggttggcagaccgctggcttaggaggaagacagcagcagaagggttgcgtgtgtgaaggcagggtcacagatatttagaacgaagcccaaagtccttggagattggttggatgtgggaaaagagagaggatggtgaggctgagactctggtttctgtgccaggtgttgcatggacggtgagctattaaccggtgcagagaaagccgaaagagtaaggctgagccatctgaggtcaggagttcaagaccaccctggccaacatggtgaaaccccatctctactaaaaatacaaaaattagccaggcatcgtggcacacacctgtaatcccagctactcaggaggctgaggcaggacaattgcttgaacctgggaggcgaaggttgcagtgagttgagattgtgccattgcactccagcctgggcaacagagcaagactgtgtctcaaaaaaaagaaagaaaaagaaaagtatcagtttagcaatattgaaatgtgcagcactcaattattagctgtattcagcctgctgtgtaattgatctaaaaaaaaaaagacagatttattcttcctatctaactgaggctttgtaccttttgagcccagtgactccggtgccttgatgggggccgggggctatgacccaggctttgctgagcgatgagggagcgtgctacttctggggtcagggctggagggctccagctgcccatctgggctgccactatggaggagagctagacattgaccacccaccatacaggatgtgtttgcctccccctcactcacaccctggttgtggcgtaggtaaacacagcaaggctcagagggctccaggaacctggctttaagattgccattagcatcatttcctccttaaacaacctcctatttacagctctccatcgataagatatgcaatgaacaacttcatcaggttaaactgcagcaaatgtcaccacttattttgtcactctctgatcttggggggagaaaaacagtgcagcataaaatattgaactgtttactcagtatttagttcattcagtgttttcggatgcccgctacgtgccagcggggagtaaagatgagacaggcttagtccttctcttgagggatctcaccaagtgcagtgtttggtgacgcaggtcacactggggacatgccatggcaggggcacagatatcagctgggggagcagagatgaaggccagatacgaattcccctgcgcatctgaaagaatgcttcatagctttgaattagatgaactgtttataggaacggtaatccagaaacaagtactaaatgttgtatggtagggtgtactagaggctgtattatctgacctaggtttttttttgttttttgttttttgttttttgttttttgagatggagtttcactcttgtcacccaagctggagtgcagtggcgtgatctctgctcgctgcaacctctgcctccccagttcaagcgattctcctgcctcagcctcccgagtagctgggactacagatgcccatcaccctacctggcaaatttttgtatttttattagagatgcggttttaccatgttggccaggctggtttcaaactctaagctcaggtgatccacctgccttggcctcccaaagtcctgggattacaggcattagccactatgcccggctccaatctaactcttgattcctcctttataactattcatcagactgagcaacttggcaagaacctgactatcaaaaacaaattagccaggcatggtggcacatgcctgtggtcccagtgctttgggaggctggggcgggaggatcgcttgagcctgcaggtctagactgcagtgagctatgatcacgccactgccctccagcctaaacaacagagtgagaccctatctcaaaaaaacccgcaacaaactaaaaaaaatccccgatatttctgcttccctaatatgcatgataccagcagcagacagggctgctttgacacctgcccaaagtgtagctggacatctatgtagactcatggagtttggggagaataggaaggcgtcaaggctaagtacaggtcccatctctctccctcatccacttcccccaacctctggtcattcaccaagaaacgttcacagtcctgggctgcgtttactaactttgttctcatgcgtgcttctatttttgaggccagaataggccattttgaaacctctggttccagccttccccttaggaaagtgagcggcagagttgcgacctctctccctggtggctcatctctgggagacgagcgctgtcctcagaagtgacgtggaagctatcgtgacagaggtgttttgggtcagaaactttccattagtatttggagaaaattgatctcattggagaaaggaccatgatatgaacaagtcaggttttttttttatcatagtattttttaaaaaacgttctaaggagaagatttacatgaccactttctttctgacggatacttcttcctggatggaaggaataggaaaagtacataaaatagctcacatggaaaatatttttcctttgatgaaaagtgaaactaaagtagcacttgcaggatgcacttttaattcctgaagcaaaagccgctacttgcaatgctaagtcacattgacgtcccagtcctgattgggccagatttcctctttctttctcatcttgtgttagcatttaaaactgccaagataatgactatgttaattaatctggcccaggatattttccccataaacaggagtgtgactgagtaggtccctcgttccttctacgtctgcctcccgccttccctagagagaagtgaatctaagtcatgctggaaaggtggtgcctaaactgtaccttaagggggaaagggctaacagcccttctcccatagccctttcagcactgtgatcaatctgacccttacactcaatttgtctacaattgtatctctattagcaatgctgctctgagtctgttgggtggaagacatccaattggtgggttgtttctgaacactggaccagcccaaggactatttcaaggaaagtcagggtgagatttgaactgtgcgcacctttgcctgaagccagtctcctgtaattgactctgggacagtaagcattgcagaagacagcagcgtccctgatgttggaaggaagtcaggcttgcagtaaaagcttatccagagaaagaatgtcattctctcaatctgtctctccctctctctctcttgccaggaaagttccgttttgttagctctagtgcttaatgatttcagggttcacactgtgtccactctcaaaaaagcccattttcttttttttgagacagagtttcactcttgtcacctgggctggagtgcgatggcatggcctcggctcactgcaacctctacctcctgggttcaagcaattctcctgcctcagcctcctgagtagctgggattacaggcatgcaccatcatgcccggctaattttgtatttttagtagagacagggtttcaccacattggccaggctggtcttgaactcctgacctcaggtgatccgcccacctcggcctcccaaagtgctaggattacaggcgtgagccaccactcctggccaaaaaaaaaaagcccattttccatgtacacacactcacatgtgcatgcaagtatacagtcttcctggcagaactggaatgagttaaattttgtccatttttattactagaattggctaatagggatccatagcttataatgcatcaacattaaaaatgaaattatattttgaggctcactgcatataaccatgtttaccctctgaaaagatattgtcctcccttgaatatttgacgcagtaaattatgttttggaggaatgcttaagttacctatgaagtatccatttttttaaatgttggttttttctattagtttttaaattaaatggtacatgcgcataatttaaagatctaagtcatttgataagacttgatatgagagacgccagcccaacactgtgaatgcagtgaggcctttcctcctttcccaaggctcattaatattcatctccctattttaacattcttaggttgctccttcttgatttacttagttaaagtttcctattacagcagttctcaaagtgtgctccacagaccatctgagtccctaagaccctttcactgggtttatgagatcgaaactattttcatgtaatactccgacgctatctgccttttttacggtgttgacatttgctctaatggcgcaaaggcaatgatggataaaactgctggcttctcagcatgaatcaaggtggtcacgccaagctatgctggtcatgctattactcattgtcatatatttggatatttggagggtttttttttttttaagaagtacagtgttacttgagtttattttattttattttttatttttgagacagagtctcactctgtcgccaggctggagtgcagtggtgcagtctcggctcactgcaacctccgcctcccgggttcaagtgattctcctgcctcatcctcctgagtagctgtgactacaggtgcccgccaccatgcctggctaatttctttgtatttttgtagacacggggtttcaccatgttggccaggatggtctcgtgatccactggcctcagcctcccaaagtgctaggattacaggtgtgagtcactgcgcccagcctacttgagtttatttgatgaggcagtgaaaataattttattgaatcaaaaaatgtatgttgacatgtgaagtacttgggtggcataggatggtcagttgcattagttgcaagctctactagcctttccccctctgccagtagaatacatttttacttgaaggaataacaaaccaacaaactatggttattgagaagtaggtattatgaagacattttctcaaaaggaatgaaagtttgccacttaaaggaaaataactaatggttattttcctttggtttgtttattaatcataaaattttggcctagcatgatggtacatgcctttagtccaaaccatttgggaggctgaggcaggaggatcactcaagtctggggaagttccagaccaacctgggcaatataacaagaccctgtctcaaaaaaaaaaaaaaaaaaaaaaaaaaaaaaaccaccataaaattttgagctttcaattaaaagataaaattttgaaaacttgattctactaccatgggcttgaaagctttccaatactaaaatatttttctggtaagatttgtggtgatattaacaaatgtgattttttgatactatattatggaatgggtcaacgtctggaagatacagataactcagtaaaccagtattttccaaatgacctttgcattatgttacaaaatcttgcaacataagatccatacaaagtacaaggtagcctaattgattttagtacaatgtgataccaaaagtttattaatatatttaatagtttcagattgctcatttcagtgaaattttaagaaactaccacttgttgatttttagtgtagtttctaagaacagtgtacacagttatctgaatactcctattcaaatactcctccatattccaactacttgtctttatgaggctgggttttctttagatatctcaacggaaaccacatatccagacataagccacataaccaaaataatataagcaactcattaaagagatttgtgggctggggatggtggctcacacctgtaatcccagcactttggcaggccaatttgggaggatcacttggggccaggggttcacggtcatgccttccaagatcatgccacggcactccagcctgagtgacaaagtaagaccctgactcaaaaaaaaaaaaaaaaaagagagagatttgtgaaaatgtaaaacagcaatgccacttttcttactaattttttgtttagaaaataattacatttcatacaatatttatgccaacatgtgatgggtttattattttaaaataaataaatgcatctatattttaaagttttcatttaatttctagtatggtgactatcaataggtatatagtgtatttacggttgctcttatgccagagcaaccagtccagactggagcagatcaggagaccctgggaaagaactcttcagaaagatggaatgattcttataactcctatgctggaacatttcgagagcagagttacagaacaagaaggagagttttggatggaattcccaataaatacatagaaaacaaagcaaattgaaaaaaaaaaaaagataaaaaaattgaaccatgaaggaagagctctctggggctctccgtaatgtttaagattatgaagagctcctgaaacgaaagagtttgagaatcaccggccttcggcgtaattacgaaacatgaaggggtagttctctttcgccaccacccaccccaatcctacgccacagaaatattcacttcttgtcttcccattgccctaacaatttgttatgatttgggttggatcaatattctatattatgatttatgtaaaggttatataaaaatattactctgagtacatagaggctgtttgcagctgagctgtgtaatgtggcttttcatttaaatgtacaaaagggatacattttttgataccttggatctgaaatatctctctaatttgccttaacacttgatggttggtttttggcttgatattagagttctaggttagatgtcattttcctcagaattgtgaaggcatttctctatggtcttagagcttctgatgttgctgttgaaaagtctgaatctggatcatttatgtaacacatctccctctcccttcccctttccctgcccgttcctctcctgaagcctgtctctttagtgttgagaaatgtcacagggatgtcttttggcgtggagctaatggcatcctttgtgctggcacttggcagtcctttcggtgtacaaattcatgttggcctgttctatgaaatattctttaattattttttaacactgtttttcctttcattttcttttttattgtttttgtaactcctattatttggtgttattgtctagtttaaaaattttggggggctgggtgcggtagctcatgcttgtaatcccagcacattgggaggtcatagtgggtggatcacctgaggtcaggagttcgggaccagcctggccaacatagtgaaaccccgcctctactaaagatacaaaaattagctgggcgtgatggcagatgcctgtaatcctagctactcgggaggctgaggcaggagaatctcttaaacccaggaggcagaggctgcagtgagccaagatcccgccactgcactccagcctgggcaacagagtgaaactctgtcttaaaagaaagaaaaaaaaaatttgtcttttctttcctatttgtcaaactttgtaaaaacttcatcttgtaaataattggttgagatgttcttttctgctgtaataattttaatttccaagagcttctctttgttgttactttgtctctgcatcttccttttttatggcattctgttcttgcttcatggatgcaatattttcattgatctctcagaatgtttgatacttggttttgtttcattctgtttcacttttattcttcctgtattgtttctccttccgcaaagatggcttctgttgttttgttttcttctcttttgtatcatatgttttcctcaaatatttggtgatccttggctgactgattgtaatttgggagtgagacgcagaataactcaaggaggagcatggaagggattggtgagtgtggtcttacctgtgtggtgacttgaagaagccattttcttccgtttctttaggtcttttcttttgagttgttgagatctcccaggaaagactcttctaatttccagcttgctgagtgtaaattttggctgccaggttttgggagctaagaggaagaagacaagggagatttcaaatttagtgtgtaaactttgactcagcccccttgtttttggtttcctgcttctaactgaacctagtgtgttctagcctagatgccctgggtgttattctctccaagaacaaacctttaatctctgccagatggggaggtacagtcacccagctacctgggggaggggaaggggtcagggattcgaactgcttcttaaacagaattgcaatcagtccccttggacttagctccaccgttgtcctcactgcctgcaatatctggggccaccaactcttgagccttttgggggttttgaggtctgaacggtgttgtttgcagctttgcctatcactagcttgagactcatctttggatctgctaagtcagttactgctcacctgtcttggctccagctgttaaaatcctgttgcagtttcttcctctcccattttctctgtcgtcgtgagtttctgccatcttaaaaattctttattgtcattttattagggtttcaggagagagcagtgctccatgcatgtatttaatccactaactttaaccagaagtatttttttaaacatttggaaagcaggctgcgtgccgtgactaatgcctgtaatcctagcattttaggaggccaaggcaggcagatcacctgaggtcaggagttcaagacaaacctggccaacatggtgaaatcccatctgtactaaaaatataaaaattaaccaggcgtggtggcacaggcctgtagtctcagttacttggaaggctgaggcaggagaattgcttgaaccagggaggcagaggttgcacagagccaagattgcaccactgcactccagcctgggcagcagagcaagactctgtctcaagaaataaaaaataaaaatataaaaatataaagcattaaaaagtaccttcaagtttttttctttctttttttttttttttttttgagatggagtttcactcttgttgcccgggctagagtgcaatggcacgatctcggctcaccgcagtctccacctcccaggttcaagtgagtctcctgcctcagcctcccgagtagctgatattacaggtgctcgccaccacgcctggctaattttttgtatttatagtagagatgggatttcaccatcttggccaggctggtttcgaactcctgacctcaggtgatcacaccctccttggcctcccaaagtgctaggattacaggactgagccatcacgcccagccaaggtgttttcttagtaggtgaaattactgagttagaagcatttattcaggacctactccttcttaaacaaagtcattgttttgtttcttcattcgcctatgtctgcaatattatagagctagttcaaaagtaagcagtttgattttggctccaacattgagcaatcataatgtaatactaggttcaaatgtgagtagatttgagtgcatgtcgatgttgaaaataaactcactattggagtgttttaggatgctctggctttccaggatggatattacttaggagtaggttggctctgggttttttcctgggttcttgatttgcttgatttggttcttatataatctattctttctttccctttccttctccagaaacagctcaaattatgaaataactttcaaaaacaagttaggtggtagtagtggaggtagtgaaggaaaacagggaactttcctgttcgctgcagagcaaaccaggtgccacgtagaccttctcagatgccactactggacgcagccctctagacctgaaggtatgctggatagacccggatagacccggcggggtgctgagcccaagcgtgtgccagggtgggaggatttacacttcagaaactggcagatgctatgaaatcagaaccttttttcctggcaagctggtatttaaatcttaaccagcatgcttctgtctagacctgactttactcttggggcaatctgatataccccccaaagtgtcataatcacgtcagcctacccgtatgacattgtatttattcactgcactgtgagctccagggagtccaggtgatagaataggcaaagggcaaaatttggagccagacagcctgacatttacatccttccttggctacttctagctctgtgacctttggcaaacctctgaaagcctcggcttcagtttcttaatctgtagaacagggggggaaatttcttcctagcgatggtgttgtaaaaaattcacaactgtggcagcctctgctctcccaaaaccatgtcctctagaaaatcctggctttatggagtaggttcctctgtggcctgtttctgtttggcagcaggcttgtgacgtctttgcttagggtccttatttttataacagaatactgactttttgtttatatggtttccaaaatttatgaagccactaatcaaaaacatgggatcagtgtacttcagactcttacaagggaatataatgttagacagacttctctccggtgctccaaatcccacaagaggaacagttttgttaaggggcagtcatttaaaggatgactcacaaattatctgtctattctaagttatacctttgaataaaattaaaataccaaataaaatatgtatgcattgggacaacatcaacataatcatttttataatcactcaaaactgtgtcttaatcatatggcttcaaacctttattgcaaattattataagaaatgctgtctctactaaaagtacaaaaattagccaggagtggtgacaggcgcctgtaatcccagctactcaggaggctgaggcaggagaatcgcttgaacccgggagacagaggttgcagtgagctgagatggcgccactgcattcctgggcaacgacaacagtgaaactccatctcaaaaaaaaaacaaaaaacaaaaaaaaaacaacaactatttgacttttgctttagcgtctgctatgaaccatgaatatagatgccaattatccattacatggttcagttttcctggcttacactgccctacacaagacatctgtccttgacacagggactaaccttgtctctcctaaggaattagtcatttttatcctcttagtaaggagttgtgaaatacatgatgtttccctatgcacctccgtgccaggaatgttagaatcaagttttgttatcaatcataagaactgtctaagattttcatttgacatgctacatttctactcctttttttttttttttggaaagggtttcactttgttgcccaggctggagtgcagtggcacaatcacagctcactgtagcctctaccaccctaggctcaagcaatcctcacaccacagcctcccgagtagctgggactataggcatgcgccaccacgcccagctaatttttgtattttttgtacagataggagttttgccacactgcccaggctggtagatttctcctcttgatcctgttttccacatgttcatttttttttttctttttttgagacagagtttcactcttattgcccaggctggggtgcaatggcatgatcccagtttaccgcatcctccacttcctgggttcaagcaattctcctgcctcagcctcccaagtagctgggattacaggcatgcaccaccacacccagctaatttttgtattattagtagaaatggtgtttcaccatgttggtcaggctggtatcgaactcccgacctcaggtgatccaccctcctccgcctcccaaagtgctgggattacaggcatgatccactgcgcctggcccacatgttcatttctagcttgttaactttattgtatttaccatactctcccactttttaaactacagattccttgtagaaaaatgaataaatgaatgaatgagtgaaggaaagtcagtggcaataactaatgatgtttttaaaattgtgtagtaagtggcatagttatgagatttgggggatttggggctggatcagacagagaaaacagaaggggaacatgccagtgtcttcaaatgtttgagacactgtagtttggaagagacagcggacatgatttttattgctcctgagaatagaataggagccaatgaatagactatccattaattgatttgttcatttctaagttatttcttatgcacctgctctctagggcatgtggacgaggtccagatgaggacaagtttcctgctctcaaatttcttgcattttagggaagtaatttttggctgacttgcaaagaactttctaatgagaagagttatataaccatgggatgtgttgccttgtgaagtagggagctttccatctttggagaatctcaaaaagggctgaatgaataccctgaaaaatactactccctcgggagagaaggtggatttgttgacctctagggtttggctctactgtgcttccatgtttctcttttatttgtcagtttccatcttaaactgaaggattaggtcatttcagggagttctggaggtgaggtggtgggaagcaataaaaataccttcacaaaccagttcctttactctttgatccaggtggttcccacaggtcccttgacccccgataaagtaatcccggctgcctgcgacggaggtgtaggcagccagggttcatggagcctgtggttatctccttacagagagccttatcagcttgtggagccaccgtaaagcttgctttgacctttggcagagactcctcctgtatgtctgtccacagaaatgagagcaggtgacagacacctgggatgatcctgagacccagcacccaaagcccaggcttctttctatggggaagtcaagcagagggacccaagctcatagccagtggaggggtgggttgatgagaggcgagccctttaccagatgtgagcccagtcatcactctgcattttctacgcaaaagtccaggggcttgctattgaaattaggcaaagaggacaaagaattgccctctgtaaagtcctcaaaaaattataaattataatttttataaaatgatagaattctaaaataaaatttttataaaattataaattttatatatatataatttcctggaaataacttacagaaaagttgcaagaataaaaatagtacaaaggacacccttattcactgtactccgttagcaattaactattttttctggaccatttgtgagtaagatgcgtataccattagcctttatcctgaagctcttcgatgcatatttcctgggaaatgagatatgctgtcacgtagccagagtacacttatcagcttcagtaaaattaacattgatgagtacccttatggaatctatcatgcatgttccaatttgttttcagttgacctgataatgtcctttacagcattgtctccctccagtgaggggtccagtctaggatcagattgcatttcgttgtcgtgtctctttttgagggtcttttaactgtaccattattattgttatctgtcatcttattagcttattcaaagttgttagaggtatttcttatttagggtacatctcatttacaatcatcctttcgttcacttgaaaatgaaggctaggttctctggagtccagactcactccccttctatgtgaagtgttttcctgtgtatggtggaagggatgggggtgagaaattttggatgtacattatgtacatggttgacttttctttgtttgatttaaatcatacaaaaacagatcagatcctttgagatcattttcaaattccgctgttgtcaatccgacttattgccaaggagatcgtcccttcatccttgaggaggaagaaaggatcattttgagaatcttcgtttcatatcaagacaacacactcttctgaatctagaaacagaaatacctttacatttacttacagcccttatctcagcactttcatgcatcttatgagaagcaacacgcatgataattaagcatttctatgcatgcagagctttggttagcttggtaaagggtatgttcagcaattctggtccctgccctccagaaaaacttgcttaagatgcaccaatatgcattattaaatataataacacatcaagtaaaaactatgcctaacactcgcaggctatcatacagacttagaattattgagatgatttttcagatggtaacatttaatcacagagaagctgaataatttgccgaagtttactttaaaaaaaatcagagctacgataccaatgttcagtacctttctttcttagtataatcccctactttcaaaataacctttatagatatttctagtatctacgctaagaaaaagagtaatggtgaaagactgagagaagacactgctttttaaaggctatagaaatctggtacatggcttctttgaagaaaaaaaattaaatggaaggaaaattggctgctcattttctgagggtgcaattttatatagaagatatttcactgtggtctgtatttaacaagctgcggggaccctaaggctggtagatggtcagactggtaacattttctaatgtgactctgataattttgacataggctttctttttggctgccctaagtatttatccttttcacctgatttactttacattcgcctattttaccatgggttacagacaagaacaaattggactcttaaaatggcatataattttaatattttctgagtttctagtattctaaattcataattataacctgagggatgtatgcccacagggcataaaacaatcacatagatagtgagttttttttttttttttttgaaattaccttggctacttgaggattctctacacccctgctatccagcatgggggccaccagccacatggggctactgagcattgagacgtggctagtctgaactgaatgtgactggtctgtataaaatacatattagagttcaaagacttggtacattaaaaagaatgtaaaatatctcattagtagacttttttatattgattacatgttgaaatgataatattttggatatgcagggttaaatgaaatgttattaaagttaatttcacctgtttctttttaattttttgatgtggctactagaaaaccccaaattccatatgtggtttgcatttgtggctcccattatatttctgttggaaagctcagctctagaaggaaagaaaatacataaaaaaagaccaaaaaaaacccaactcattcagtgtattttagagtgaattacggaagggaaagctgaatagccaatgatcccattttttttcttgattaggtttggagttcattaaagcttctttaattaaatatattgtaaatctgcttcaagttcccagttgagatgagaattgaatctttttgtttaattttaaaaattctaagaaaatcctgaactcacttcaaaagcgacttgttttttgaaatctttgtaaaaagctttccatttacatggattggaggtctgattaatatagagttttgaaggggctaaagaggtgtgaaaattatccagaaacttctgaaaggacctttcttatctcacaggcatccagggagacataagggcccttagaagccgcagatcagccataagcatctgtgttcacagtttccttccaataagcaaaaacactgggagagataacatatttattcctaggtgtctataactgaatttatgggtgtaacttgctggatattattgcccttgtaaacccatgtaactgcacacgtaaagcatgtttttattagttcctacataaaatttttatgataatggcaaacaaaggaccaatttagtttagctgagtttgttcttattactccagcttccaatagataagcaacagtgcaaacagcaggctgggcgcggtggctcacgcctgtaatcccagcagtttgggaggccgaggcgggcggattgcttgaggtcaggagttcgagaccagcctggccaacatggtgaaaccccatctctagtaaaaatacaaaaaattatctgggcgtggtggcacatgcctataatcccagctactcaggaggctgaggcatgagaattgcttgaactcgggaggcggaggttgcagtgagcctagatagagccattgcactccagcctgggagacagagcgagattccatctccaaacaaacaaacaaacaaagaaacacacacacacaaaaacaccaccaaaaaaaacccccgaaacagcaacaacaacaacaaaaaaaacaccccactgcaaatagcagcagtcaacagggaagagagagtcagtgcttgcagggctggggctcctggcctgtgggtaaggaggattgaggctcccctaggcctcatgggactgcagtagggtgaggctgggctggcctgccctcagcttgcaagcctgttgttgagcagctgttctccacgttggtagctgtggagtattctaatttagcttctgaaaaggcttgcatagctagtattgaaagaactcccacttactgtatttcagctggagaattacagagaaaaaaggttcaagtggcttattgtaggtcatctcccactctgggatttaaacaaagcacaaacagaacaaagttcctttaaactgggtgccttcatctgagtccctcctgtctgcaaggtttggcaggctcgctggatacagagcccacgcctctcattctcactgctgcctttttatgtttgacccttggatgtggccaacgattcccatggtgacctggattggagggaagtttttctagaatttgaagataaagcatctttcataaatactgcctgttccttcccaatgactagttaaaaattgatagtctgtaaactagagtgagtgcgatccgtgaacccaaattcaggagacagagtttgacgtgtctaaatgtacgcaggggacaatagcaagaaatattttaagctgaatgagcctgaaatataaaagacataggattgttatagatatgtcatactgaaggctgccttggatggaaaatcaactgaaaaaagggcaagcttagtacacactaggtttattctgggctaaggccggtctaggacattcatgaaattacaacttagtgattaggggctatagtggtttagattctagactttagaagtatttacacatcaaaaaactcatggctgcgaagagttttcctcctagcatctgacacaactcctcattttgtaagtctgtactggagtgaattctagacagctggcttgttgtatttatttttatttttagaaatggggtctcactctgttgcccatgctggagtgcagaggtgcaatcgtagctcactgtggccttgaactcctgggctcaaatgatcctcctgcctcagcctccccagtagctgggactacaggtgtgcaccaccatgtctggctaatttttaaaaaaattttttgtagagatggggtcttgctatgctgcccaggctggacttgaactcctaggctcaagtgatcctcctgcctcagcctcccaagtagttgggactacagggacacaccaccctgccgagcttgactagttatattgttcttaaaggtttatagaaggaaggagcttctgtagcctccaaccccatttttcggatgcgttcctttaaggactaatccaatttgaggttctttattctatttcctcagtgggcatgtttactgatcctcaaatgtgcctttatatatttcataagctgtttctttgcattctttcccccaaaggagtagtttccattctttctgaaaaacactgcttgagcctcgtcccttttggaagagcagttctggggtgtgtgtgtgtgcgcgcgcatgtgtgtgtgtccacgtgcatgcgtgtgtgtgcatggggggtgtgtgtctgcatgcctgtgtgtgtccacgtgtgtgtgtttctttggcctcctctcaggctctgggggaaaaaaacctctactaaatcttaagctaagtacaaaatgtgtgcatgtttcactcttgccaacgttttagacttctggtgttaagccctgtggaaatgcaaatagcatagtttttaatacttactctaagggtactatttagggaagtaaaagttactctaaaggcaagattgatttcctgccctcatggaactgacctttcataatagatagcttgttgtccatgctaacaagggcttactacaagtgctacgtattctcaatttgtatcaaaaattgtagtttggggccactggcttctttttggagatggcctgattgattccagactctggatctgagaagctgacggttttgtaccattgccctacacacatggaaacactgcagacttcaaagttcctttgttttaagtgcggtggaatcatagttgaggggacagtgaaggaagaggacagactgagctgaggtgttgttgctgctttctctcaaaaggttgttaagagatcattcatttttgaggaattgcaacaagactgatttttttttttttttataaagcgtagagtcttttaactcaggattagatgaatagcttttcaaatgtgtatgaaagacaagaatcccaaaagattggctctattttaaatagcagactccagggactcaaggtttgtaacaaaagggcagatatggaagagatgaactcccgggtccaactctgagaatagagcaccctcagggctggggatccctgaggtgtcagggaatgccaatctcgctggttccggtttattagctcggggaatctcgttagatatcctcacaataagctagttggtattgactttgcctgacccatattataaagttctaacaagtggaaagtatagccaagctttgggaaatgccatagcatgcagaatagaagagaaaaccagcgtcttaaatgaacagaggagaaatttgagcagaaccaccaactggagaaattaggacactggctggaatgttacagccacaacaggggaaaaaagcagaatatttacttagtgaagacataatgagatggtacaattctctggtgtcaactttcacagaagagctttgtctctgtgctaatgatgcagagagcagggaagtgatgagaaaattgtatagacctcaagaaatccaacaacagcaaaaaaagaatttggagtttagttttgtatcttctgaggtccaggatttttccatctccctaaatttgagaattcaggttcaaggaaggacttggagaatagtcaaaacattactacacttcttaaagcattcttaatggtatttttactagtgaaatagaaaatgaaaacacacacatgtaaataagcatattttattaatcctccaaatgccctgggtaaaccagtttagaaaaccatcagatgcaaagtctgtcatgggtctggtgacgagattaggatcagtcctaattaggattaatgaaacagagtttcccgggaagcaactgtgacaagctgttctttgaattctggacatgtaggaatgatgtgaaagtctagatgatcagcctcatggagtaagggatccgaacctccaaagggaataggcagaagaacaatttcaaatatcttcataagatcagcccacaaatgtttgcctacccgtgtgcaggtttgcaattagaggctttagagcattggttttgattcttaagccatttttatttgaggagaaagatgcctgagagtgtttttagttaatattccttatggcaaatctgtgattttgcaactaggatgcagagaggttaattgactttattaaggtcccacagctggtcatttgggtagaactgagcccctggcttatggctaacctacagagactctccctctctgtatttctaggattttcagtcatttcagagttctgctgtcctattgatgttgttttttttttttgtatgcatgaataagtgctgcaattaacgggctgtggcgtgaactaggggtgtgaatcaggatcactcatcccaccaagttgggcttctgtgtcttcatgtttccacatggaacttggcctggaatagatctaagggcttttccagctccatttttaaaaattgcttactgaattgtgtaggatttggtatttctgcagttggcaaacagaatacaaggtttggtgtcaagtcgaaactggaaccatgtaagccattgcattactctggaacaatcagctgactctgaaacaattcttgttcaccaatgacagtttgggaattttttcccagtttggtagggaatttcttttttgtcatttttgatatgtttgtatgtttttgcacaaaggccactcaaaggttaagtcggggcattttttagagatgtaatgggaatatctgtaaatggtcctgctttagactggattatgactttaggaagcacagggcacgttcagccgcatggccctccagtcatcctatgtgcagtctcacacgttccccactctggggaaattgaggcaaagagaggggagatgagtcgcccatagcctcccttgttgctcccaccaagccaggcccagaattagttcctaacacttaatgtaacgtttaccaggggcctgatgcctgacacaccctttgctaggcactaggattacagtgacaagttaatttggtccagcctgtctccaatttgggcatctccttcgtggctgtggtatggagtggctcagggtataatgcactgctggttgccttgaaagtttcccaagcattagccaagacttaggtgaagaacttggacatggaggtgacgtaggccctgggaagggactgcctaaagatgtatgttcatgggctccacagacaagaaagacatggcagattaaacatggatagaaaagggcatgatgtgtattagaattaaatgctgcagcagttccagctaatctaatttcagtctcttaatctcattgtctttccccttggcagcataactaataaacaatgccactctgcaacagttacataaagcacgtattcaatagtcaaaaattccaagctcttttcttcaaaggttaggtctattttttattttattttattacttattattatttttttgagacagagtcttgccctgtcacccaggctggagtgtagtggtgcgatctcggctcactgcagcttctgcctcccgggttcaagtgattcttctgcctcagcctcctgagtagctgggactacaggtgcgcaccaccacgcctggctaatttttgtatttttagtagagacaaggttttaccatgttggccaggctggtcttgaacccctgacctcaagtgatctgcctgccttggcctcccaaagtgctgggatgacaggtgtaagccactgtgcccggcccaggtctattttttaaatggataaaagaaagagggtggctcaattttgtgacagggtctttaaatttgtcagtttgtgcatttcatcttctggtgccccagagctctgagtgtagctgaaactcatgcccggtatggggaagaaccggggcagggtggggccctttagcctctgggtttggtttctcctctcctggaacctgtattcctatgattacttgccccatattccagagaattccagctctgcagctgtggctgtcgcatctcacactcaaactgactgagatgaacaattactggttttctctccccgcttcccatctctttgtgtacattgctttttgtttttctcttttttcttccttctcccatttctctctttttctttttgttcttttttctctctttgttccttgtttgccctttcttccccgaatccagcaatttgtcttactaccactatattgaattatgtataagccgaagcatcttagttcattcaataaagctttctgtaccctattcaccatgttaaaaatcaagtgaaaacaaagttttatcccttaaaaacaaacaaaactccaacaaccccaacccaactaaattaagtccattcctatttgtatacatctgttaattaatgtatgaattaatgtatttattagataaattccatatccagacacatcctatactggtaatactaaggagaacagacacagtccctaaggtcctaaggttgactatttacttggggagagagactgacaacaggcagttacaaagcaagacatgctgtaggccctgggattgcatggacagtgtccactgtcagtggagtcctgtggagggggtggcgctgatcattcagtgcggggaacaagtggtcaagacatgcttcctggggcactggctcttggttgactatttgggagtgagaaacagtggtagcctttgcccaatagaagagccgcccccaggtgattctgtacataggagctggcctaggagtagcctctggcctgaccctgacatcagggttgagttgattagggttgtgattccatcttgactactcagtctgaatttgctgagttgcaaattgaaagtgaaatcaattacatccagattcagaccatttgattttattttcatttgatcataaacatcacaaaacacgggatagagagagcctattgtgctcagttattcaaataatcctaattatgatcactcattcaaatgattcttaaatgattctttttttttttttttttttttttgaaacacagtcttgctctgtcacctaggctggagtgcagtggtgcgatctcagctcactgcaacctccgcctcctgggttcaagcaatcctcctgtctcagcctcctgagtagctgggcttataggcacacgccaccatgcctggctaatttttgtatttttagtagagacggggtttcaccatattggtcaggctggtcttgaactcctgacctcaggtgatccacccgcctcggcctcccaaagtgttggaattaccagcgtgagccaccgcgtccggccccaaatgattcttttttttaaaatacaatcttttgctgttagcacattttctgaagagggtggctctacttgagccgtacattctctggatgatgtgggcctgagctgcccaatatgaactcaagagtagcgagaaaccaagcccacaggccttatctgctccagggcttttccacctggcagacggaattgaagctcttactcgatcgcagttgtgcctgcttcacagggttgttgtcagtattaaatgtgtcaatacaaataaagctctcagaacagaagcccgctcatggtaagtgctcaaaagtggcaatggtgataatgatgatctatgagcccacctgtttcacatcctcaaaggcctctgaggctgaagctgatctcatcatgtcaactggactccttgtttcattatacaccctgactatgtcgctgaaaacaccccccaaaacatcactgaggaataagtattgagatccagcatacctgcaaggtgaattcacatgcatatgtgcaaaactgcaagcttcatggtgggaccatatcacctcttctaggagactctttttaaaaagcttgatctctatcttaagccacacatgttggaactaagaaatctaagggaggaaccccagatagagatgcagttggccctttgctgaatctcggtccttcctggagcaggcgggcagccctgcccctttatcttctggcaatacaaaggataaaagaaaacagttatcaggtgctgaggggccagatctgagccccgataatgggaatcctgaaacatgagcagcctcttctgtttgcagagtctcatcatgcaaggcagagtgctggaggtagggctataaattgagggtgaaggaaaggcagccctcctaggccctgcgtatcgccagttgtggaattctcttttgcaagaggtcactgagtcaaatgctgtggatggataattttatggccactaataaaatttatagccaaagcaagctaagataataagagtaatcaaacgtccagccctgggacataagaatcccatcctggcctggggtgctggctgggggtgctggacagcacagagaggagtttatctgtctgactcaaggccagcctcagagtctcagaggtgatttgtgtccacatgaactgcgaggactaggccaggtctggggcaagcttcagcttgggcagtaactgctgtttctctgcagacagcatgccaacagcagcaggaaaaagctatatcctatttaaatgcctaaaagcaaatcgtgagcctaagaaaagatctgaaccaccccagctctggaatactacattatggaaggaatgctaactggtcattcacgtgtgacttgccaggtgtgagggaagataaagaaggatgcaagtattactcatgcaagtataaagaaatcagatgacgtttaaccaaagagttgggtttgtgtgggggctttcccctgcccatctcctccctcttctccgagcttagctcctctctgagtttccttcccatcccagttcttcctcctgtaggcctggggcataggcaaagtgggatcttgtcactgaggccaccctgcagaacacacctcgtgacatctatagaggcatatcagtcactggaagacagaaaccctgggttcttggccctcttctcttgactcgggcctcaccgttgatggtccttatgaccacactctctaaaatggcacagcaggtaggtagccacgtggaacaagttgagaacaagtaacactctggtgttgtgggattctctctctctctctcttattttttgagacagggtctcgctctgtcacccaagctggagtgcagtggcacaatcatagctcactgtagcccccaaccacccaagctcaagagatcctcccacctcagcctcccgagtagctggaattacaggcgcgtgccaccatgcctgcctaatttttgtatttttggtagagacagggtttcaccatgttacccagcctggtcttgaactcctgagctcaagcaatctgtctgcctcggccccccaaaggcttgagccaccccacctggccttctttctttttttattgtggtaaaatatatataacctaaaatttaccatcttcaccatttttaagcatgcagttctgtgacattaagtatattcacattgttacacaaccatcaccaccatctaccaccaaaagaactttttcatcttcccaaactgtaactctgcccccgttaacaataactctatgaatttgactattttaggtacttcagataggtggaatcatacaatatttgctcttctgtattatttttaaataaaaactcttttgatgagataggtcagagaaaatccattttattgccctagtttttagtacattttattcaaacaagaacccagcaatagttaacttgctgcaatgtctactgagacgtctaaaccaaaacatgtcttgctgatgccagcttttgccctcttcacaaatcctgcttaggaaaggttcatgacactgccacagtaggcctgaccctgccagggaaaggcatcaccgcggttctgggtagctctggtgtgcgcgaagaaaagagacaagcagggtgagagtgaagtctaaatggatcaacaagtttgcctgataccttggagtcaggaagcacgggaagaaagagttgagtggaatagcttagtgaggtctgaggcctgcctgatccagaggagacactgacaaacacagacgctgcagaagaggaagccgtcccaggttaggaggcatcccagtgcttccctcctcagtgagtcatttcatctgtttctctgcctgcaaggaagaaataaacataactcataaaatgaagcatttcacctcgccgggggagtggcattgaagtgagaggcatgcatctgtgggtgtcagagcaagagtcctctgtagctgcttgtccttgacctggaaggaagggtctggtggggtgacaaagtgacatctgctccttagagggagcctgttcttggagacccctctgccagatacatttttatagtcagctccagaagtgacttgatgtggggattgagacatattcctgcagtcaaagactcatacatagaaagggacataatttttttttctttctctctcttatgagcaaagactgaataaggcttatgtggactctatcactgcatcgtgatgactggagtaaggtgccctccgtccatcatcgtcagctttctattctgtgtctgactgcagtggaacatcggcgtgatcaactctacattatttaactttgatccgggcgtgcattgtttgatcttttcctttgcagattgactttcataatttatattttatagaatacacagaaatgtattctggcatattctaagagcataacggctgacagcatagacacatcctaagacaatactaagggtttacaaattagctgtggatggtcttttccaagataattgtgagttgatttgtgctaacctggatcagaaatatttatcaagcactcactgtttacaaaactataaaagcattaagtaacagtgtaagtagcagatagcaataaaagatgtcccaaggcagtgagatattaattgtgtaagagaaaatgttattaaatgttattttctgggatttgaggagggggagcctgtcattaaatgtcattaattaaagactgagtaggaagcaattgctctccgtagatgtctctacacaggaaacggatactgtttggtgttccctgctgtcttggcagagtcagagggaggtagctttctgggtcaataatgccgtttaagatgaacgcccatgctgacacactctggtagctctcagagtccttccttcagtgtagaagttaaaggtcagcagcttacagattgcaatttgcattgtggaagcaaccttaggaagagccacacgtcttttatcttgattctgtggtcaagatggtaaccacatttgggattctctctttctttgggattctctctttctttgggaatgagtaccaagctcctcatactgaggtatcagtgtagacatttaaatgtggttgaaagacgtgaattaaaagttaaaatagaaggagaagctttatttcgatgtggcctgtgaaaagcagactttcactgctcgttaatggtgcacggaattctcatggacgttgagaatgtcacatgtacacgcacatgcacacgtgtcgacacctgcgcagacacacatgtgcaccctctccctgcagcctggccccttttgctgccacctgtattcattttcccaccaccccgagggatatgatgtgctgtttggaaagtaacagatatccttaaggagtgaaatggtcccctgtaatcaagatggagagctaaaaacaggtttcaatcagaactaaaccaaataaaatcccgtggtgaaaatttagttccccttaaagcttgtgattaggaccaccccgtgtgttttcggccactgcttttagacggtgacagtgacacatacacgtaacgaagataatgaggcctttccactagcactgtagggttttcaaacatgttagatggatatttggaggttttctcaggaagaatcatgtatctttcacagtatcgcaagagaagaaataaattcctaagagtctaacacgcagatgtaagccatagtcctttaaaaataaggctcttggccaggtgcggtggctcacgcctgtaatcctagcactttgggaggctgaggtggatggatcacaaggtcaggagtttgagaccagcctagtcaatatggtgaaaccctgtctctactaaaaaaatagaaaaattagctgggcatggtggcgtccacctgtaatcccagctactcaggaggctgaggcgggagaatcgcttgaacccggaaggcggaggttgcagtgagccgagattgcaccactgcactccagcctgggtgacagaacaagactccatctcaaaaataaataaataaataacaaaagtaaggctcttgattcagaattatgcagtgaggctcaagtttcaggagaacatcttctaatagtggactgcagggaggggctctgagggcagcctcgagttaggaagtggtcctgaaggggagagtggagggagggagatggaactgaggcctgacatgctgcacagaagccacctcagccgaatggatcagcatcccaaccgtggctcctcctcctactagctgatttcccttggggaaggagctcaacctctctgaccctcagttccctctttggtgaaagggttgaattgtcttggaatccacaggtgaccacctcaggactgcagtgagggatctgtatgcatccagtaaagcctgtccttagctctgtcttgtggctgcccacctggcctgggggccagagatggggctggagaaggggcaggcttcctccgggagctcatccccacacccagtggagttagcgtagccaaggcttccagcagagttttacatccagagtcatctttgttataggtagcagcaagaagcagtctctcctgggaagacttgctttgaagtgtggggagtcgcactgacttgtaggaaaggccactgccttgagatgaaattccaaagccaagaggaaaagtgctgttgaggaggtgggatgggaggtcaactcctcaagtccctcaaggaattcagtggaagccactcctgagaaccggctggaggtgggaagcctgaagaatgagggagttcacggtaggggcctgaggtgcgtgaggcttgtttgtgttggtctgagcagggctgaagccgtgggcccagggcctctttccttcagaaacagtcggaagtgaccaagcttcagctcctcctcctccccaggcctcggcacccaggcccggtgctgcggggctcacgtatgggaactgagaaagggaatatggagtcttccttctaggccccacagaggcctctttgacctcaagacttggctagaaacacattttggaagcttccgcatttccaagtcacagataatatttctacacacacacagacacacgctcttattttagagaagggacagaacatttgtctctggctgactacaagtttctttatctaccttcctttcaaatctcctgaggacagagactaagcaaagtttaccttttgtaatcccccaagtctgtctggtgctcaggttattcagtaaacttcagtaactgaggtcagatggtagaaggaaggggaaaaaaacgggaatcagaggcctgtgtttccagctcaacttccctacttgacggctgagtggctttggaccaatcatcggactcctctcctcgcctctgttttctcatctgtgaagtggaaacaatagccaaccagtctacataacttaatgttgtttccaatgtgccttctatgaggaaggagaggttatcagcagcaaagggatagacacatctgagggcatcccttatgctgttaatgactgtttaattgtcatagaatatggatcactgccattctttgcttgacataaaaacaactcagagacacactgtcaccgtttcagagagcttcagaaagaatttggattggagtgcttctttcatagccagatctcatgtagtaggtcattattttgtttctttgattaataggacaattcggttacaaccgaaggtactgtaaccctgcaaccctagagaggatttgcagggctgaggaagagtaaattcctattagcaagtatcttggtggcaagcaagatggcaccttggtaagaagttatccatccaactcagcactccaaagacctgcataccagtgtatgcgggaaaaaccatagccggtctaacagggaggcgccttctcgctcagaatcatctacaatggatatgattgtaattgttgaagaagctacagctgcttctactgagagcaagcctcgctcttctgtttttcagaattataaaaatggagctaaacagagataatggaagttgcttttggagcactatcttgcagactgtctttgcacaagatattgacaggaaatgtctgcacgtttcttagagcctcctgaatcttcagcatctacttttttttttttttttgcctgacatataccaagcacccaacacatggttgttcatacgaatgaatgaacaaatgaactagtagactaaaaaagaggcagctcttgatccccaaacattgtggagccaaaacactatcctttgacagtgatgaggatgggagaaaagactgtcatatcttaagaattaaacaaaataggccaggcgcggtggctcacgcctgtaatcccagcactttgggaggctgaggtgggcggatcacctgaggtcgggagttcgagatcagcctggctaccatggagaaaccccgtctctagtaaaaatacaaaaaaaaaaaaaaaaagttagccaggcacaggggcgcatgcctgtaatcccagctactctggaggctgaggtaggagaatctcttgaacccggaaggcggaggttgcagtgagctgagatcacgccattgcactccagcctgggcaacaagagcgaaactctgtctcaaaaaaaaaaaaaaaaaaagaatcaaacaaaatagaaaagcaatgaaatgttttaaagaaatgactcttacttaaaagacttaagaaaatttacgtagatacacgtgagcagtagaaagtaagaatagctcagatttatttcacaaacatgttttgagcatctttgtgtgccagccattgtattgaccttggtatacagtggtgagcaaaccagccttagacctagagacctggggcttttgtgtagtgggggaaaatgacttactattaaatgcatgatatgaaccgaagtggagatactgagggaaaagattgaggctctgtaaaagcatccagcagaggaagcataggctggaagaaggcttctcggaggaagtgaggcttgagcttacatctgcaggaaaagtgggagcattccatatggagagcaaaggccccacggcagaaggagcaggaggtgtgtttgaggaccttgcccgaggctggagccctggagtgtgaaactgagggggaggtaaattagcagttcctgtagccaaatcctggtctgttatttctgaaagtctgtcatctctgaagaggatactgggcataaatacaaatgagaacatgatcttttaggtggtgagagtctatagagcaggcatttggagggatgccctctccccattgtggaactagcagaacaaaatctaaagaatgcacaaaagaaaccaaaaaatgagctgttaggttctaaggagggagggagtgtgatggaaagcacaccatgagaaataaggacatggacctgcccccgccccatcatgacactggctgtgtctgaaaaatggagcaggaaaggcagcgtgactaggaaaatgtgcagttttaattttacataatatttgtttttttttagaaaatattttctaagataaaaaatgctaacatttgtgaatagtggtagtggatacatgtgtatgttttattattggatttttttctatatatcacatttttttaattagaaggggaagacttttttttttcttaaattagaagaggggcagttaaaggaaggaggtaggtgctaggaatggtttaagagtcagggtcctattcctagatacaaattggcttgggcaaattgcttctctggtcttcaggtgtcttatctaaggagaagagttttgaagatgatgatgttggaaatcccttctagctctagaacgttctgtgatcctgatttttaaaaacaattgatgattgaatagttctatttataggcttgggaatttggtgtctcatgctcactaatccctgattctttaaaattaggagaaacaatcttgcttggcacaagatagccaatagctttctagtcaggaagctcgtgcattgaaattcatttgcccagagacattttcaaaagctgtgaacccacaggtcgctgacatcccttctggaccagatgtgggaatctggacccacccagaaagctgtgcctctgtgtcaggcatcctgccattcaccacacgcgttccagcggctgctctctggctttgcagggcacctgcaggacagtttgtgcataaggaatcccttccctccaaattttagatgagaaatatggtaatgaaaggaaataacccaggcagagtggcttgtttcacatgtcacggtgtgtcaaaatcagatgtatgtcttagattcttgggggaaaaaaaaagttgtcgcatgaatttgggggttttgttttgtctttggacatggtccgggaggcatgatgcgcgccctggagcttcatcgatgctgttgagtggggatgacggtgtgcatcgccacatcctcagctttccagttgtttcagctgcgccctccaagctgccctgttccgcggggacaatagcagccagtggacgggagcccgcaccacacagcagcaaaggaagccggaggagaggctctgcgggctctctgctccgtcagcaggaatgtcctccgggccagcagctgcctttgcagccacctctccagtttctgtcacttgggtcaagtttccttataatgcgttaaatgaatgagaataagaaagtgtgtgttggcagaatttccgttgaataatgccaaggctttccaagtaagagcatgaatttaagcggagcaaagttcccagtcaatgggattcagagtaatggctattctgctaataatgaaaagtagaaatgtttttacttttaaaggttcacaaatgggctactcttagggctcgctggcctattcagttacaaagtggaaactgttccggatctttgctttattgcacttgtatttagtaggtgattggaaacattttccacttagcatttaagggtttgaatagactggtgactttttttcaactaaagtttcctcttttttaaaaaactgacatttttctttttttgcaagtagactgaagatttcaagtaacaggttttccaaatacttagactctgcctgcataattattatatttgccgtggggattagcacttttcaaaagtgtatttctacacaacatccttgttttgccccaaagtttgattcttcacagcttattacgtagatttaggcaaaatggaccgagctccatccactagaacttccattataaaggcaatcatttcgaatgaaacagaagccatttatcttaatgaaccagcaggaaaatgaagtctgttgaaatgatctgaacccttcaaaaaatattggtaattcattgtggctatatttatttttattagtttctctatgttgcctgttttattgactttccacagcaaaccaccacccccaccagcaccaccaaataccgttgtattttgattccttatgttctttattagcaggcttacttctctcttcatagaactatgcctttgccccactgctccatttcagagcattcggggctattcctggtaagaagccagcattagttaatgttactgttctggtcttgggctgcaaagagtgcatggataatggttcatgttttcccctccaaatggagggaagacacagacataattgaaacttacaatgtcgggggataattttataccattatttttaatgaaaacggggaagtatcctagctaaaatgctggaaaatagccttccagtagccctaagcatccacgtgtaactgaatgcaggtgggatagaaacctgttccctcttgcctccctcccccaaatagagagatgctgtcagtggtcaggaaaagcagtgagccacaggtaatgagctccgtatccattttctttgtcagatctcccagctgatgacagagagtagccgggagggactaacagaagcagtgctgaaccgctacaatgcagacaagccttccgcctgcagtgtcccagcctcgcagggctcctgcgtggccagcgagacttccacaggcacatcggtggccgcctccttctttgcacggtaagagagctgttcagatccttggttctttccgatgagcccagctggttagcccctcacgtggactagctcagctgaaacactagaaagagtttggggccgttctgtgatgtcattcattaagacagagtttctcagccatggcactgtgacctctcgggccagctaactgtggtggggactgtcctgtgtgttatagggtgggctgcagcatccttggcctgtacccctcgatgtgtgcccgcagtaccctcctccagtcgtgactaccaaaaatgtctgcagacattgtgagaggccccagggtcgagagtcgctgctctcttgatgtgtagctccaaagatgctcttttgcagcatcaggactttgtagaggcatccctctggtgggtgtttccagatttatcttctcattacagaaattgaactgcttaaaagctattaaatagatggcaggttttctcccccgcttcttgacagattagccagagtgttatcaaatactctccagctaatcttgggaacttcaaaaatacaagaaacaaaaaagaaaggtatttcaacaatgttttctgcctaattttagcaacatggcagagacggggcgggagacgaaggacagctgagcaggaaaggacttcagggattgtctggttccatctccttatttatgaatgaggaaaccgaggaccaggaaggttcaactaggagtgagtttatagcacagccagaaatagaaaccggattgctctacatttttctgtataactcatgttttaatttaatgctcagaactgaaccttggaaaactttctctgtctaagatttgcaagctcctgagtaaacaggacatagaataaatgcgatagcatcagatacgaaatcacaagaccttttgggttccagttgcagcagttctgcctcagtttcttcatgtataaaatgaggatgatacctgctctgcagggtcgctccgaagactaacataagatgatgagaaattataaagtactgtagaaatggttactactatgtcagtaagaaggaatattgtgtggctttgcttgttatctttatgaatggtaacatccagaacacaaatatggggaaggggctctgattaggacagcggcaaggcagaggaggacagagggctaagaccctggatgatgggaccctaaaggcagcacacagggcttgttggaagaccggctttgagggtcttcattgtattttggtgctgtgtttattgtcgtatgaacacttgggacaacttgaatgtgtgggaagtaataggaaatatgtataggctggccacccaacaatggggaccattgtgttagccctgtctggacatgaatctctgtgttgtcccagaccattaagcagggagtccaagctcactgggaggtcatgtccatgccatttagggagagaataaagacagggaacagttatgaggaaatgtcacaagcacagaagctcctaggaggttattagaacatgttcaaaggaggctgactaagaagccatggcatggcaggttcagtttggagaagagaaggactctggggtacatcatggatgccctcagctatctctcaggctattgtataaatggagacttggttcgttctgtagagcaaccagttatgtaggcaaaggctaaataacgagggaggagacggacctcccagctcagaatgaagaacttgcaattccgatggcttcaggagagagtgagatttgtgtccctaagggagatcaaagttatgttgagtaattacctggcctcgatcctagagggaacattcaatgctcagatgggaattgacttccgacgtgcctttctaacctgaaattctttgaaagtggagtcttccgttcagttccagccagagaattttacagaaggttgactgactcacaaggcaacccagaagatttgaagcaggaagaaataagaagtgagggttcccaattggcagaatttaaggagaacatgagttctccttaaattcttggtgcgaggaaaccagcagcgtctttggagctggggaaaggatgtggaaatgaggggggcctgggaacctcatagtactggacaaggtgtgcctgaggccagaggtcaggatatcagaggaggatttacgaacaagcaaacacacagcagggaaaggaataacaaatcactagcgaaagcctagggtggaagggagatactgaggcaaaacccaaaatgtatgggccagtgatgtcaactggggcaggctctgcaggtgatgctagcagcaaacaaagacttgaaactcatgacttcagaacgacaagggcttgcagtatgagctttcaaagagctggaaaggatccctaaggctccccaaatctttactattactttctgtgcagtgaacgctgatagtacttggagcttcatggtataagcattaaaagtatgtggtttgtattcaaagggtttacaatgtacagtgggaaacaagtaccatgtgaaaaagaacaattctttctatagatttcccccccaccctttactcattaccatattttgccatgttattctcatcattattgatgagaactattattagctgggctttcccacctcccagcgagggaggcagcatattaataacccccctgtcactgaggggcacccaaagcagaagtgtgactgactggctccaggctcatcctgtcaagaggcagaaccagggatgtacctgacagttaggtccccaaacgtccatgtgataagccaaaacctgcccagcttatgctgtcagacagtcaactgagttcaaagagccttttggttttagctgaagcaaagctgtgtaaggggatggtaatgacagcttttgataagtgtctgtcctcataggggtttggggcagagtcagctcctacacctccaatctgtgctcaccactttccactcttcctgcttgactgcaatggagagagagtcctctgagtctgcggggccctggaactctcctatagctccaagtcaagacacaggggtggcctgctttcaggaagctgtcctgggctgggcatggtggctcacgcctgtaatcccagtactttgggagaccaaggtgggtggatcactagagaccaggagttcaagaccagcctggccaacatggtgagaccccgtctctactaaaaatacaaaaattagctgggcatggtggtgcatgtctataatcccagctacttgggaggctaagacatgagaatcacttgaattaggaaggtggggtttcggtgagccgagatggcgccactgcactccagcctgggtgacagagttggactcagtctcaaaaaaaaaaaaaaaaaaggaaagaaagaaagaaagaagcaacagctatgctgggggccatttcgttttatatgggagggatggcatttgctaaatttgtggccaatgtggctgacgtatattgagcactgagtgggcatcactcactattaactacctcttcatatgcaaacccccttcatcttcacagtaaccctgtgaggcagagcctaccattttctctgttttatggataaagaagatggttccctgagttactgacccagagccacatagccgggagtggcggagtgggaaatccatcctcgtttcctctcacttgagaccccaggttcctattctctgtgctaaacagacacaggaagacactttattatagggttttttttttttcaccgtaatcatgaactgatgattgcttataaaacaggtgtgaaactactaggccctgtaatttgtttgagaaggtgagtagaatgacaataacaaaaacaacagaaaaacccccaatttgttgaagatttgaagcaggaagagataagaggtgacacatttgttgttgctcttgaggattcctacctttacacggtgttttcctgttgacgaaaaatatgtctatcctgggtctggaattttctggataaatgttggtgttcatctccatatagcgtcgctctcattcatgcagatgtccacttttctctgtgatattaacctttatttaaaatgtatttatttttattttaaaatcttttttttgagacagaatctcactctattacccaggctggagtgtagtgacgtaatcacagctcactgcagcctcagcctcccgggctcaagcgatcctcccacttcagcctcctgagtagctgggaccacaggaatgcaccactgtgcccagctaatttatttttattttttgaagagatgagtctccctatgtttgttgcgcacgctggtcttgaacacctaggctcaagcaatccttccaccttggcctcccatagtgctgggattatagtcatgagccactgcacctggcctaaaatttattcatttatttatttttgagatggagtcccactcactctgtttcccaggctggagtgcagtggcgcgatctccgctcgctgcaacctctgcctcccaggttcaagtgattctgcctcagcctcccgagtaagattacaggtgtgcaccaccacatcagctaatttttgtatttttagtagagatggggtttcatcatgttgcccaggctggtcttgaactcctgacctcaagtgatccacctgccttggccccccaaagtgctgagtattgttttgattgactaataaacattgtatatatttacggagtaaaatatgttttgaaatatgtacatattgtggaattagcctgtgtttttaaatgcttactttctagaactgtgggtggaggtctgggtgaaccttgttacatttcaaattcaatgcctataaaataagaatttcaattttgaataagcagtgtgtggtctgtgctggtccacacacggttactggtctgtgataagtatagaaatggagaggaagcgtttagaaacatctgctgatggaataattttctgtctgttgaatctaagaataaaaaatcggggcttgcattttgtgtataactagaagtaaaagaaaaattggtccttcacccggatagtttgagatgcactgctatagagaacgatggagcatgaagcacctgttctgtgcttttcttcctctcacgattgtctttaaatggtcagcatcttagtagctgtctttgcttcagaatttcagtaccttccctttttttttcgagaaaagacactgtttctggaaaaaatagtaacagtcacccagaaaagagatcgagacaactgatcgtcaagttggttaactattatgtgctggctttgaacatcaagaacatttcaaacgagggccttttttttttttttgcatgattttcacattaatagaaaatggtgaagtagggtatcattagattttcccatttgctgacagttcactttgaataaaggtggacttaatgatgtactttaccttataaagtatggagtacatgaaacccaataaaaactcttgggtgaaaccctagctttgtaggttgaggcagtggaaccttcatgtatatttgaagagcagttagtggattctggattatgcatagaattgaaccctgaaacagaaaatgaatcttttgggtgacctcatatctttgcattgattttctttcccaaataaccattaaaactcatgggttttgtttttgttttttttgagatggagtctcgctctgtcgcccaggctggagtgcagtggtgcaatctcggctcactgcaagctccacctcccaggttcaagcgattttcctggctcagcctcccgagtagctgggactacaggcgtccaacaccacacccggctaatttttgtatttttagtagagacggggtttcaccgtgttggccaagatggtctcgatctcctgacctcatgatcctcccgcctccgcctctcaaagtgctgggattacaggcgtgagccatggcgcccagctgtgtttttttattcatggagaaaattagcttctgtagaattttcatctacattcagagcaagagtttgaaaaatggtgaaaatggacaaagatcacatgagcacaaagacactgtcaagttttggcagagctggtatcgccagttccatggcgttggtgagcacagagacttccagttctgccctcagacatcacttctaaattgtcatatttttggtgttcagcttttatgtttagttgacagcctttctaccaaattctaatcagatttccaagtaaaattatattaagggcattttttattttccgtgattttatttaaattttcctgttttcttaatataaacaaatacctttccattctgttatctcaggttctgatgacttcagatcagaacttactatcttcaaatcctttattctgtttttttgctcattattgactctgttacattagttagagcttctttctctctctcccccttcctctctctccctccctcctccctcccttctttcctcccttcctgtttttccatctgctcttgaagattcctacctttacacagtgttttcctgttgacgaaaaatatgtctctcctgggtctggaattttctggataaatgttggtgttcatctccatacagcgtcactctcattcctttctctgggatccctgttgtctgctttctcttccacacttgccaagctgtccctcactttctcccactgactcctctaactccttgccgtcggcccaaacacattcctttctcaggacgtgattgtttttctgtccatctcaatctcttgtgtggtatcttccatcgttgtttttgaatggctccctgtgttacctgaacagcattcttcagtcctcttgagcatgtcactgactgttgtatgactgatttgaccagtatccccttgggtccagaggttgccgtagtgttaaaaccaagccccgctcaggccctggggtcagggctaggctgagcagagaggactgacctctggctcccaggccctgccttcaggaccacgtggcttctcttgttagttccctgtggggcctgctcttcgtgctgtgtatcctcatgtgaccatacggagagctgttactggtctgatgaccattattgccgcactctcgctgagaagcaactcagatagcgccttgctgtgatggtttcagcaaatgcttttcatatatgatcttgtatgatgaaggctttctttagtccctgggcccttaacagtggtacttggttatatgtttggagttgatgaagtcagagaaggatgggaaggagcgtggaactgttcctgcttcttttgttcttctgtcaggtacagttccctttagggatgctcccttcttccccttagaaatacatcaacaatattaccagagaaaaactaccctaaacataccacaattggtctcaggtgatctaggcggaggaaaaattgagctgggtgtctgagatccaactcctaggcgtcaattgactgtggagagacagggcacaagttctgcctccagtttcacaacttggaacagttaatgtccagcactgtttccattatgatagaatgatgcctttacaaaaacaaacaggccaggcgtggtggctcacacctgtaatcccagcacttcgggaggccgaggcaggcaggatcacctgaggtcgggagtttgcgaccagcttgaccaacatggagaaaccccgtctctactaaaaatacaaaattagccaggcatggtggtgcacgcctgtaatcccgtctacttgggaggctgaggcaggagaatcacttgaacccgggaggtggaggttgcggtgagccaagatcacgccattgcactccagcctggacagcaagggtgagactctgtctcaaaacaaacaaacaaacaaagaaaaagcccttttaggagctcatattgtagaacttcactgtattatttttttttcctgtttcttgttttgttttcactgaagcatattttgcttacccttagttccttgcacttgccagggtcccgttctgacttggtgtctgttcttttctccttgccccagtgtatcccctcgttctcacattccagatctcagtctgcctattccaggacttcccatggaagcagggctaccattgagcttcctgtgggacacttgtggtcggggccaacatgcataattgtgccatctattcacagaaccagggcgcccaattgtaggagtgagtggggcttaaatccagccaacactgtgccagcctggtggaaccacctcctctggggctctgtcaatcctccttggatgcaggtaatgtctgggctcatgttgtcctggccggccctgcctccttcactggtggccaagcagtgtcaggacatagatctttgaagggctgaactggaaggcaaacccctaccctctggtttcttatttatttatttattcctgacaggtcgtagctttactctgcttagaaaatactccgttgatttcttggaaaagaagggactctcactcatgtatattgatgaagtgaatttttaggaatcatagttctatgaatatggtctcactttaactcaccttatgaaaggaaaacattaagaagcaaccaagggtatatttagtgccatccgatttcaagggccctagaaaacagtctcaggcatttgctgtgtgaagctgaacctcctcagttgcttatgagacagcgaaagcacagaaggaaaagtggttgtaatttaacgtctacactgttttcccttctgctaaaaacatgcctaaaacacctcaaatagataaccctaacatccaatatgcaaccccagcaacccccaactgttctgttgttgggggtgcagtccgtaacagaagtggcattcatagcttggcacacaccactctgagatggtgagctacgctaaagaaaatgaccagcgtttgcggccccttcccatcttctgctgcagggaatgtggtcaggtggagcattttctgattaaacaagtcctttgtctgactggcggccggttggggtgttggcaattggctcccaacatctgggaatcatttccacggctttgcctaggttgaaaactcagttcatgtcttgatgtgaatgtctgaaggcaaagcaatttcaacaagcctcaagaatcccagggattcttgtaagatactctcagggttaaggattctagttcttattgcacattttgcattttttgttttaattgatgctgtggtgggggcgggggtggggggcagtggttaggagagaaggatattgaataagcaaacagaaagctggagaagcccaggcttgaattctcagccagacactgacattctgacttgaggcaagtaacttaaccttgctaagcttccgttgcttctgttcaatggagatcatcatatctgctttataggattatggagaggattaaatgaaaatgtgatagtccttggtaaacttcatccaaatcctacagataatgtgaagatggcacgtgctataaaaaggatggagttctgtcctcaatgaattctcaacgttcccttttgagtagatgacttttcgttgagacctttacaggctgtttaggtggccctttgttatctgtctaacgactgtccaggccttctgtggcaattataaagatctggtatcatgtctctgagaacaaaaaccacctacagaaggagctgaagagcaattcgcccttaaatctcacctgttacgaactagatgccattggtgatggaaaatatcagtgacccatacggagagagaaacctgccctcaagtagctgcattttagcagagctccaggtaggtcactgctcacctctaaatcttctgaagaggtttcatttttttgttggtttttgttttgttttgagttgcagtctcgctctgtctcccagcccagattgcagtggcacaatctcggctcactgcaatctccacctcctgggttcaagcaattcttccacctcagcctcccaagtagctgggattacaggcacctgccaccacacctggctaatttttgtattttttagtagagatggggttttgccatgttggccaggctggtcttggacacctgacctcaggtgatctgcccaccttggcctcccaaagtgctgggattacaagcatgagccactgcacccggccttgttgttgttttatagccctagaaaaactggtaccaaacaataaggaagagactgaagggaaaaaagaagatggggaggggctttaagaattctgttcccatagaactttgtgactcactgaaggccagcaagctggaattgtcgtgatactcacagtggacattaacgaaaacagtgaataaaagtaaaaggggaaatgttctttctttgtgaataccctcgtgatctgaactgggggctgaagagggaggatggggtgacatggagtagattcaggaaaagcagagtagaaacctgtgaactgaaggagaggaccaatggatgaggagaggatgcaattttatctagtatatgttgcgtaaatttgtttcctggtctacacttctaccaccaccctaatacagtaccgctataatatgtttccttccttcagcactgactcatttaaaaatcgtactggccagccaggtggtgccatggctcacaacttgtaatcccagtactttgagaggctgaggtgggaggacagcttgaggccaggagttcaagaccagcctgggcaacatagcaagaccctgtatctggagaaaaatttaaaaaagcaaccaagtgcagtggcacatacctgtaatcctagctacttgcggggctggggcaggaggatcgcttgagcccgggaggttgaggctgcagtgagctacgatctcaccagggcactccagcctaggcgacaagagtgagacccttctcttagaaaaaaaaataatcataatagcctacatttttgagggcttcttatatgccacacactattctgagttcttgacacacatttaatcttcagaagcccccatgagttggccgtgtttttatcccattgtttagacgtggaaactgaagcacagagggcagaagtaagttgaccaagtccacacaactagtaggcaacgcatagggatccgagccaggtgtctgattccagaggccacaagccagaatataagctccaaatataaggtggggacatttgtgtctttgttcttggctgaagctccagcacctaaaagaacactcaagaaatgtttgttgaataactcaatgatggtcttagccaccatgctctcctgcctccaaactcaagatgggttgcaatggacaggggtcattaactaagcagtctcaatgcaacgatctcaatgtgagaccaaagtagagaatgggtacaaagtgcaccacagaagctatagggggaagcttttggaacaactactcttttttttgagacagagtctcgctccgtcgcccaggctggagtgcagtggtgcgatcttggctcactgcaacctctgcttcctgggttcaagcaattctcctgcctcagcctcctgagtagctaggactgcaggcgcccgccaccatgcccagctaatttttttttttttttttgagacagagtcttgcattgtcgcccaggctagggtgcagtggtgcgatctcggctcactgcaacctctgcctcccggcttcaggcgattctcctgcctcagcctcccaagtagctgggattacaggcatccgccaccatgcccagctcattttttctatttttagtagagacagggtttcactatgttggccaggctggtctcaaactcctgaccttgtgatctacccacctcagcctcccaaagtgctgggattacaggcgtgaaccactgcgcccagccaatttttatatttttagtagaaacagggtttcaccatattggccaggctggtcttgaactcctgaccttgtgttccacccaccttggcctcccaaagtcctgggattacaggcgtgagccactgcgcctggcctgaccaactactgtttatgcttctaattttgttagttactaaaatatcgctttcagtctcatgcagtaaaagcaaaaggtttttcagtgacttacaaggctctgtgcacaccatctgtcccctgccctcttcctctgccatgttcccacttgcttactctgctctaggcatattgacctccttgcttttcctctaaaagtgccaaggccattccctccccctaggctttgttcttctgcttggcttaaccagaccttccttcagatctttgctcaaatgccacttccttggtaaagccctctgtgacctccctgtttaaaattacaataatcccacctgtgcacccctccctctcgcgtggtacctgctacattaggaatatttgctgaatgaatgaatctcagacaaatgggagatgggcggctaagtctccagattgtcctgcattgaagtgcttggagaagtttgcgaattttcccactcagttcaaaccacatgctcaggaattaaagtgttctttcagctttcagatgttttcgggggatagcattgtaacaaagcatgaaaaaaagcagtgttgggaaattgagattcttattacagtgggagtacctggttgtcatttcaagatgaggatttgttaagggatgggacaagggatgctgcctgggacaataaaccaaagaaagatttaaaacagagaaaagagttattagttacaggactagcacaaacaaagtagggctctccatctttttcctgtctcgctgaaaacccatcttttcttcccttgaataaacttctttgctttctgtccccctgctttgatttattattttaattctatagctgtcttcgtgaagtatgtaaagcatttgggggtaaaatcatgtggaagacattatagaaactaaagatgtgtgatattatgtggtgttgggtagaggctcagcgtgcttatgaatcacacggttgatgaaaacaccaatctgtccagggccattgtctatcagctgtataagaaattggctcattgttgagggtacaagaaggaggaatgtaagggggactgccggaataattcggttagaattcggtaaaaccggagcatggagaggtctggttgacatccctcctttttatactgagagatgtccctgaaggtgaggtttttattttcttgcctctaaaagggaaataatgaatgtttctatttcttctgtcctattactctgtgatgaatgcttcttttatttttatctgagtctaactccctccaccatacttagcatcatgcttgcatcatatccattaataaatggatgttgaaagaatgaatcaaccatgcttgaaaacttagatctctcttgcttttcaagagactcaaatatttaaaagcagctatggagccgtgtgcggcggctcccgcctgtaatcccagcactttgggaggccgaggcaggtggatcacaaggtcaggagttcaaaaccagcctggccaacatagtgaagccccatctctactaaaaaaaaaaaaaaaattaacagggcgtggtggtgggcacctgtagccccagctacttggaaggctgaggcaggagaatcgcttgaacctgggaggtggaggttgcagtgagccgagattgcgccactgccctccagcctgggtgacacagcaagactctgtctcaaaaaaaaaaaaagaagaagaagaagaagaagaagtaagaagttatgggattgtgcttgcaagcagcacagtttattgtgtagcatcagagttttcatcattccaagtattagtgataaaaataattctgaaggataaatggcatattttccattgttgatttcaacacagttagactcagcagtgcaccatttctgataatcatctatcattttactcagcatatgcaaaaaatgatcttagcatcacatggcaattagatgcttttttttctggcacctggtgtgcttgttcatgaagtgcactgagattccggaaatataatttcaaaagcctagaaataatggcccatgtcattttcttggcattcttcaaaaccaaagccttaagagtccatggtttgtccttttaaaccccagcaacggaaagaaagggccttggcagtgacaaagaaagagaaattctcttgggggtctgtagtgaaaagggatgtaatcagtaccaggcaagccactttgattttttttttaaaaaatgaacaaatataaaccattactcaaaatttctttccagtctttttggtgcttcagaatataaatgtggctcatttttctctaataagtttccatttattatcatagtcatctcttcagtgctcaatcaaagtggcaaggttgtatttgtggagaaaacagaatattttgtaacatggctatcctgaattttagaggcacttactagggatggaaaaactggtctgaagttcttaggcatactcttaccacctaaaagtgttcagcgataaaaataattgctttgtttttacctttgaggaactccaagtatcaggttaaaaattgagagaggtagtgaaagagagtcagtgattccagtgtttcagaaagtctgacctggccagggtccagctgggctgcaagaacctcctttctctccctgtctctgcagctccatcactcaccattctctccaagtcccttgggaatacatggggagaacctagtggccatagcagatactgctggtccccctcttcccccactccttgccacctcatcatttgcttgcacaaaaccttatggttctcaaggcccagcacctgtgactctgcccgagggtttcctctggctgtgggagccccctgcacccacacagggggcaggccacttgggagcaggcccaggtaagactggcaggagttggtggataaacaccccagctctcttgtctctaggtggggataattctgaggcatggtctactctgtctcccatatttccctggcaggattgagccccagttgtctgtgtccataacctgcttgagaacacagactctggtatcttccttccttcccttctcccttcctcactgtcttatggctgttacctagagtcacctcccagttaacctaccagcaccctcatccttgtacaaggatatgtctgagggaacttggtataagatattggaagtatatgctcttttgtccatccatccatccatccatccatccatccatccatccatccatctctccatccacccattcatccatccatccatctctccatccatccatccatccatccatccatccatccatccatctctccatccatccatccatccatctctccatctacccatccatccatccatccatccatccatccatccatccatccacccacccaaccatccaacaagcatttggtaagctcatgctgtatgccaggtattgtgttaggcaccgaggagagcaagaggacagccaccgccctcagggagctctcagtccagcagggcagccagtcccaggataggacagtgagaaaggacatggaggttcaagacagaaaaattcataaagccatccagtatggcttttgctctcccggtgtcttcaggttgtttaaaaattaaaggtggctttccagcacctattattatcagaaatggtcttattggttcacttgcttactagtccattgcctgtctcccttcctagaatgtaagatccatggaaagaggtacttgtctagcttattccatcattgcttcctcaactcttagaacaggggccaggctggcgcatgataaacatttggtaagtgcatctcatagtcattaaggcgtctgctgtggaaagtttgtcagtttcctcctgttcctcccggagtaagctcatccatgttgaaatatacccaagctccactctggatgcagtgttccagtgcactgtggaagtctctgctcaggacaggagggatagcaagtgtgctgcccaccctaggtccgaggtggccacttcctgctagccactgctccttgggaacaaaggacacttgcccaagtgtgtccctaaggtgagcgctttagcatcaagaattattcaactgaaaggagttggccggacccagtggctcacgcctgtaaatctcagcactttgggaggccaaggtgggtggatcacgaggtcaggagttcgagaccagcctggccaacatgacaaaaccccgtccctactaaaaatacaaaaattagccaggcgtggtggtgcgcacctggaatccgagcgacttgggaggctgagacaggagaatcacttgaacctgggaggtggaggttgcagtgagctgagattgcgtcactgcactccagcctgggcgacagagtgagactctgtctcaaaaaaaaaaaaaaagagttttcttctaaatagcttgctgagtttctctattttctttgtacactgaattctaaactctcagttgggagattctgccaatgaaacactctttgcagtctcctacctctgctacctgggcttgcttgatgctgggtgatgaaccacccaggtacctacacaacaccctggttgtcagcagtggcagtggaaaggagagtttgaatttggaatgtagacattttgtaaacaggttcagagaagtaactgcccaccgtcctccccactgtggtgtgcaaagctaaagagctgactcatgtgatcgtgggggttggcaagtccaaaatcggcatggctggagattccagcaggagttgatgttgcagcctggagtccagaggcagtcttaaggccttcaactgattggatgaggcccacccacatgaatggagggtaatctgcttttctcagagtctactgactttaagtgttaatatcatctagtaaataccttcacaacaacatctagactagtatttgacaaaacaactggacaccgtagcctagccaagttgacacataaaattcatcacctcaagaatcagcactaggtttaacatgaaaacaacttgtatttagtgcaatttatcaagtgcatattgagactggctgaggttcttcctggaacttacttctctctctcactttctccctctcttttttttttttttttttgtgagtcttgctctgttgtccaggttggagtgcagtggcatgacctcagctcactgcaacctccacctcctgggttcaagtgattctcctgcctcaacctcccaagtagctgggattacaggcacgtgccaccatgcctggctaatttttgtaattttagtagagatgggattccgccatgttgcccaggctggtctcaaactgatggcctcaagtgatctgccagccttggcctcccaaagtgctgggattacaggcatgagccaccgcacctggcccctggaacttatttgttagtattcaggctactgaggtgttgcacctgcagactctcaggtggcactcacccattctctctctctgccgagctcccgtgttccatcctttgttcctcagtgtccccacctgttaacgtgttgaatgtaatccccgtgtcttttggataaatcagagaatcccatatcatttgttacttaggatcctgagcattcagttttagctttcacactaaagatagagaaaataaaaatagataccattaatctttacacttctcctgtggtcctgattgccaaccatagtctgaaagatctgcagtggatttattactttgcatgttctttatttcctttaaacccgggcgtgtgaggaacgttgatttatggagcctagatcatgcttggctggggaatgggaggagggaagcaaagtgttgttcaagctgcagtaaatttaaacatcactagtatttctttacacatgcaagggggaaaagtcctaacttaagtccattgctacaggagctcataaattaaaaataacaagactatttcctatacacctggagcttcaaaattacatgccgttaattctttgattgcccccttcacaaaagagccattgagggtgacaactcaaacaagatctccaccacagccgtgaaatccaatcagtgattcaccttgtgtctttgaccttgttcaagataaggaagtgacttgtctgaaacatagactctaagaatttagtcccattatttttttcctcaaacttttccctctcattactctcttctctctctctcctctctcgttttattttttctaattttacataaattttaaaacaaatctaacagcatcagaagaccaaaacacaggaaagtcttcttgactttccactatgttctgagccataaatcctttcgtgtgctcaaataatacaccccagctggtctgttggatgaatttggttagcctcttaaatgttttagcacctgtacaccacagagctcccaaaagcgaggaaattatgtttcctcctgtccccaacggattgcttttcacctgggccatatagctgctgtgtgccactttacagaggttaagactgagcagtcctggaggacacagaaagctctaaagaagtacagacacaacttcaagtcctcatatattttacttcttcatcttgttctttgagaactacgtttactttctttgagaaaatgcataaaggagaaagagaggatatactttattttgatttttagagaaccttgaaagtgtcatgccagaagcggtggaattgagttttcactcttataccacccagacctttcactctaggtatataccaaagaaaaatgaaacgaaggcgtttgttcacgtcgagacttgcccgtgaatgttcatggcagtgttattcatcaaagcccccaaaatgtaaactacccaaatatccaccaactgataaatgaatagacaaaaaaaacatggatgtccattcagtgagatactcttcagaatcctcaaacgattgctacacgcaacatgactgaatctcaaataatgatggtaagcgacggaaaccagatcccacctctacagatggaaggctacatatgctgtgatttccttcagtgcaggatagacaatagaaactaatagagtgacaggaagcatatcagtggttgatgggaagtgagggtgggagggaggaaccgattacaaagggctgtgaggaaatgtttgggggtaatggatttgcttatgatcttgactgtgatgatttcacaggtggatacatatgacaaaactcatcaaagtgtgcagtttattatatatcagttacatttcactaaagccaataaatgatggccaggcatggtggctcacacctgtaatcccagaactttggcaggccgaggtgggaggatcacttgggtccaggagtttgagaccagcctgggtgacatggcaagaccctgtctctacaaaaaataaaaaattagccagacttagtggcatgtgcctgtagtcctagctgctctggaggctgaggtgggaggattgattgagcccaggaggttaaggctacagtgagccatgattgtaccactgtactcgagcctgggcaaaggaacaagaccctgtctcaaaaaaaaaaaaaaaaagaaaaaagaaaggtaataaatgaattttgttgggattagagaaaatgttttgagatggggcgagaattgtcttaaaaagtaaatagagttgcaataagtggtcgttttcctctggaaggaaaagtgttaataataggaacccctatgaaatgtattggattggcctcattaactattttttcccccaagggctcaagataagaaagtaccacgggaaatctccaaattggtacacaaatctaaattattttaggtaataaaaaatcatcaaagtagaataaacgggaagaaatgagcagaggagctttaatgagagcaaggagaaacattttgggtaaaataattcaaattattcttatgagatgatagacttggagaaactgtttataattgaggaaggggatgtaaggactttgttgccagaagattcagcctaagatcaccaggagtaactaaatgtgttggacatcatcggaaagaatattgaaaatattgaaacaaagtgaaaggtaccaccttacccttgggcaaagtgaacacttctttcaacctagaagttcctataaagttctgacaggccaggtgcggtggctcacgcctgtaatcccagcacttggggaggccgaggcgggcagatcacgaggtgaggagatcgagaccatcctggctaacacggtgaaaccccgtctctactaaaaatacaaaaaattagccgggcgtggtggcgggagcctgtagtcccagctactcgggaggctgaggcaggagaatggcgtgaacctgggaggcggagctcgcagtgagccgagatcgtgccactgcacaccagcctgggcgacagagccagactctgcctaaaaaaaaaaaaaaactaaaaggttctcacaagttcaacttataaaagggaagcaaagcctggtgagcgggtagagactcccatttgagaacgggcatttggaagaactccctagtccggatgacaagagctagggtgcaatctgagtagctcatttggcacgtggatagattattcattaagttttggaactatctcttaagacggggaagaagcagccttagggaacaacaaaacaagctgtattccacatcctaagacacagtaccgactgagaatataaatctgcaggtccagattaatccacagatggcaggctgcttgcaagctattagacaaagccaggggtgttcgggagcagatccccaacttctgactccatagagggtcacagcctgcctctcttgcacagaaagagatggaattctcagctaagtgccacaggacttctgtccaatacactagcccttctagtctgtttctgaaatagtcttttctacatcattttttaaagcggtccgttattccgagcacttttatcatgtaacacatcagctgccataaaagcttgaaggtggctgaaagtgggcgaggatctagaagccccttgggcaagtccagattggaaacacgtcatgggacctccttttagggacagtctcacaggcaggctgccgtaggatgacctcaggtgtcccatgttttgggtgggaatgtcaacagagcagatgcgagaggcatttcacccaagcacctggattgtttcatgcctgaaaggaggcaagacaggaaggtataaaatccagatcggtgcagttgctcagaaaagggacaggtgacggcctggcgttctctccttggcttcctgtggaatttcaaagttactgctttgggattgtgaactccagccatctgcgtgcttggaacctggagagcaatccagctggtgtctaccaccgtaattaagaggggtgtggagcatgtaggtgttatacacccctgccaatcaccaggaaggagctgagtgtggaattcacatttgaaagtgaagatgcaggaagcctgatagctcccaaaagaaacggccaccagattttgtttaaaacaaacaaacaacaacaacaaaacacacaaaaacaacggaagggtacactttagaaaaactattgactttttcccaagatatctgtacctcagccacaactacaaaaaagagtctcttcctctgttgctggcatctagtctgctgtaattgtagaattttctgatgctccatggccatcgttgcttctttgtcctccccactatttcatccgccggctcctgggaggggagggttccagttcactcggctaacgtgtgtgagtccgacagtaacgagcaacgcagaccccgggaagaggaacaagaataggacattcctatatttttatgtggagattgataatcaaggctaacaatcctggcagaaggtgaacaacacattaaacagaggggaaaagataataaaatatctcctgatgcttaacaatcgttgggtggaaacattccctggaattatacagctgttgcatttgatggctcataaagcctcagtaaagtccgtcaagggccttttttcttggcgagggaccattcttctcatgcggttatgatagcatctgcttcctgtccctggaagtgcacagaatccacagacactggcagacggaagcaggggaggagccctactgcagaggcatctggccctttgatggcttttgggtaacttctgatctacagggcatcgtatcaaaatgcagactgagatttagtgggtagccagtgagcacttgctaggtgccaggcactggcttagggtatttcattaatcctgacaactatgaggtcagtattaccatttttaaaacaatactatggaaaacagagccctagactccttaagaaacatacccagggcatgcggctgacaagtggcaggctgaagtccccacgcctggtagccttttttctgttactgcaaagatggaggaagaggcgagagttgcttcctgtccgtgctctgggtacgtgtgaaatcttgtgcatcttcttataccgggtgttcaggcacatgtgtgttgagaagggatgctgttttccagaagactcaaaaacaatgatgggggtcctaggtgacttactgttttaggtcggggtccccagaagcagatcttgatgaagtgaggatttctctgcaagtgatttattaagaatgtggtcctcagggaaactgggaagggagtaaaggaggcaggaaagggaaagagacaagccaaagatgagtcctttctcaggcaaaatccggtggacagcggcttttagcttcagcctgaccatactggggaactctgggggtttgtcctgatgggaagcagcagaggtgagcggtcatctccctcactgttcaccctgcagtcatctccctcactgttcacctagagctgtcatctccctcactgttcacctagagctgtcatctccctcactgttcacctacagcggtcatctccctcactgttcacctacagcggtcatctccctcactgttcacctacagcggtcatctccctcactgttcacctacagcggtcatctccctcactgttcacctacagcggtcatctccctcactgttcacctagagcggtcatctccctcactgttcacctagagcggtcatctccctcactgttcacctagagcggtcatctccctcactgttcacctagagcggtcatctccctcactgttcacctagagcggtcatctccctcactgttcacctagagtggtcatctccctcactgttcacctagagcggtcatctccctcactgttcacttagaggagaggtcatctccctcactgttcacctagagctgtcatctccctcactgttcacttagaggagaggtcatctccctcactgttcacctagagctgtcatctccctcactgttcacctacagcggtcatctccctcactgttcacttagaggagaggtcatctccctcactgttcaccctgcggtcatctccctcactgttcacctaaagcggtcatctccctcactgttcacctagagctgtcatctccctcactgttcaccctgcggtcatctctctcactgttcacctagaggagaggtcatctccctcactgttcaccctgcggtcatctccctcactgttcacctagagcggtcatctccctcactgttcatctagaggagaggtcatctccctcactgttcatcctgcggtcatctccctcactgttcacctagagtggtcatctccctcactgttcaccctgcggtcatctccctcaccgttcacctagagcggtcatctccctcactgttcacctagagcggtcatctctctcactgttcacctagaggagaggtcatctccctcactgttcaccctgcggtcatctccctcactgttcacctagagcggtcatctccctcactgttcatctagaggagaggtcatctccctcactgttcaccctgcggtcatctccctcactgttcaccctgcggtcatctccctcactgttcaccctgcggtcatctccctcactgttcaccctgcggtcatctccctcactgttcaccctgcggtcatctccctcactgttcaccctgcggtcatctccctcactgttcacctagagcggtcatctccctcactgttcacctagagcggtcatctccctcactgttcacctagagcggtcatctccctcactgttcatctagaggagaggtcatctccctcactgttcaccctgcggtcatctccctcactgttcaccctgcggtcatctccctcactgttcacctagagcggtcatctcccttactgttcacctagagcggtcatctccctcactgttcacctagagtggtcatctccctcactgttcacctagaggagaggtcatctccctcactgttcacctaggatggttgccgtggggaggaggcgggtggtgaatcccaggccttttcagcggccctccaggcctgcaggttcaagcaggctccagtggcctgagggcaggcctttgagaaagaggctgactgttagaagcagaagcccttgaaggagcacacagaaggggtctgggctaagcagcagcgtggcgacctacacccgcccctcctccgtaccttgcaggaggcagcgggtgctgaggaaatgggaaaagagccgcaagattaaccagatacccgtggtattttcaagcaacaccatctgctgtatttccacagaaagggtgttgattttcctgaattctagaggtggtgttttcatcactgagttcagatgcctttgattgatgagccaccttcaaaccaagtcagcatgaaacagaagcttgggttagttcacgttgtttgatataataggacaaggcagactaacgtctcttgagaatgaagggaagtttttcctacataaacttccacattctctcacaaggtgggaaaataaaaagggaaaatgacgtgaggggttgcccaagacagggatccttcccatctgaaaccatgctgtgacatgaagtgccacagattccaaaatccacgtgtgtctttcttcgaaaccaatagccacgtgtaaaaaaaattatatagcgtataaacccatagcagcaacattttaagtggaaacagatttcttccattttaaagaaatgtcaactgtgttagggagtctggggatccctcgcatacatcccagctgaacatgaaccccaaattcctgtgtaatgtatcgcagaatctgtcctttgctcacttcgtatctgtcatcaatcaacactgcagactctggaagcaagcatgttatggttttactcttgtgactaagcggagacaagaaggcatttttctcctccttgggctgtttggaaagcatagaatgaaatccagggcatggtcatcatgaattatagcgcagccaggctggtctagaatctctcatcttccaggcaaccccagccttggcagcaccatcaaagggtcatggataacaattttaaaatgcagtgaatgaaagtgttcatatgatgctaatggaatcataatttttaaagtgtcctcatcctttagagatatagactaaaatactggcagatgaaatgctatgattatgggacttttgtcacagtaatactacagagagaagtgcgtgcgtgcgcgtgtgtatgtgtgtgtatgcatgcatgtgcgcacgtgggggggatacacatggaataagattggttatggattggcaattgttgaagctgagtgacagacacataggctattctatttttgtatatgtttaaatttttccataataataggtcaaatagatcataagcatagtgtatactcacagatccctccagaagaatctaaatgcccagctacgctggtcaccgagtatccgccttgctctcccaggtgtccataagcccctgccacagggctggtgaggaagcctggctcccagcttgtggctacctttacacccatcactctgctctcctcccagaactccattcctccagtcacagggcccccagcataacaattccattagcatccttccctcccttatttcttgcaaaattactcttatcatgaattccagggactgtgttcatttgagtggcatcatctattactatttcatttaccccatcacatttctttttctcacataaagatacagtcatttgtcacttaataacatacacgttctgagagaggcattgttaggtgattctgtcattgtgcgaacatcatagagtgcacttaacataagcctaaatggtgtagcctactgcacacctcagctatatgatgtagcgtattcattctaggctataaacagtatagcatgttactgtactgagcgctttaggcagttgtaagacagtgctaagtatttgcatatctgaacatatatgaacataaagaaggtatagcaaagatacagtgttatcatcttggggactacagttgtgcatgtggtctgtcattgaccaaaacgttgttctgtgacgcatggccatattaaggtatacactgggtttggctgcttctatacaaggagtttggataaatttcatatagtgtcagtcaaaaaagtataagaaaattaagccaagtataagaagctgtgatttgtcccagacatcatgacctcagaaacagagtgtctgtgtaggtgactgctctacaataggctcaggaaggcatcgtgtctgagggcccaggctacagactcctaagtgtgtttttagcccccaaggccatctccttttggtcattatggaaattctggagcttaattaaaaggaacctagagtgcaacctttagatttaagagtaatagaaagaataactccaaaacctgtttattgtagggcagttaactcttatgtgagctcttcatctcatgatagaaaagggtccctggtggaggggtctgatacaattataattctgctctcccccaatccccaaagcatcaaaatagaactctggcccctctcattatatagagaagcaaatcgttactgtgatcactagggagttcccaccagcattgctgtgggtcctgaaagagaaaaggaggttccatgatttgggaagtaagtttcattttctttcatatttggagagatagtttctgattacagccagtggtctcttctgtaaatataggtgggccatggactctagagactctcaggatataatctgaaggattgattgcatatgaacctgcctacagatgcagctcttggttctgttttggctttgcctcctcccctcactgtgtggtgggtggagctggctcctctcaagctggtgccttcctggtgtgcttgctgctgctgtggtgcccgtggcccatctgaattaacatcttctgcggtgctttagggtgctttgcacaaagtcacttgagactgatggtgctaaggactcatgggtaatggtctagtcttaatgttctaattcaatccaatccaacttttttgttttgcatatctacaaagtgcataggaatatgcttcgtactgggaggagaactcatagtgcttaataaggactgctatggtctgaatgttggtgtgcccctacaattcccatatgggaaacttgatcttcaatgctatagtattaaaagatggagcctttaggaggggatcaggtctcgagggctccatcctcatgaataggattagtgcccttatcaaagaggccagcaggaacttgtccctcccttcgaggtgggaggcggggctggactctggagctgggctcagacaccagaccaaaatgaggactagataaaacagggaaggggcaaaagcagcttttcataagacatgcccaccagtgtgccatgtccgtttactattgtcccaacaacactcaggagttaccgcccctttccgtggcagtgaccccacgacccagaagttcctacccttgtcctagaaatttctgcataaactaccccttaatctacatgtaattaaaagtaaatataaatatgactgcaaaactgccttgagctgccactctcagcacactgcctatggggtagccctgctctgcaggaccagttatggacctgtaacactactggagctgtgacaccgcctctttaataaagctgttttctgctaccctaccaccagctcgcccttgaagttttactgggtgaagccaagaactcttgtgggctacgccccactttggggctcacatgccctgcatcaccttttgccataggaagacacgttgaaagcactatccattagtaatggcccttgccagacaccaaatctgctggcactttgatcttagacttcccagcctccagctgtgaccaataaattccattttatttgtatgttttttttgttgttgttttttcttgagacagggtctcactctgttgcccaggctggagtgcagtggcatgatcttggctcactgcaacctccgccactcaggtgcaagcgattctcctgcctcagcctcccaagtagctgggactacaggtgcacaccaccacacctggctgatttttttatttttttggtagagatggggtttcatcatgttggccaggctggtctcaaactcctgacctcaggtgatctgcccacctgggcctcccaaagtgctgggattacaggcatgagcgaccatgcccggcttgaattctgttgtttttaacttacccagtccaaggtattttgttatagcagcaggactggactaagataaggactaatcttagtaggaaggaattaacatggaccttgtgagttatggctgatgctcaaaagcctggaggacgccttgcagctctttccacatggtgtgttctggaaacactgtcttaactcctctcagtttggtctggagtttgatagtcatgtagatttgggattggcatcacaacctatagtcaaagtgatgaatcctcttgcataacacaactactttgcattttaataattttaataactttgataactaaacatttactcaaaaatgtatttcttgaacatctatggagtccagatattggggtctactaggctttggctgtccttgtgatttttaaaaccagaagcacccagaaactattaaatccttaaagcaatacaaaatattcacagccatagcatgctcagtagagaacctctaatgcctgaaacaaggagactgtttactttagcacgtcagtacttgaggatttattctgtgttgcggcttctggcctgcgagttcagaataacatgatgtggatttggaaccaaaatgaacacagcaacagacagtctatcacgataatgggaaggagctggagtctgcagctgccatcggcatcaaagatctagcttttattgagctctctatatcccgacagatccttgtcgtatggaagtgatttgcgtaggctgagaacagtggggtgaaaagaaccagggcatttctaaaaaccagtgagagcaatttacaagcctgagccaagaaacaagctggacacaccacaaaggaaatgcattttcccagtaactttttttttttggaggaggctttagagggctggcctgtgaattgcatttgtttatgaattgtctagtaatcacttgcattgtcgctggatcaggaggggctgtattttcttcccacacctgatttccatgattcagtgcacctcaagagctccatttgtgtcaccttctctgtggctgacgtgtgcgtttccactttgtactgttaatcagttaagtgaatatgagctgggaagtgtgttcaccaaacacctggctagcccgaagctctttacatttgacaaaacgggagacagaaattagaatggcttttctattttagtctagattatggaattctgtaatcaagattactttaaaaccatcatttgaatgaggaggtaaaatagccttgatacttcactgctggagaggaacaatagacaaactcaaaagacaaaaacatgaattttaaatgacagtttgtcccaaggacatcgtcatactgtgtgctttttacagtctgcttgttatcttatgcaattattgccaatgtgttttgctaatggattcattgcaagtggacttaccctacgtggaatgaggaatgtccatatgtggtagatgtgttatttattgatgaggagaggaaagtggatcaatgtggtctttagatgtgcgtgctttgccttgggaagcaccagcattgtcgtctgaactacaattggtgtgtatctgggtggaatgtggtacccgtggtgagtttgcttgttctctttccgttggcccacttgcagcaaccaactgttgcctggactcggtattttgggggccattttctcttacttttatctgttggccttgtggttccatctgtaggttgctctctccgtctagcttggaaacaacataatgattccttccgaatcactggattcacagggttgagggacttgcctgccactgacattcgttgactgggattagaatttgaaaagattttcgctgttgcctcaggtgttctgaaaggtggaatgaatcatttccactcagttttaatgctagagggagaaaggagtcatgttaattagatgggaaagatgatctaatcctttctcaaagagcctttctataaggtttagggtactgtccagccagcctgcggctgcgtgagactaatgatgggtactgggctgttgttccatttctgctaccattcattgttggtgcctttggtaaataattccatttcattgtgacttcatcttctcattgggaaaatgagactggtgatgttgcgcctcttgggttaggcgtattctgtggtaggatttagagtcaaaagtgttttttatactaaaagacactatggcacatcttcgtaggacattagcttttctttgaagatctggtggtggggggaaggggaaccattttttgaacagtaaaaaataaagagatatagtatggaaaacaatgtgaaatgtgaatgaatttttaagatagatattttaagatgaatttttaagatattttaagatgaattttaagatgaatttttaagatagatatgctgctaagtaatttcttgctagatttcaactgctttggggtgtgtcttcctatggaaatgaattcctcgtgcccacggccattacatttcctacaacggaaactttgacttttgtttttttttgaagagacattttgacttattttttattctaccgtttttctatttgctacctcatttatttctacttctagtttgttattttcttccttctgctttatgttattcttttttgtaacttttagaatttggaatttaatgctttttaaaatttttatcaatataagtatttaggccataaatgtcccactgttcagtactttaattgtattttatgtattcagatagatagtgtttttattaacatttcgttttagaaattctgcaatttgggtttgtagttctccctttacccaataattacttaatatcaaatttttaaatttctgagggtaacagcctctttgttttattacatttatttatttctggttgtcttctattatgatcagataatattgtttttattttttaatttatgaatttattgagatttgctctgagttagttaatgtatagccaatttttatgaatttcacttgagaaggtgtattctcctttgggtacaaagtataatatgtatccagaagatctatcttttttttttttttttttttttttttttggtttttgagatggagtcttgctctctcacccaggcaagtgcagtggcacaatctcagcttactgcaacctctgcctcctgggttcaaaaattctcctgcctcagcctcccgagtagctgggattacaggcacccgccatcatgaccagctaatttttgtattttttgtagagatggggtttcaccatgttggccagcctggtcttgaactcctgacctcaggtgatccacccacctcggcctcccaaagtgctgggattacaggtatgagccaccatgcctggctaagatctatctttttaaaaaaattatttactgtggcaaaatacatttaacctaagatatgcgattctaagcatttttagttgtacaattcagtggcattaattacattcacattgttgtagaactatcaccattacctgttttcaaaactttttcatccctccaaacaatctctgtaaccattaagtaataactccccactctcctcccctcaacccctggtggcctccaatccactttttgtttctgtggatttgcctactcataaaagtggaatcatacaatatttaaccttttgtgtctgatttatttcacttagcataatattttcaaggtttatccatgttgtagtgtgcatcggaattttattcctttgtatggctgaataacagcatatcattgtatgtattatatataccatacttttttatttatttatctgttcatagacacttggactgtttccatctttggctattatgtaagtaatgctgctatgaacgatggtgttcaaatatctctttgagtctctgtgttcagttcttttgggtttataactatgagtggaattgccgagtcatacaacacttgtatgtttagctttttgaggaaccgtccaactgttttccacagcggctgcccattttacccatcagcaatataccagggttccagtttcttcacattctcgacagtatttattttccttttttttaaaaaaagaaaaagttatggccattctattagatatgaggtggtatgtcatgattttgatttgcatttccctagtgactaagagatgatgttgatcatctcttcatgtgtttactggtcatttgaatatcttctttggaaaaaaaagtctattcaaatccttcgtccattatctttatattgttgagttttaggagttctttatatattctggatacaaacatttatcatatatatgatttgtaaatattttcttccattctatagtttgtctttacacttttttgataatgtcctttggtgcacaaaagcttttaattttagtgaagtccagtttatcttttcttctgttgcttgtgcttttagtgtcatatttaataatctgttgtcaaatcctaagttgcaaagatttacctgtatgttttctcctaagggttttatagttatagctctcatatttgggttctttacctattttgagttaattttttgtgtatggtgtgaggtaggggcccaacttcattcctttgcatgtagaaatctggttgtcccagaacactagatctgttttattgatcatgttatttagatcttctatagctttatttttttaaaaaatctccctgaattaccttggactaagagtggcaatttcaagcagcattattaagagccatacagaagcctgaggcaaaaggaaaaatcagtaatactgcatcctgtctttatataaaatataaaattttcacattttattcatcacaattttttgcatttatttttattttttaaagtattgcattaaaagattattgattttggttcctgagtttttgccatcaccttgaattatgtgaccaagaagagtgccttttcaccttactatagtcccagccctggggtaaaggctcctaatttgagtgtgtttctgtctatgtcttcttgcagctcatgtggttttgcatttttgaaagcggttgccatgtatctggtataaaaatattcacaagtgttttacttctgctgtaaattgtgactttttctattacagtgttatttgtcgtaatactttttggcatggattctgccttgtctgttatcaggattacaaacgataggggaaaagataagacactaacaagtcttcagtttaccaatgatgaaatcagggcccaaggactctggcaacagttgaaagaattatgatcattaagttaaaaatgtttattacttctaaatcctgatattaaagtaacagcccagcgtacttccatgtagaaatgatgtcattctgaaatggtataaataaaaattatagtcaatattctcatcatgttcaagcagggcatgggccacaaacccacctaaggacctgggaagggcgggtttcaataaccttcaggctgaatgccactcatacaaataagaagcgtggaagctgagggaaggccaatcagttgaagtagggtgattcagcccactcaatatttgaaatattggttttaatgagatcctagggctccattttagagctactagaagttttatgagtgaagaagggagctgttttactgcactatacagagtctccttatctttcccttttgtcattcttgccataaccttatagcctctaacttaatcagcctggcttccttcacgtaatacagcagcacttaacattgccttcttacttttcttctaagtagttctagtttctatgtctgagcatccagggaggtaaatgcaaagaaggatggaaataaaatatggctcagctgtggcctgagcagccccttccaaatgcactcacggcttctctgcacatcttgatatgtgaatgggaaagaaaaaaaagcacattttggtccagcaggttttcttccctttgtctccctctgaggtgctcagaggcatcagtaacagagcaggaaggccctggccaacaaaccttagccttttcctttgataccttccattgggagccttcatacaatgcatttgaaagcactttgtcagcagactcctgcttcaggcaaacattgagaaaactattgaggaggcctcaatggaaaggatctgatctgccccagaaactgccctagttctctggcaggagagccaccagcaggagaagagaagtcctctctcctaccccattttttttctttctcctttttcctctcctttctattgtaagaattgtgggaactctctttaaatgaaaataactctcaggctgagctttgtctcccaatgtggataaatgcccagatatctcatatcccctctgtaaagctggagtctcagttttggatgatcacaaactatttgggacaaatgtttgagctcaaggagaaacacatggtaggtggtgtgtgcatagctttttctaaagcacctaaaaattgaatacttgttcatcagcctactgcttgcaagccctttgctaccacttgctggtctgttgtttgcgcctctgcaggctggctctgtgtcatgtttgcattggtatccgatctctccctgcaccaccccttgctcgattttaattgaatttaatgatttctgaacccctaagcgtctatcactttttaaaatccatactacaggccgggcatggtggctcacgcccgtaatccgagcactttgggaggctgaggcgggcagatcacgaggtcaagagatcgagaccatcctggccaacatggtgaaaccccatctctactaaaaatacaaaaattagctggggatggttacacgtgcctatagtcccagctactcgggaggctgaggcaggagagtcgcttgaacccgggaggcggaggttgcagtgagtcgagatcacaccactgctctccagcctggtgacagagtgagatctgtctgaaaaaaacaaaacaaacaaacaaaaaacaacacacaaaaaaacatactgcattagtttctacctacagtttcagtataagcaaatgcttaaggtgacgatgccaagagaaataaaagctctctttagctgccttcttctcccgtcattgagaagagccttattagatacagatggatgaatattcaagaagccagagagtgtgaagaagtgagagaggctgacccttgccctgagcaatgctagactcttggttgggaagttctgttctgccagcacccctgaggccagagaggccttgctggtcttctctgcgtctccctcaggacatggctgcccagtggaggacattcagccactcagcactgggtatgatcttcccttaacctattcccgtctatcaaaatgaagagccacttctagatctaaatttctgtaattatctgataatttatgttttattctaattacaaatctggcccattaaaaaaaattgagactgtatcagggtataaagaaaaaagacacccatgattccaggagtcagggataaccattagtggctttttagtgtgttaccttctcatcttttttcatacatctgtagttattttgcagaattagattcctgtgtgtatgcaacattttcttcactaaccttatctcttgaacatttacctgtgtcatttagtataaactgaaaaataaatatccgtgaagactctagatcattacattatgtggattatattttatttaatgaataccttatcgttgtatatttaagtgttttgctgtgataaatgatgctgccatgaatatgtttgcacacaaatctttgtacacatctgcgtttatttccttagtatataattctagcagtcaaggtgttttgatatttttaaggcacttaatacacaatgccaaattctacaccagcactatatgaatgcccagtttctggaacccactccaatactgaatgcgatctttgcgtatttgatagtttaaaattatacctcactttaaaagttgtttccttttcttgctcatttggttgaatgttttcatgtgtctatcagccatttaaattatcctgctaaatttttttctgtggcttttagtcttccttccattaggatatttgggtttttcttagtgatttttaagaactctaggattctattattttaaaatataaattgagttaccaaaatagtttaaattttaacaaaactgctgtagctggcctccttttataaggtaaccttgttattgtttgccagctgttgtgcctggcacagagctatgcatacccaaggggctacataaatgctttttcattttttatttttatttttatttatttgtttacttatttattgagacagaatctccctctgttgcccagtctggagtgcagtggcatgatcttggctcactgcaacctttgtctcctgggttcaagcgattctcctgcctcagcctcctgtgtagctgggaccacagctgcatgctaccatgcccagctaatttttgtatttttagtagagatggggtttcaccacgttggccaggctgggctcgaactcctgacgtcaggtgatctgcccgcctcggcctcccaaagtgctgggattacaggcatgagccactgcacccagcccataaatgcttttttaatgagagaatgacctattatctaaacataattgatgtacagtgttggttagcagagctagtaggagaatttttagtccattaggagttataagaaaagcttttagaatgaattgtcccagaaaggagagctggaagaaaaaaacccaaaacaatattccacatccacatatatgacctaatgttagcggaacatcacagaggacaaatatcgcaaatcagaacaaaaggacagctcagaggtatttttcaaattgaacaaaattgtatgcatgcaaaatataaatagaatgatattagaaagattttatcaaatcttaatgtttcggcacttttttcctgctgtttttaaagaaataaaacatgacagaacagttgacacctctgcatttctccttttatctcatccccctttcatctataacacaggtggctttgattttgaatatggtgcttatcatctgagtgtgtgctttcatgctttgatgacataagtgtacaaatggtatcatactttgtttcctattgcaacatttcttttctcattcaatattatatatttgagattgatccattttaatagtattacatcataggagatttcacaacttatttattcactctctcatgtatggtcattccagtattttgctcttgcaaatgttgctacaacgagcattgttgatcatgctcccttttgcacacagataagtttctctagggtggaaatggaattgattgctaagtcataggtatggatctccttcttttctagaaagagccaaatcatttttcaagtttttaaggtattatataaatacctgcatttcccccaaggacattttacgtaaatgatgccagttaatatttgtgagtgcttcctatgggccaggaactgtcctaagggttttatatgattccacacatttgatcctcaactattcatttgacaagtgaggaaactgagattcagagaacttgaggatcttggccaaggtcttatagcaagtgccggagcccactcaaacccctcggcagtgtcgttctcaagccctctctcttaaccccaggctgtgctctaggtgctagaaagacactacccatgccagtttatagggatataaaggcagcggctatttaggctgtaagaaaactccaacaaaccgaagcagccttcctagagcattgctgttgtacagataggaagaagaaccagatggttgctcaatgtgtccaaggtccgcccgtcagtgactgatccaagactaaattccaggctctagacgcacatggcagccaggttctttgctccctggctctcgctgtctcactctcccttgctccctccttccctgtgtattcctgaaggcatatagctacatcttcatgtgcttttaatttcttttagcctagagtagacgctcataatagaaaggtcaaataaaattttttaggagtagtaatggatgtaatcttgtacatgtacatgttaattgcagcactttaatccccattctaagtaccaaactttccggattaatttcctgcatctgttggtaacacgggactcagtcttctgaccagattctttgcccaagggccctcatttactaatgagtaatcactgcaatttcagagaaaatgctactggtacactcatgtttgaacattcatcaaatatgacgtgagcccagttaggagagatgttagcgtccttagcctacaaataagggcatagaattaaatctccccacgctataattttgttggggttattacttgcatcaatgtttggaacagttggtgataaaacgtttcatggtcttacagctcagtagataggagcatgtcatgagtcaggcttaccaaaggacttactgcagacttacttccccttgcctcctgtgattcaagccaattttgcaaagagaagacagaggtggaagaggaagtcccttcagcaggaatgcatttctctttgtgcacatatcacagacacacagcactgacacactaattatagctttaggttgagcatttccagtttctgcattttgtttgcaaacagcccattatttctatcctgtgtgctggaaaaacacaaaatgaagcagtctaatcactactgtttctggtaggtccagctgtctacctgtctcccctcttttggttttatttttttcagggtgggcctgtaactcctcttctatccccacccgattttgttttttggaatctttctaacctgcctgcagaccaggggttgcagttccagctttccatgatcttacctgtgttcagccttatctattttgtattgaaagaaacagtcaacacagtcaaatcctttataccttccttaagactgcactggtgtggcctacatagccacctgtgtgccagctgctgtttgtcactaggaagacagggtgggatgtgcgggtggtatgaccgaggtgtgaagaatctcagggttggctgtgtcagtgaaggagtgaacgggcactttggggtcacctgaactgggagaactaagttctcaagcagcaaaaacagaggcacaaaagtggataaaaacccaatagtgcagacctggagctaggcttcttctctcagtggtggcacagaaaaggatgaaagtctctgaaatgtgcacctgtgattcaggttgccacccactgaaaaatcatgattcaagatctctcctcctcataaaccttttttttttttccctgcctgcagcctaagatagaattaggaagtcaagaaaggctctagatgactttcagagtgttttttgtttgtttgttttttctttttgagacagtctcgctctatcatctaggctggagtgcagtggcatggtatcgtctcactacaacctctgtctcccaggttcaagtgattctcctgcctcagcctcctagcagctgagattacaagtgcctggctaatttttgtatttttaatagagacagggtttcaccatgttggtcgggctgtctcaaactcctgacctcaggtgatctgcccacctcggcctcccaaagtgctgggattacaggcgtgagccaccacgcctggcccagaggtttgttttttttgttttgtttttgtttttgtttttccagaattagcacatcttctcttctctgggtcatttttctcttaaatcagagattgcaaaatgtggtccaagggtcaaatccagcctggagtcccctgttttggtaatgtttccttgtaacacagccacccccattttttacaggctgtctgtggctgcttttgtgatacgatgcaggagttgagaagttggacagagaccatatagtttaaaatatttaccaccctagcctttgcagaaagttcgcccaccccttagagtacagaaaaagaaagatttcagagatgtcagtttgggaaggtccttgaaaagtcacttggcaaagaaaagttgtgagaagaaggttgatgttttgtcaaagaaatgcaacgatgacagatgccaacctgccttttcttccagcggcagaggacctcaggccgtggtgtgcatgcccgtgtatcggtgtgggtatgtgcacctgcacacatgtgtgcttacacgcagctcaaaacggtgccaccctgtccagagttattttggccatcatggttcaaatcaacagacttttctggaaagcttctgcacacatgccatgctcagaacaggaggtgcaaagatgggaaaggattctgcctgatatgcaaatagtgaccgaaaacaaatagtaaggagtgaggctgatggagagctaggggaaacaactcactgtccctgggagggctgcagaggacccagcacaggcgttctggggtgtaatcttccttccattctcgtgagagaagctgagtggaaaccaagagcctggcttttcagtgaggacatgaagcctctgatagttgccttccctctggaggtgaagcagtcctggaagaaaacatattcttacctcaaattccaaaacaacatgtggggactctgttgagaagcctgggtgacctagggctgacgtggtagaatccagactgattctgcttctgctttctcttaaagtcagctcagttttcccaatttttatctttttttttttcagggtctctctctgtcaccccagcaagagtgcagggctcactgcagccttgacctcccaggcccaagcaatgcccccacctcagcctcccaggtagctaggattacgattgcaccccaccatggttttcccaatcttataactaattagatccgctcatcacgtgtcctgcaagcatgcagtggcatgtcacagtgcccatctgacagcagggcagggtcgtttgttgagagaaacccactgaggaggaaataaattaatgtccatcctttgctcccatcacctccagctgcaccatccttcaccaggacccatcagagcttccccggggatgctgccctgtggttctcggggaagctgagagctctatgttgcatcttccagggcacctgtggtctccgaagtgttggctgcaagaatggctaagcagcgcactctcttcagacaagaatagtattttaattgccgacagaatgcagatatcgtttccactattgcctctgacacttaattttaggccgggcatggtgactcatgccagtaatcccagcctttagagaggctgagcctggaggactgcctgaggctagaagtttgagaccagccctggcaacatggtgagaccctgtctttaccaaaaaaagaagaaggagaaggagaaattaaaattagccaggcatggtggtgcatgcctgtagtcccaggtactcaggaggctgaggcaggaggccaggagtttgaggttacaagtgagctatgattgtaccactgcactccagccttggcaatggagagagaccctgtctcagaaaaagaaaaaaaattaaaaaatgaaaaaaagaagaagaaatgtaagtttaggcatcttgaaggcaggagattttgactggtaatggtggaaggattttgcaaaactccatgagttgacctcattcctcagaaattccattgagaatggagggtgttatgtgaaaatccgaatcacaggggatggcttcgagacatgtggaaagaatgccgccattacatatgcacgcgtagtgtttgccccagaggaggcttttgaaaagttcatctacaatgtgctaaagtcgagttttgcagtgacttcctagcgcatttagactgggcatagtttacattactgagtatttatcagccagcaaatcaaagccagaaataggttactcctttgtggagcaggagacagtgactgtcctgggaggaagtgactgtcacagcaatggattcctttagtagcatcttcactgtgtattcaccgggtacccaccgtgttagcgatgacagccaccctgtatcaggtactcccaagtgtccgttcccctgttactgagcactttacaggcactcttgttttgtgctcacagtaaccattgagggagatgaggcacagaatatgaagttagttgccaaaagttgccagagctgggatttgggctccaggtggactgactttagaggctgtgccctccatccttgccctgaacaacctcctgtgaagaaatcagtgtgaatgaatgaatgaatgaatgaatgaatgaatgaataagacctgaagaggcaggcaggctctgggagatgcagagacaacttctgcccagtttgtgctcaggttgtggagacaaggcttcctacgagatgcacacacagaaatttggcagaatgggtaagtggatagcacacagtatgaggtgggtccaatgactgctgagattccctctgtcctccacccacactttctcaacggtgtccttctcagaagagaacctgcttcttcgaccggcctggtaggaacagcactcaccacccatttgtgtgccagtacaggtaagtaagagtgctcccggccgcccttcagccgtggtgctcaatctgctgcatgcatcaccttagccaatcctcacgtcaatcccactaggtagggattatcactgcagttatatagacaagggacctgtggctcagggaggttaagctacttgccagatctcatggctaagaagtggcagaaccaggattcatgcaatggtgtggccgtccttcaaatcctgtgaacctcccatgggaacctcccatgacatcttgtgtctcccctggatatacatccgtaccatgacgggttttcttttttcctggtgggaaagggcagctgggggtgagaatgctccagagagtggcagaatggagctatggacatgaaagtatttggatcgttgggaagtgcagaggtcagctccgcacacacttcctgggactttgcagtcaatggttactgaagttacttaatacccacttgtcccacgactggtgagtcccgcctattgcctgctgtcctgtggtgcagctgctgtttgtccatctccagggccaccaaagcccgtctggattgtgattcaaggtgtaagaggacatggaaaaagaactgatttgtgttgtatgagtttagtttaacttgattacaggaaactgttggtgggtgaatgtaggatttcattgcgtataaacatttcagagacaagtccctttcagctactttctacttgggaatacttgtgaggtttttcacctaaggcttccccgtaatgattttgtcctgatgattcattccttaattagtggtattttattgccgctttgccacagagctttcaaaaccatcacctcctcctcctcctctggaaaacgtgcacagactttgcccacatttaatcatgccatccccaccctttctagtctttcttcaaacttctaccagttcctgtgtttctgagaggagcccaagtcaaacactatgagataaacatcaagagcttaaaatgaatgcatgttcaaaaaatatgctggtctctgattccaaacatggctactgctaacccattgaagacccatcaaagacctgactattctgaattgttttaatagcagtgaggggtgagtcgatgtctcaggagaggatggcccagacctaggtaatgtgtgtcccgtcccccgacccagtgagcacgtgtgtgcatctgtgggtgtgtgcgtgtgtgggtgtgtgtaggtgtgtgtgtgtgggtgtgtgcgtatgtgggggtgtgtgtgggtgtgtgcatgtctgggtgtgtgggtgtgtatgtgtgcgtgcgcgtgtgggggtgtgtgcccgtgggtgtgtgtgggcgtgtgcatgtgtggatgtgtggcaccatgtgtgtgggtgtgcgtgggtgtgttcctgtgtgggtgtgtgggtgtgtgtgcacgtgtgtgggtgtgtgctgtgcgtgtgggtgtgtgggtgtgtgcatgtttggcaccgtgtgtgtgggtgtgcgtgtgtgtgtgtgggtgtgtgcatgtgtgagtatgtgcatgtgtgtgcaagcgtctggcacacggtgtttttgactggactgaggttgtggtaccagagtccagaagacagacagttgaagttgtgtcgtggagggacactgacatgaaatctggcaagtcatgtccaaaccaggtcactaatcaattgtgagcagagagcagtgagcagagggcagcagctatgtgcagagccagaggccggggttcgaatgcacaggagccacgtggacactgctgcaggctgcccgggcacccagccgcagattacctgtgttacctcatgcctttttttttttttttgagactgagtctcactctgtcgcccaggctggagtgcaggggcgcgatctcggctcactgcaagctccgcctcccgggttcacgccattctcctgcctcagcctcccgagcagctgggactacaggcgcccgccaccacacccggctaattttttgtatttttagtagagacggggtttccccatgttggccaggatggtctccatctcctgacctcgtgatccgcccgcctcggcctcccaaagtgctgggatcacaggcgtgagccaccgcgcccggacccattgcctcatttcttcctccagccgcctgtgggtggggactgttcccgctgcagtctcctgggtgagagatgagggagctgctggtgagaggcggttgccccatcacctaagctcgtgaccaggggagggggaaaagcatcactgctcaggcaggagcccccatgcctcctgcttggggttcacttaaaggcacggcttagagagattctatcgaccaaaggatggaaagagccacggagaaagtatctttccggtttttgctttcctctgtgttccgtttccttcccatttacacaggtgcctttagcacgtagatattcacagctctctagagtcaccaactcctcgaatatccctggggtcctggcagaaagcggatggcgcgctgcgtctaacggagagtttttggaaaggactgtttacaaaagctgtcgcaggtgcaggcaagccgtggtgcgcagtgctcctgccagccgctggggaggcctgagggcaggaggggaagccacgaccaccaccccgagagggaggacccgggagcatcagctgagaggcatcatgggacaggagccaggaggacaagtgccctgtcctctcccatctccttctgcgctctccaagggctgagcccatcctgaagccagaaggaagcctgtcgaggcagcttgcatccgtctgcctcctggcgcagagcagagtagagagattgaagagtggacctggacgggcaagtgttcatagaaggcgcacagtacgagcatctcatgaaaacagtgggccctgctgctcagaaaaatgcccaaacacaccaaatgtggcatatgttttcaggggatccatataccccttttagccagtctctggaccagactgtagagtaagagtctgatttagatcgatgggaatgtttgtttgtttgtttgtttgtttgtttccctcctgataaaaaatcctggggtttgtgctctcctttaagtctgtaacagctgagtgaacaaatggcctgcacgccggctcccaggtcagatgtccagcaagcagacgcttcttttcttgtttctctgtctcaagggagcaagtaagtccagaagaagaaaggatctggtgaaggaggctgcaacccgaagttattttaagagagtgttgaaaatgagggctatctaaagcagaatgtgtggctgggatttacaaggtaaatcaaagcagctgtaggaaggaaagaaaagattttcaatgacaaacgttttcctttttacttgttcttttgaaagaaaggggaatgtgtgggcagacagttgtgaggatcttgacttaaatacttgactgccttttcacatgcatgctttaaaaactctctggttccggctgggcgtggtggctcacgcctgtaatcccagcactttaggaggccaaagcaggtggatcacttcaggtcaggagttcgagaccagcctggccaacatggtgaaaccctgtctccactaaaaatacaaaaattagcagggcgtggtggtgagtgcctgtaatcccagctacttgggaggctgcggcacgagaattgcttgaacccaggggacagaggttgccgtgagctgagatggcgccaccgcactccagcctgggcaacagactccatctcaaaaagaaagacaaaccaacaaaaagaaaaacacaaaaactttctggtttcttaaatgaatgacactcacttcgagaagaaggcccgtctaacctcagccttatttttgcattcagctagataataaagtcactcaaggtcttgggtccaaccagatgctaaaaatggctgtttttgctcaacactataagattggaagtcagggagctttggactttggacatttggaactgaggattcacctagaacatcaacgtttttgaacattccataataaaataaatcctgttaactcttaggcatttatacccccaatgtggtgggataaaaggatgaggaaaaaagtggcaccaagatgatgcgagctctttattctgtgtttcggtctcatcccattcagatgcttcttcatggaacatttccaggcagtggtgcctgatattcttcatttcttgaaaattctggttttgttgccctgagagtttgagatgaaaatctggttcctggagaaaagggtcttcttctatcagtgaagcccgtcagtgtttggttctggagtgactgcaaacaaaaagagccctccaagtctcagctcttcccctctctgctggtagatggaaatctctggatctgaattcctaatgggccccaccagtctgatattttaattagtctggtttaaacatggttggaggccgggcgcggtggctcatgcctgtaatctcagcactttgggaggctgaggtgggcggatcacttgaggtcaggagtttgagaccagcctggccaacatggtgaaaccccatctctactaaaaatacaaaaattagttggccatggcggtgtgtgcctgtaatcccagctactagggaggctgaggcaggagaatcacttgaacccaggaggtggaggttgcagtgagctgagatcttgccactgcattccagcctgggcaacagagtcataaaaaaaaaaagtgggggttggggggttggcagtggccttcacacacagcagtctctgcctttaataatggtttaaatcatgtgttagatctaggccctttggtgagagccaggttgaacacccctgaagcatttgctctttgatctatggcctcctattcctttgaactttcccagaaagcagggtgggggtggggatggggaacactaacccagaattctttaaatttctttctaatgatttggaatgatcagaaacttttaaaccaacttcatttccaccttccagccatgcttatccatcgtaagactatttttatcttccataagaacccattctccagtgactcttagatggaaaacacaacactacagagttaccataaaccacttttccttaattgctgacatggaaccagacagaggggggtcattggtttggagaaggagagggagggagaatatctacgccctctctgtccccttcccagacacctcattgcctctgaggattctcttcccttcactctcatcacaaaagaggtaattaccttatttcaggcatcctttttatagagcaggcagcagcctgtcacggtagtagcatttcactcttccaagaatggaaccattgcacaatgtcccaggagtcatttgtgatttttatgagaacctgaagaggttaaagaaaagaacagaaaaataagaaagcctttgctgagaagaagggagctgttagccaaaagagggaatttgggctgagaaattattgtctgaaatacttacatcttagagagagagagagagagagagaggtgagggaggggctttgttattgaattgagtgacatttctctttattataaagttataacgtccggcagtagaactgccagtaaaactcgatctggagtgttttctttccccctcgctatgctcttttagcagtttgcatctggactgttaaattaagggttcttgcatgggaaatacttcttattccttcagcaagtgaaactacttgctaaagtaattatttttaaatgcaaatatatatacacacataccttgtgtgtatgtatttttaaatatttacacacaatatatattcatgtatatgtatgtatgttgtatttttgtggttttgtgttttaacatcagctgcggtagaaagagaagggtggctctgctaagagtccctcctcaactggcctctggctgcaacgtaaatgacctcccttgttccctaccagcatggctggagcaaaaacgccagagtctcacgtacaaacattacctggagtcttcctactgcactcctgcactgtggcatccagagaaacagcgtcacttggggagaatgtcatgcactcctgcactgtggcatccagagaaacagcgtcactcaggggagaatgtcaggcagggatgagctgccttgacttgaaatggtcttgcctctcatctcaattaaaatcaagccattaactggctttaatgtagagattttgtggttcagttttcttcagtggtatccattataaaaaaagatgggggttataggtagcagaactgattggcatagttgtcaggcatatagtatgtattattaatatttaatatgtattattaatgttccctacctatagtgagagctatcctggcttaatcagttatccttcactccaggacgaaaccatgctttctgtggttacctgaattccaggtggggctaagcacagctaagagtatctggtagcctcttcaagtggcttttgtatcacccaaaccttttaaaaactgccacacaaactgataaaaacgtatacttctgtctatccttgattgaatgtaattgtcactatttattttaaagaaatggacaacttagagccctattgcaacacatcccaaacccagctcacttaaaccattaatcaaaacatttttcctccctacctgtggtctgtaaggaggatacaatctagtctctgattgcacaattaaacaggtgcagaaagcagtctatggattcatgccaaatgagtggtactggaagggaattctatgggagttcaaagaaaccggaggtcacagtagatcagagttggttggcgggagtctcgggggagaaatggggtttgacgtaggccttgaaagaaccgataggattcagacaaacctgagtaatgggagggtgttccgagccacacacactgattgttcagtttggtttgctcagctagaggacgtgttgggaagatgggtctgattggaggtgacgttgacacccagacttagattctaagggcagggggagttccctgaaggattttaagtgccaggggcctggtagtgctcgtgtgttaggcagaagggaggcgaactaggctgtcacaatcatctagattggagttactgagaatctggatcgggtggacatgaaaagaaagcagtggattcaagttacaaaggaagaattggcaaggggtggcaaaacagtcactgcttggaaaaaccatttttctgaagcataatgccactttgtttttgtttttgtttttgagatggagtctcactctgtcgcccaggctggagtgcagtggtgcgatctcggctcactgcaagctccgcctcccgggttcacgccattctcctgcctcagcctcccgagtagctgggaccacaggcacccgccaccacgcccggctaattttttgtatttttagtagagacagggtttcaccgagttagccaggatggtctccatctcctgaccttgtgatctgcccgcctcggcctcccaaagtgctgggattacaggcgtgagccaccacgcccggccaccactttgacccctgtctttgctctgtgtctcctgaaggacaagaaggccatcgtgctaggcttcggaattccctgcctattcgtgcataatttgaaatcatctctatgtagctttcagatgctcatttccttctggactccctagtacaatttcatcaatttcatattctctctctctctcctctcataggtatatagtatatattttacttgatgactgactcaagaattttcagatgggttctgatcttgtttagctggaagcattttctagagagccaaagccattgttattttggcttctacatttattgtcgtatattcaagcagaacagtgtaaaaatgattaccaaagttgagcctattatttagattttgatagtatgtgtgtgtgtgtgtgtatatatatatatatttgagaaggagttttgccctgtcacctagactggagtacagtggcaccatctcggctcactgcaacctccacctcccaggttcgtgcagttctcctgccttggcctcccgagtagctgggattacaggcatgcaccaccacgcccagctaatttttattgtatttatagtagagacggggtttcatcatgtcggccaggctggtcttgaactcctgacctcaggtgatccacccacctcggcctcccaaagtgctgggattacaggtgtgagctaccacacctggcctgatagttatgtttttaactctagatgactaaaagacacctataaagatatagaagttaagacaaaagtcacaattatgttgacaactgctgttacagtgttttcaatatatttatccaatagaaaagttttattttactgcacaataatatgttctattaaattaataaaaacgtactcatgagtgacttcttgtcatacagatctctatatctcttagagctgtatgtcggcgttttctctctggatatataatatacatattaatcaattcattcattgagcctgtgcttggcatgattccaggtgcttcagtataatagagcaataaagacaagccccctgctctcttagatcttacttttttttttttttgaaatggaattttgctcttgtctcccaggctggagtgcaatggcacgatctcggctcactgcaacctccacctcccgggttcaagtgattctcctgcctcagcctcccgagtagctgagattacaggcgcccgccaccacacccagctagtttttgtatttttagtagagatggggtttcaccatgttggccaggctggtctcaagctcctgacctcagatgatccgcccacctcggcttctcaaagtgctgggattacaggcgtgagccactgcgcccagtcagatcttacattctgatagagggatatagacaataaacaagccagaaaatacctgccagtcaaaaagctgtgatgggaaccagccaggcaaagatctagagggagagcaccaggcctgtctccacttatgtgagacgtacagaaacacacagcgccttgcccgtgggaggttctcaccacgtatttattgaggaataaatgagtgaatggatgtattcattggcctgcttgtaaaaccttcaccagtggactcttggcttttagaactttattacaggttgagtaatatctgaaatatcccttattcagaacacttgaaaccagaggtgtcttggattttgaattttggggggtttggaaatatttctactgtacttatatttatcaagtgagcaccctaaaatgaaaatctgaagtcctgaatgctgcagtgagcattctctttgagcatcatgctggtgcttaaaaagttttggattctggagcattttgggttagggatcttcaaccggtatgctaacaatagtgatcttatgtagtattttccctccaaagagatttgagagagaaataagtggctgccgtggttggccgtctttctctggctcacttcaccttgttgccctcggataactccagtgaactccttcttacttttcaaggccatggctcttccaagcaacctccctgagccccttgggctgggtcaggagggttccccaggcctgcatggacctacaatgtgctactgaaatgatcatttatgtgtctgtctctttctctaaacagtgggctcccccagactgggcacaaagttatttacctaatgtagccaagaggtaggtgtgcaagaattgttttctgttgagatgaaaatcaccaagcctggtcatttgctttctgtgtagacagcagtgtgttgttcacttaggactctgctctctgtctcgtgcaacttaccctttatttagggaaaatgaacaatctgtaaacaataagagaacactggcaaatcaatacagtcaagacctgtgggaaaatgtagaggtgtcaagagtaagagaataagctgagggagcaggtgtggatcaccatggtctcctttgacttgctcaataaagaccctctgaccaaaggttagctgcaaacgcctttgttttggagggctagtatgcagtggtttcgtgatgtgtcttttatatggtctcatggttttcaatttcttaattgatgtttctgatttacctgaaagctttaaatgttcatgatcttggcttggtacacattagacattaaggtttacaaccgatgcctgtcattgccatttgaatgtgttggtgacattcctggtgtggcaagctaggcgagtgtgcccccatcgacaaaagaggctgaattctatattctgcactatatggactgcctttctctttcactcacttgctttttaaatgacacaattcatcccattcttaatgggggttgggggagaaaggaagaaggaaacgaaagcaagcaaaagaaccactcagtgcccgcaactgttattatgatcttggtatatagctctaaatactttcaaaaatatacttgaaatactttcataggttttacaacaaataggattatacaaccaattttatcacagtgaatttccaagtcaataactgcttttcagactatgttccaaggaggggccggggttgcccagctcaagagaacaggaatccctgcaaagggccaggggcccgtcagtggctcctcctcagtgcagctctgctctctcggtttttttattgatacataatagaggtacatattttgggggtgcatgtgataatttaatacgttcatatcattgtaaagatccaattggtgtcattgggatacccattaccttaaatatttcccctttctttatgctagaaacatttgagttcttctgttctagctattttgaaatatacaatagattattgtaaactgtagtcacctactgatctgtcaaacagtaggtccttttttttttttttttgagatggagtctcgccctgtcacccagtctggagtgcagtggcatgatctcagctcactgcaacctctgcctcccgggttcaagtcattctcctgcctcagcctcccgagtggctgggactacaggtgcccgccaccacatctggctaattttttgtatttttagtagagatggggtttcaccacattagccaagatggtcttgatctcctgacctcgtgatccacctgcctcagcctcccaaagtgctgggattacaggcgtgagccactgctcctggcttttttttgttgttgtttttttttttttggagtctcactctgtcgcctgggctggagtgcaatggtgcgatcttggctcactgcaacctccacctccctggttccagtgattctcctgcctcagcctcccgagtagctggaattacaggcatgcgccatcatgcctggcttattttttgcatttttagtagagatggggtttcaccatgttggccaggctggtcttgaactcctgacttcaggtgatccgcctgccttggcctcccaaagtgctgggattacagacgtgagccaccgcacgcagcctcaaacactgggtcttatttcttctagcacactgtatacttgtacccactaaacaacttctcttcgtctcccatccccgctgcccatcccagcctctggtaaccacccatctactctctgtcttcaccaactccacttgtttagttcccaaatatgagtgagaacgtgtgatatttgtctttctgtgcctggttcatttcacttcccataatgacctctagttccatgcatgttgtacagctcttctctcattggaatatattttgtaaaacaaacaaaaaaaaattgggggtatgaaaggttttcactgctcatataaatgacaacttgtaaactactgtgaatagcaatattttcattgagtagagtgctaccaatatgcccattcagaatgaaaaactctgacaaacagctctgtccgtatatccttatcactcactgacaatcttttgattggcactggagcacccatctgctgggttttgtggagactgtggccatctctgccttttagactgagctgctcagacagttgacccaacaccggctgcctccttgccactgaatcggaatgaggtcatacttgtacatgcttcttggaaggttttcaggcctcagctctactgagcgaagacttggttgagtaacaagtgaggaggaaactgtagggttccattgtttacaatggggacagcctgcggcaccactagacattctgaggcgggtcctggttgggggtcagaaggtcattggataggcgggaaaaaaaatcattgcaaggttatgattgcaccagtgcattccagcctgggcgacagagccagactccatctcttacaaataaatcagaggaatgggagaaaatatttacaaatcatgcatttgatatttctccaatcatataccggtggccaataagcacacgaaaagatgcttaacatcattagtcattaggaaaatgcaaataaaaaccacaatgagatgccacttcaaaccgtctgggatgactataatcaaaaagacagatcgtgcattgggggcattttgagcattggtgaggatgtggagaagctggaacagtctatacgttgtttgtgggaatgtaaaacagggcagccgctgtggcacagtctggctgttcctcaaaagcttaaacacagagttaccaaatgatctaacaattccattcttagggatatacccaagagaactgaaaacatacatccacacaaacattagtacacgaatgttcatggcagcgttagtcaaaatagccaaaatggaggaagtaacccaaaggtctatccctgatgcatgaataaacaatgtggtgtatttgcacaatggaaagttattcgccacaaaaaggaataaagtgctgatgcatgctgccatgtggatggaccttgtaaacgttctggtagctgaaataagccagatacaaaaggccacatatagtaaactgcgtttatatgaaatgtccaaaataggcaaaactatagagacagaaaatacatttgtggttgcctagaactgggggtgttgagtgagacgaggagtgagtgttaaagggtgtgagtgaggaagatattccgtgttccatgatgattacatcattacatgcatagtgattgcacaactctgtgaatatatgaaaaatcacttagctgtatacttatggtgagctttatgttatgtgaattttatctcaatattaattttaaaatccaatgaagggcaaatttatattgtttttggcttttaagaaactgtcttaaaagacacatttatttatttatttatttatttatttatttacttacttacttacttacttacttgagacagggtcttgctctgtcacccaggctgaagtgcagtggcgtgaccttggctcactgcagccttgacctcccgggctcaagtgatgctcacacctcagcctcccgagtagttgagaccacagacacatgccatcatgcccagcgattttttgtagacatggggtttcaccatgttgcccaggctggtctgaactcttgggctcaagtgatccgcctgccttagcctcccaaagtgctgggattacagacgagagccaccgcacctggccaccccttttatactttgttaatggagaagtaaataaacagccagggtgtaaacaatacatgcacccccatagttcaaagggacaatggagcatatgtgttgatgtgtctgagaaaaacagaaaaaatgcttgtccctggaatgatggaaagaattgttacaccttgagaggagaggtcaagggtggaagtctgaaacaggtgtgggagatgatatttctaagagtgagccagtacgtttctggcaaaataaagactttagcaggctactagtttgtaaaaattaaactgcaaaactggagctggtttcacccttattttttaattatgtgggattagtcatttgtgcttgatgctccctcttagctcagccccatttctcttttctaaataaaaaacacttggttctaaatcctggcttagaaagcatatttttgaagctcaagacagaaaattcatttgtttgtgcattcagcaaatacttttcaagcatgcactgtgtgccgggcactgtcccaggcacctgagacacactggggaaccaagacgaagattcctgccttcaggcagcttagatcctggtgggggtgggggataggaaggggcagagacagatcatccaccacaaacacagtaggttagtcaatcctgtggcagattggaaggtgataaatgctatggagaaaaaagaacaaggtagcgcaggtacggaagtggaatggtgcaggtggcatgagtagccagggtccataacatggtgagatttgggcagaggcatagaggaagtgggggagctgaaccaagcaggtgtctggatatctctgagggaaaagcattcccagcagagggaacagcaaggttaaaggtttgaagggagagcgggcctgtcatgttcaaggaacagcaaggagtccaggttggctggaaaagagaccgaatggtagcagagcaagtcggggaagtctcaggagggtcagagtctatagggcctaggaggccattgtaagtacttggcctttttaacaatttaaatgtaattcatataccataatatttgcccctttgaggcatataatttactggtttttagtctagtcatcatactgtgcaagcagaacattttcttcaccccaaaaataaactttataccataaacacacacccacacacgtccctcttccagccgctggcacccactcatcaacattctggctctacggacttgcctattctggacatttcatattaatggaatcatacaatacgtgaacttctgtgtctgctttctttcacgtcacataatggtttcaaagtccatccatgttgtaacaaacattattagcacctattcctttctgtgtctgactagtattccatggtatggatagaccagtttttggtgatgcattcatcagtggatggacatctgggttttcccacgtttggctgttgtgagtgatgctgtgatgaacgttcatatccacgtttctgtgggggtgtgtttttctttcttgggtgtctgccgaggagtggaaggacttgagcattgcttttctcctgtgtgaaatgggaaccatcgcagtgttttcaccaggatctgactcgcatttttttttttttttgagacggagtcttgctctgtcgcccaggctggagtgcggtggcgcgatctcggctcactgcaagctccgcctcccgggttcacgccattctcctgcctcagcctcccgagtagctgggactacaccacgtctggctaattttttatatttgtagtacagatggggtttcaccgtgttagccaggatggtctcgatctcctgacttgtggtccacccgtatcggcctcccaaagtgctgggatgacaggcgtgagccaccgcgcccggccctgacttgcattttaaaagggtcgctttggctgcctgttgggtatcgactgtgggtgaacagtgagtagcaggaaggaaaccaggcaggatgtgatggcagcgacgtgggtgagagtggtgatggatcagaccagggtgggagcagtgaaggggttgacagattctggatgtattttgaagatagccaataaaattcttgattactgtgagagaaagtaaggttgtgagaatcagcccgaggattttggcataacctgttggaaagatggagctgccattaaatgagatggggaggggtcctgagggatcaggagcgcagctgaatgcaccgaggtggagatgcctactagacatcaagaggagacgtccagcagagggctggatggatgagtctggaattcaggaagcagcctgggctgcagatataaatttgggaatcattggcatctagatggcatttagaaccctgtaactgagtaagatcactaaggctcccatttattcaaaggacaaaacaacataaatgttgacagagagtaataatcttttctatttattgagttccaacagtgagctcctgttatcactaaaaacagacatcgcagataagcttctccagaaatacatatttcaacctggttgagctataggcacccagggtatatctacagaagccaggtattaatatcttagaggcatatgcatcaatatcgtgtgaagtcttttttgttagctcttttctgattatgctttcagagtttttttgttgttgttgttatatttttgttctcccatgtataccttggtttgtgatcagtgtgtaaaggaggaggaatggttgtttggttgagacatttgcaaatagtaagcagtcaccttacctaacttggctaatttgcattgtttccatacagagaatgtagtttgacagtcaaggatgatagaaagtcagaggatgatagaaaacaatcctttcttcatacagattaagaagaagaaatgaataatctaaagaaagaaataacaacaagagacagatgggatgctgactggtccagaaaccgtcaggtagcaacagttgcaaatctgagggagttcagcctggagaagaccaaggggagagagtagaaaggatactcaaatatttgaaaggacacaggcttcttttctgttgctctatatagaactaggattcgtggataaggattgcaaatagacaaatttccacttaaataagaaaaaactttcaaataattaaagctgcccggccaggtgcagtggctcacacttataatcccaacactttgggaggctgaggcaggtggatcgcttgagcccaggagtttaggaccagcctgggcaacatggcgtgaccctgtctctccaaacaaacaaacaaacaacaaacaaaaaactagcctagtgtggtagcatgcacctgtagtccgagctacttgggaggctgatgagggaggatcacttgagcctgggaagtcagggctgcagtgagccatgaccgtgccactgcactccagcctgagcaacaaagaccctgtctcgggggggaggaaagaaaaaaaactgccgaactacatgcagggtgggattgggcatggtacctgggccagcctgttggcataacatgtggaagcgggtgacccacagtcaggggtcagtctgagggactgccatactgggctagggcctctgagtgctctgccagcttaggggttccatgattctcagcagatttccagcaggtgtttgagggtttctgcattcagtgacataaacaggccctcgtgcttctgtgggttataggccagcttggtaccgtataaccagtacatcaagagttgaagtgttgcactaatgctttccaagagtcagagctggcagagtgaccgggtatacaggcagagtttgtactctttccttttagaaacacactctgctgtctgtacctgaattgttctcactctgtggaggacttgggattcttgatgttatttatcttatgtgttccaagtgctaagtagtttaatcctaatacttttaaaatgttaaaaaaaaaaaaaaaagagagagagaaatgtttaaagtttggatagaaacccttagaatcattaaatattctcagtgaaagggaccacagaggtcatctgggcccatttcctcattttatagaaaaggagtctgcaagatccagacagcagttcacccagattagttggttgattcaaactttcccttcctatttctctctacagtgttttatctacaattatattatatttaagatttggcaacaatgaccatatgagaagtccttgtaatatgccaggcactgtgctggccgtgcgttgtgcgtgcattttcctatttaaaatgccacctataagtgccatctttggaatatttgtcctttagaaagaagcatctgcttcaaaccaatggcagagacaaaatggcttttctcttatctttactactgtgtggatttctccataaacaagaactggcaaagggcctcataacagctctgtggccctctctgggctcagagaatgcccgtagccaccagcccagctggcaacaaatggttgcaggttctgtttccatgtttcagtcaatctgtctagagaacaatggaactcctgaaccattcccgtgctcaaatgtaacgtaaaaaggacaatataaaatatcaggcttctgtgtttgaactgctcccctggggaaaggagcatggtggttgggaactcagcattaaacaaggaaactcgatgtgtatccagcatcactgagtgctcaggtctgcagactgcagagagatgtaatgcttattcctgttcccacatctttgatctttttgcgtgaagctaatatttgagaattctttatttccctggagtgtcaaacctcctgtcaactcgccataaagacaaggaagagatttcctttttcaacaagtgaggacagatgtggccaagcgttgattattattgtaagagatgaatacaaatgttatcattactgagtgctaagctttgtttatttcttcagaattcccctagtgcctctgggctgggaatctcacccacagaccttgatcaatgtcccctggcactttgaacagtccttggttggacctgacagcacgctccagtcttacctttcactggtagcacagcagcgtctaaccgatagggactcttcttggctctgtgtgtacttttaccatcctagataatgaagaccagagccaaggaagagaaagataacaaacgagagagcatatttgattctaggagatttgactgaagatggagatggtcaggtaggcaattcaatggggaaagacacttattttttatttattgacttattttttgatacagagtcttgctctgtcacccaggctggagtgcagtggcacgatctcggctccctgcaacctctgcctcctgagttcaagccattctcctgcctcagccttcctagtagctgggactgcaggtgcgcaccaccatgcctggctaatttttgcatttttagtagacggggtttcaccatattgtccaaggtggtctcgaactcctgacctcgtgatcctcccgcctcagcctcccaaagtgctgggattacaggcatgagccaccatgcctggtcaagacactgatttttaagtaagaccttccaatgagtaatcctttataatcaacattagaactagacgagtattcagaaatgcatgttgttttatatgataacacaaaggactgaatacaaacatcattaaccaagctcttctgagagcttggggaaaaagctgcccgagggtaccctgctttgtgtgcatgtgatatgttccatctgcctgaaatgttcctttgaaataagaagcgagggcacagctgggtaggagagggttgggaaggggcccatggaggactcacctcactgatgtgctgtggaggttcgatgaatacattccccgcttccctcctacccagtgtggcctgatgatcacgactagtgttcctaccagtgaatggttcaccccgaggcaaatgcgttccctaaggaagatatgtgctgtgagtttccagttgtaagaagccagtggagacacccaggtagtctgtgttgttgaagcctcacgatctgggagggcggtgtgatgaatcccgggcagccacacacagtttccggcaataccacatttcatcaattccgtgttagaacattgagtccaagctgttggaaaaagcttccccttcaggtgtgaggaggcccaggcagcagatgccaggactcacactcctgggcatcatttattttggaagttggggaagcaggtgccggacaaagctctgggtcgtcttcttttgcatcccctccagatctcacagggtttcatgggtgccctgtgtttgatgttcagtgtggaatccaagagcctggtgaggagaagctgtctcagaaccagtcacaataaaaataatgatccacagttaacatgcatagagcatttgctttgtctcaaggcatgtgctgggtgcaccattttcatcctcacgggttctgctagtgtcctcatgcatagatgaggaaaacaaagcttagagaggtcaaaagagctgtccgaggtcacccagctggggttgcaatccaggtctgcctgaccccagagctccagctctgaacctctgtgcttcctgacctggcttcagtgcctgtgagtgtcacagtctcaccacagctggtgttaccatagctacttaacagctggtgttgggggagcggggaaagtgcagaaatgaagtttgcgttgttaacaagaaattttgctaattaattttggggggacacattgagcaagtccgcccaggtgcatgttcccacggtcccattccagtgggcagttgaatgcacacgtatgcatgaagggcgtgggtagtgaacttgtaacagcagaggaagcagaaggttaaaaggagaagctaaatacacctcagtgctggaacgttcattttgcagatttttgtcaggtttggcagagaaacctccaagctctaatcttacagggcgactacttgggaatcaatcgggaagcatatttcctgttactttagtgtagcgaaggcttctcctcgttcttttctactcttagtaatgtattagtaaaatgtgtttatgaaaatctgagtttcctcattccacctttatgtttttccttatgtctttataaaatctgtaagttagtttcctcattccacatttatgtttttcctcattctaatgccctctcttgaattgttagttctttgctttaatgacgctttgttaggcctgggctgatcccacgccatttttttatttcttctggtttgatttctgcttacacctcaaagatgtttaccttcatatcttctctttccctttacctgtgacctctctgccttgcctctcttaataagtgttaataatgctgggttacactttaactcactttgggcagtattctaaatcttaatctcttcaaaggaagtgctaatgaaatgtcccaccattatgtatctgtgttctcttacaaatgcagatgaagagccattcaatggagccacataactgcctttcccatcaagccttgaactgcaagtaaaggggcctgattgtgaggagtcagactcaccatctaggtcgcctgacagaggcccctcctaaccctgtccctggacactgtaacttctctaagacatttgatggtgaccaggcactccactcgtccatgtagtttctgggatggattcctctctggaatattagactgcctcacagattaaactgctaaaggaattttgcagcaaaatgaaatagattttggagcattgtttggagattggagatttggactttgttccaaattgcagatttggagattgttccaacaatttggagctgcttctcctccttcttctccttctccttcttctttcttctttcctcctcctccttctcctcttcctcttcttcttcttcttcttcatattattattattattattattattattcttttaattcttcaaaggagaagctcccaagagagtcgatttgtgtgagagggcctgtgactgggcccctgagagttgcttttttttgaattaactgggataacaaaagacaagcaggcatcttggtattttaagtgtgttttcccaatggaaatagaaataaacacaacactgaccaagtattcaacagagggatggctaaacaaactgtggggtatacatggaatagaatattattcagcaatgaaaaaggaatgtcattctgacacatgctacaacatggatgaaccttgaagacattctactaagaagccaggcacaaaaaggccaataatatataaatccacttaaataggggacctagaataggcaaattcatgcagacagaaatagtgattaccaggggatgtggggagggagaatgggtagttaatatttaatgggtacagagcttcagtttgggatatgaaaaagttgtggaacttgatagtggtgatggttgcaagacattgtgaatgcacttaatgccactgaattatacacttaaagatggttaaaatggtaagttttatgctatattcctagcatcattttttttttttttttgagacaaagtttcgctctgtcacccaggctggagtgcaatggcgtgatctcggctcactgcaacctccacctcccaggctcatgtgattctcctgccccagcctcccaagtacctgggattacaggcgcctgccaccactcctggctaacttttgtatttttagtagagacggggtttcgccatgttggccaggctggtctcagactcctgacctcaagtgatctgcccgcctcggcctcccagagtgctgggattacaggcgtgagccaccgtgcctggccttcaaaagtttttaaatgctgcatgtgaaggtaaccttaggagaaaactcttctgcttcttataaactggcgatgctgtgtagccgttttctgtgatcccagagcctgcagggcaaggctttcagagggcacacggtgccctttcacacgagtgatgctgacattttctccagagctgtgatgaataaataaatgaaggaaggagttaagattccttactactttgcatcttggtcaatagtcagtttgtcttctggttaaatatgagtatttttcgtggtggcaaccccgtcctccagctgctattcttacatatactggcatttacttaagtgagccctcttttcaaacaggacctgacctttcctaaaggagctttaaagaaatccatatttcctgattacaaatagaaaacagtgtgctttctcaagggttaatgtgggcaaagcaaagcaatgttggttctaatttaagcacatagtctttaggcttctttcgtaatagttcccttttgtccatttgggctgaaactgcttcagtaagcattttatgaaatcagtgagaaactccagaaaaaggcttctgcctctttttacgagggtcgtatttggagcaaaggagggaagaaaagcatctgtcaatttgataaatcattttcaggaaagaagaagtttcagcaaagtataagatagagttggcaatttaagggaggaaaaaaaaaagagaggagaccatcacatatagtgctatataaatggtttctatagagagcttttaaatatgtaaaataatttcatatatactatctcattagtgctcacggcaatccagtagttattatagagcttttaaatacgtaagataatttcatacatattatctcatttagtgctcacagcaatccagtaaagtagttattactttatgggtgaagaaatgaaggttcagctttattttatttcattatttattttacattttttattttaattaaatttttttttgggacgaggtctcgctctgtcacccaggctggagtgtagtagcaacaatcacagctcactgcagcctcggcctcccaggctcaagccatcctctcgcctcagtctcccaagtagctggaaccacaggcacatgccatcatgcctggctaacgtttccactttttgcagagacagggtctcgctgtgttgcccaggctgtggttcagctttaataagtggcttgctcaaggcctcacagcctgtaaaagaaactaaacttttgcagagcttccttcctgtccatagaactgtcccaaagtcggacgtcctgggcctgaggcacgggtttgtcacaaggggtggctcccaatagtaaaccttcatggctccctgtatgtgtggaatgagtctctaattgtggagaattgagaatggggggggtggttagagtcccttgaagtgttttgccagtgtagcttgtgtcgtgatacctctttgtgtcattgtaagtatgatcatgcccacatctttctgacatggtcttttgcatctgaatttgcagtttcacatttaacagatttaaacagattggtggcccatatgtatctaaaagagaaacatgtcatctccaggaccaactatatcatttgcagggctcagtgcaaaatgaaacagagggactctagctcaaaaatgattaaaagtgtcaatgtagcaacagcagagtaggcaaccaagcacagggcctacgtgctggccagtactctagcctggaaaagtgcaagaccttctgcaggtggaagcttcacagtgtgccttcagggtctgcttttgggctttctgccaatctggctacatacttaccctttgacacaatcaagggcaaagagttaaaggaaaggtagtcttgaggcctgaactctcttctaaccctattttttttcttcttttgagacagggtctcagtccatttgcccaggctggagtgcagtgacacaatctcagctcactgcagcctggacctcggctcaggtgattctcctacctacgcctcccgagtagctaggactacaggcacatgtcaccacatccagctaatttttttttttttttttgagacaagagtctcgctctgtctcatttgcatttgcatttcagacgcgccaggctggagtacagtggcgcgatatcggctcactgcaacctctgcctcccaggttcaagcaatcctcctgcctcagcctcctgagaagctgggattataggcgcctgccaccatgcccagctaattttgtatttttagtagagatgaggcttctccaagtcggccacgttggtctcgaacttctgacctcaggtgatccacccacctcagcctgccaaagtgctgggattacaggcatgagctgccacgcccggccatgtatctttttaagtacaggtggaggtctcattatgttgcacaggctggtttcaaactcctggactcaagccatctgcccatcttggcctcccaaagcactgagattaccagcgtgagccaccacactggccaacccagactttccactggtacactgtcttcattgctttgatagcaacttttaggctcccttagctttaaaaaagaatcctctaaccatatggggaaaaaaaaaaatcagcaacaactttgtacccacctgacattcggccagaatttttccaacagaacctaacaatagatatgctctctgaaaactctacccagatcgtacactccttgctgggtaggattgtttcagaggatatgaaggacaagggactgagccatgacacctgtcacttcccgtctgagcagttcctgaagaaacagcccccggggaatgaactaccccctctgcctcggggacaggcacctcctggtccacatccatccctggaattagatcggagccacagatgctatcactcctctgccgtggccccatcctcctctgtctggcttttgatgaactgaagactggggtccgggttgtaatggagacttagagttgagtgaagcattttagctttaagaagattattataattatctcaaggcactgaagggctgcttcatttgcatttcagacactaaaatcagagggcagatctttaagaggttaattttgtgagtgagtccttaataacagagggaccaagactcgattctttatgccttaggctaggtttgcagttggtagatgcaaaatatgctgataagattaaagctcctctagtgactcttaagcctcaggctcttttatttgcaaatgtcctgcaccctccatctcagagaactctctaggctccggtactctagaatcccttacagtggatttgcatggacaggaaagcgaattctcatctcttccaatcactgcaagacatggaacggatagtctggcggcacgtctggcagctgaacctcttcactgagaatctaggtaaaggccacttactgatcattataaatgcgctcatcataaagcagtccttctggatttctggcattttcttgaataaacttattgaaacaccctaaggagaactcagacatccttttcaaccctcaggagcggataagaggatgcagcttcatttgttaaattgcagttgcatgtcagttatgaataaacatggactggacttctgatgctaatgtaggaacgatatttgtacctcctggaagtaactcctatagctcgttttcttttaaaattatgcaatccacagtcaagtcctggggtacaagtctaagaggcgtcagccacacaagaggctaaagtgactttggggtagtctgcaagtatctcaacctgtcatttctccagacattcagatatagtacattttaaacacagcactgcctttttcttgaaatatttagtttcagtgttagctaagtttgtgattttttaatgcagaaaaaatgatttatttttaatttctgattcctcgtcgggctatgtatatgtaaagtccagggttatgagaaggcagaagtaaacttgctgggtagaaggcgtcatggtatcatgtgatgtggcttagattaatatgggccagaacactttctctttagacattgctaatgttattcttattcttctactattcacaataatagctaacatttactgagtgcttacagtgtgcttggaactttgctgagaactttataccaattatctgagttttacagaaacattttaaggtagatattgttaatatcccaatttgacagaaggaagaaacaggagttctgggcaggtaaggaacatgcccaagcattgctcactaataaatgactgagctgtgtgtaaacatagttctttccacgtccaaagcccatacttgtaaccactgcactgctgtttgtagatttgttcgactcctcagagcagtaagtcagtttcatcttacttgcctggcctctccattgagtattgaacttggcaggaaatagtgttgggagtgatttgtgatgtctgagataggtagatccagtacagaggaatgttgaaattagacttactagtcccatattagattcttctcagactatccacgagagacttctccatggacccaataccaaccaagcttctgtagaacattttttttttttttttttttttttgagacagagtcttgctctgtcaccaggctggagtgcagtggcgcgatctcggctcactgcaacctccgcctcccgggttcaagtgattctcctgcctcagcctcttgagtacctgggactacaggcgcacaccaccacgtccagctaattttttgtatttttactagagacagggtttcaccatgttggctgggatggtctcgatctcctgacctcgtgatccacccacctcagccacccaaagtgctggaattacaggcgtgagccaccgcacctggcctgtagaacacatttttattatgcagtccatgttcatatgtctagcctgtcagtgggttacttgttaataaaaagcagccgtttcatattagtgtctcattgaaagcagtgcctgttttccattcattctaccttggatttgttttcttcctcaatactgaattcttagaaaatgatatgtatgttgaaaaatacttgagaatacctgagaacggttctctgttgcatttattgctgtatgtgaacctgtctatcaagaatcccaggtgttttgtgatttccgtgtttgtgaaatacattaactctccttatggttggagaaatcaaaacagtgcaggtaaatggtgttttgaaatatctgtaatagtagcgaataagtcagagcctcacagtgcttcattttttaatggaaaatttgaacacatacccacctcttcagtactgaagaattttttcctgtttgattttgttgctgagattggagtttgtcccatgagaaatcactgaacagatttaattttgtttattcttttttttttaagacagcatatttgttctctaccaatatcatccaaagaatgaaatgaatttcaaccagagatgtaggacctaaaaaatttaggtcaaagcttacatataagtggctttgtcttgctggcatcagtattttcgtatttctcttctcaaaagaagataactttatatcaatatttcagaattccatgtagcccaccctactgactgcattgttgtctgttatgctgatacaaagatcttttgttttccttgcctgggatgttctgccatatctcagatggctggatggacacaggtggcctaaaattcctgtgccagattcagcatgatcctgacctaacttggcctggatcataaagtaaaccttggggaatgttcccgtagcctgagcgggaaacactggcctctgggagctccttatggaggagagaaaacgaggagctgtaaactggacaatggattaaaactctagtaaactggctggggtgcagtgtctcacgcctatcatctcagcacttcgggaggccgaggtgggtggatcaactgaggtcaggagctcgacaccagcctggccaacatagtgaaaccccatctctactaaaaatacaaaaattacccaggcgtggtggcgggtgcctgtaatcccagctactcagggggctgaggtgggagaaccacttgaacctgggaggtggaggttgcagtgagccaggatccttccactgcactctagcctgggcaacagagcagataatctcaaaagaaaaaaaaaaaatctggtaaactgaattccgggtcagatcttcagatcttacctcctgtgtaaccttggctaagttaccaaatttctcttcacctcagtttctctgactgtaaaatggagacacaagccagaaaatctttaagttcctgccaagttttaagagtttgaagcttccacgatactctgtgcccaggcccttcctgatgtctgcttttacagcgggacaagcagcaatgctgttgtactctctgcatcttggggcttgttcctctgaacccttgaagacaagggctgagccgcgtcagctctttcccaaaacacaatttaaacccttcggagtggtcagaaatgccactttgggaggcctccctgggttctctgggtgttttgttgaagcagtctcaggttctctaacgttctttttgttgaagatgatatctacaagctttataagctttcttctgatggggagagggaagaggttctcttaaatacagtgttcaactatcaaccgtcatctttagggagacccttcaataacctcagtttctctttgtgtataactagagctaataagagaatgtgggtaaattgggctaaaacaaagccaacattacagtagttcacatgatatttttaaaagaaaaacaaaggcggcacgccagactaaataaggctaccatggccaccgaagttttgcatcaatttgtgaccaaaggacatttttcaaactgacctaagccaatttggtatctgcagttatttttggtcaatatcattagcctcccatagttcaaagtaggtggggctataggttttctcctacaaaaccttgtttccaggtcatgttacaaaggaaataagtcttttatttttatttttatttttggagatggagtcttgctctgtcgcccaggctggagtgcagtggcgtgatcttggctcactgcaacctctgcctcccgggttcaagcgattctcctgcctcagcctcctgagtagctgggactacaggcgcgccccaccacatctggctaatttttatatttgtagtagagacggggtttcatcatgttggccaggatggtcttgatctcctgacctcgtcatccacctgcctcggcttcccaaagtgctgggattacaggtgtgaaccactgtgcctggacaggaaataagtcttaaaccaaattctgccatacttacaaacgtgtagcaagctgacaggaaaagtcctacaattcgttttgtaaacttgatgaaaagccacgcccctatccttttaggcaatcctacagcattttacataaagggtaccctagaggcaagtgcggttattgcactaatggcatgagccagataatcatccagttagtcaagcagagaaaagtgctcctggaatgacctgaacaatggaccaatcagttcaaatccctaatttgattaattgggcttgctggattttatacaagcaagaatgcctgctcaatatttctagccaatcactatatcttgaacataaccattttcaccaaagaaaaataatttctaactgccatgattccagttaaactctgccgttgaccagtaatagagatagccaaggcagcgtggcaacggcctttggagtgtaaccttctgatgagactctcagatgataacttggactggcctaggcactgagcaatcagaacagattctggcctcagctgatgctgtgcagaagcttcctactgagccagaattgtctcagagagctgccaaggcaaccaggtcttgagtggccaagatctgagatagaagggaactatagagagtggagaaggtgcttttctctccctgttcatctgctgagaaggcagcagaacttttggcagtataatgaggcttaaaagacaaaatttgggattcagacctgccaaggcggacaagacttaagagatcaagatcctgggaggaagagacagaaaagtgaactggatactccagtcgttgtcccctttgaagcatttgccaaatattagactgtatactgcaagagactaagcaaaaaaaccatttttagtggagttctcagtatcacagtgctaagtggaaaaaaaaaaatcacatggcggggtgcggtggcttatgcctgtaatcccagcactttgggaggccgaggtgggtggatcacctgaggtcaggagtttgagaccagccatcaccaacatggtgaaaccccgtctctactaaaaatacagaaacttagctgggcatggtggtgggagcctgtaatcccagatactcgggagactgaggcaggagaatcacttgaacctgggaggcggaggttacagtgagccaagattgtgccattgcactccaccctgggcaacaagaccaaaactctgtctcaaacaaacaaacaaacaaaaaacaatcacattcaaagcttagccaggagaaaaggcgctaggagataccccactgggatccttgaagaatcataacctaaaaatagatgtgaacctgaagtagacaagcgatacaaaatctcagtgagctcagtctgggattggtttagcttgatcactcccattcagctgcctaccagaggactgggcgaacgatcactgaagaaagatgggagtctctacctttctcataagttgtttcaatgaaaaatgatcaagcataccaagaaataagcctaaaagaaaaaaaataggcactggaaagatacccataatttactggcattatcagacataaatttcaaaatatctgtgattcatatgttcaggaagataaatgatacaataaagaatttcaccagaaaatgggaattcataaaaagaaactggggccaggcgtggtggctcacacctgtgtaatcacagcattttgggaggctgagttgggcagatgacttgatcccaggagtccaagaccagcctaggcaacacggtgaaactctgtctctataaaaaatacaaaaattagccaggcatggtggcgcacacctgtagtcccagctacttgggaggctgaggtgggaggatcacctgagcctgggaggtcaaggttgcagtgagtcaacttcacttcagcctgagtgacagagatcctgtctcacaaaagagaaaagaaaagaaaagaaataaagaaaagaaaagaaagaggaaattctggaacttaaaaaatgaaataatggatattaagaacacaacaagtggatctaatagcagattagatttagtacaagacagattcagtgaaatggaatgcaaatcagttgaaaatatccagagagatacatggagaacaaaaaggatcaaaatacagaaaagagcagaagagacatatggaacacatgtaacatataattgaaggcctggaagaggggaagagggaatgaggcagaagcaatatatttttctttttctttttagttgacacataataattgtacatatttgtaggtacatatttataggatacaaagtgatgattttggtataggtgtacaatgtgtactgatcaaatcatggtaatcagcatatctatcaactcaaacatttatcatgtctttgtgttgtggacattgaaaatcttttcttctagctttttgaaaacatacaataaatcatcattaaccatattcacctgagagtgctgcaggatgccagaactccttcctcctacatagctataatttggtctatagtttggtatccattaatgaacctctccccatccacctctccttcctacctttctcagcctctaacacctaaaattctacttcaaaatgtgatttaagaagccctggcttgccccaaccaggatatacacagagaaaaccacagctgggtacaatgtagtaaaactgttgaaaacaaaagccaaggagaaaaatgattaaagccgtgagaaaaaaattcattatttttaaaggagcaacactaagacagtaactcatttctcaacagaaacaatggatgccaagagacaatggaacgtcatattcatgggttgaaagaatgtaaccgtcaacctaaaagtttacaaacttaataaagatattcgtcaaacattgaagtgaaataaagacatttcaggacaaaaattgaaagaatccatcatcagtagaccaacactaaaagaaatactaaaaggaagtatacggatagaaagaaaatgatcccagaaatgcaggaaggaatgaaagctgacagaaagggtcaacatgtggttaagttcaaatgtattaagaatatgagatgtattgatggctggatagagggatggataaatatgtgataaagtaaatgtagaaaaaattttcacatgcagaaatgtggaaaaattaaagaatctggatgaggggcatatgggccattctatttttgtaaaatgttcagaaaataaatatagggcaaatataaatgaacattgaccatataaaagaacaaaaatggggttttgtgggcactaaaatatatgtagcattaaatgcatgacaaaaacaatacaaaaagtgaaagggggtaaagggagttaaagtgtaataaaatcataacatctggaagtattaaaactcagaattttaccagactataataggtcaaggacacataatgtaatctgtagagcaactagtaaaataatgcataaaagggaaaatagaatgaaaaatacttgattaatctaaaataattcaagaaagaagaggaaagagaacataaactaggtggactaatagaaaacaactgtaagatggtagctataaactcaagtatatccgtaattgagttacatgaaaattgactaaatactctaattaaaagataattattgttagactgtattttaaagacaacaaaatctaattaaatactgcttataagagacgcttcataaatgtaaggacaaaaagaagttgaagataaaagaatgaaaaaaagatataccttgtaaatgccaaccaatataagctggcatagttctaatataagagaaaatagacttttcaagaatcatcatgaagtcaggagttcaagaccagcctgaccaacatggagaaaccccatctctactaaaaatacaaaattagctgggtgtggtggcgcatgtctgtaatcgcaactactcgggaggttgaggcaggagaattgcttgaaccctgggggtggaggttgctgagagccgagattgcaccattgcactccagcctgggcaacaagggtgaaactccatctcaaaaaaaaaaaaaaagataagtatctttaatttatcattaatgttaaatagccaaaaatatacagaattaaaagaagaaaccagtctgtaatcatagaaacaacatgtctctctcaaaaactgatagaacaggcagacaaaaaatcagttaggagagaagatctgaatctctcaacaatgacacaattcatttccaagtacaactgggacattaaccaaaattgaccatatgttggctcataaagcaattcttgacaaatttcaaaggactaaattcattcagagtactttttttttgaccagagagaaattaagctgtaaatcaatgaccataaaaatagaaaatcaccaaatgtttagaaattaagcattctacttgtaaataaccaacaggttaaagaagaaatttcagtggatttcagacaatagtttgaaatgaaatgatgaaaattttacacgtcaagcgctaactaaccactcacccctgaagtgtgtattcctaaggtacttcaaatattaaataactactcctataatgtaaattaataactaacccacacattattatactatgtatactgaaggactgttatttatttatttattttaagacagaatcttgccctgttgcccaggctggagtgcaatggcgtgatctcagctcactgcaacctccgcctcctgggttcaagtgattctcctgcctcagcctcctgagtagctgggattacaggcatgtgccaccacacccagctaatttttatatctttagtagagacagggtttcaccttgttggccaggctggtctcaaactcctgacctcgtgatctgcctgccttggcctcccaaagtgctgagatttattctatcatattatcattcatctcaaactccatatgtaacttgcagttgatttttcaacattcaaacatcatttattattatccatcaaattgccatcttgttccatttccctgcatatctcctttctgtgtagaagtcttccttctgggagcaggacgaggtaagtgagatgagagcctgggctgtcacactttatattctaatatttttaacccaatttgctttagtgtggtcagagaagctggaaattgaatcagagacctcaggggcaactcaggtgataagtcagcctggatgtgaagtttatcagtcttggctccgtgtgtttaattagaagctagtggaatgttatcattgactccgccagcaaacatcttcactggagaggcagctgggttaaggaagaacatgctgaaaatagagcttatgaacatagctgaaaactgtttatccacagcaaccagcagaagtgaggggcgggagagagcccagcagttggcaatcagagcgtgcatataagcaaagggatcatttcttccaagctgtgtcagagggcactcaatcatgtatactgagctttcttcctgaaaagatagttcaaatctgtgtggattgtcaagttttcttcctctccataatatggtcattaatatttcacttcttttagccaggaactttcaataattcaacatctgctcttccaggctgcctgcaagaaaggccagtttccacccactgccctcctgggtttgtccttccaggtacagaatctgagaggtactggggaaaagaggaggcaacgaggctagtctctcactcctctctcttccctacctgtgtttcttggacgggttcacattcttcttgcatcagatagtaaatgcagtcaaggaactggtgaggaaaatgggaagtttttttgtgcatgtgttagatgggaagaggaaaattggcaagtgttctttaagaaaagcagacacagttacattcatgaggcaaccggttgccagactagtgtgactcctgaaggaacaacttggattgcctttttttttaaaatcagtttttatctagaccaaatctcttttatttcagtgatgtcaagcagctcatgttaccttcgcccaaagagaaagatgtatgggagcttcaaactcaggacaattctcaatgtccttagcgttgactcatattaaaaatgttaagagaacactagaataatagtgatgtgtgtgtgtgtgtgtctgtgtgtgtttgtggtttcctttcctggaaaccctttctaggattaacctaggttaatccaacataatgatagtctgaagaggttgaataaatcagcccagatacgcaggtgatttagccaaggctacatggtgagtctaggggcaaagccgaataagggtggagtccctaattcatagctaacctgcactgccatagtctatcggaagtgaggtagagattattatctgattttattattccgggacacgtaaacttggctgaggacacacagctcggaaccctagcccatagataaatagacaactttatagagtataatttgagtaagccaaaaagtttccacttacatatattctagacctccactttaaagtaatttgagggggacagagaggcaaagtgagcagcatttcttcagaaatcacgttgtctggaaatagctcagtagtgcgcatggcactccgttagccaattgctgtcctgggcctggagggccatagagctggacagaggccttgttttgtttggttcggtttgtgcttgtggtattcaggctggtaggtctgatggctggtaaagtgctaaagcaatcatgggtgcgaggtacacagtggggaatgtatcaaacggtcactttcctaagggagacattctcccccttctaggaatttgctgagggttgggctgagtggaagcgtttccttcctgcctgttctctgacttccaatgcgcactttgttttaggctggatagctacacatcatcaatgagattgcagacagtccctgtgcttgctaagaacggtggaaggttttaggactactgtgtcttacatattcattgtctaagcccccaagtgtacagcattcaaagctattccttccagctctgaaatttctttgggtgaaagctgtcgactttccttagaggaaaaagaaagccatttcatcagggcactgacctcattcctgtaagcttgactggctgagccctgggagtgacacctgtcccagtctttggctttagcaagtgattgatttgaagaaatggtattggtcatttaacccacaaactgattctgaaataagactcatttgtaataaatacatctcacatttgaggactgaattcttcaacacacattccaagttttgtcagttagaaaaaatacagtactttgtaaagtataaaatccataactctatataacccaaacaataggttgaaaactgggtttgttgtaagtaacgtattaataacacctggtgtaatacctgttaacatgctcggtgcctgaagcaaattggcaagcgtttcatctccttttgccaataacttgtcagaaactgactgagggttccttccaaactctcagaagaacatccaaggccaggcagcttatgtagctcttgaacttcaccagggcgagggctgggccccggccaactagagaagccacagctgaatcagaggaggaattccgaagagctgggcaggggcctcctgatggcgagatgctgaatgggataagaatgtgatgaattaattgatttgtatcttacgcaagagctgcagtgaggatggtgaaattcatttccttccataggtcctgcccctttctttgtaagtcagtcagcagcattgccagagctgcctaaaatgccacctccatcccctgacaatcaaagaggaatcttttcatgcaggctgagttctaatgacgaactcattaaaatcaagaccacttactatgcgtatgtgatgtgttataagcactttcagatgcatgattttaaacattctggccatcctgtgaggtcagtaccatattatccccatttcgtggacagaacagtcgtttagagaacttcagtaatttactcgaggcaatctggtgtgaaaagtttgagagaggacactgcaaccaggccacctgggtccagatcttggccttgccacttacgagctatgtgaccttgagaaaaggtcttaacttctttgtgtttcaatgtccttatctgtagaataaggataatagtgttgcggatgtcacagagtcgtaatgagggttaaataagttgatatatagacagctccgagaacctggcctggcatatggtaaggactagctacttatttgtggtggtgatttgtttttactctgtgagagatttgaacccagtttagtttgatgctagggtcagagttctttgtcatctgttcttaagaagccagtggaataaatatcttctttctcctacatttacaaagagatgataatcctgctttagaagagttatcatgcctgcagaggtatcatagagattagtttttatccgcagagcactttttaattggaggataattgctacactggactagtgtggtagtaggaattcatatcaaaattagactttgtgactgaaagtgtaaacaaatgcattcttgctaagactagccacatatttagaggcatatagcagtctgaaataattctattcctttgtcaacacacagacggaggaccgttgggccttttgctaaatttggctctgctgcacttccgtctttagaactaggcaattgcttcatcatgcctacattgtgctaccctgatattttggtacctactgcactgccgcacattcatgggacgccagctgtaccatctatataataatctgagaacttggccattcaccatccaaagttttcatacaaaccaatgaaggcggcgtgcacttcagatgagcaaacaccagacctgtagtataggtggacagataactagattttgcttttctgataaaaaaggaatcttgtctgttgttttagaactactttatatggacagtgagtgcagcatgatttcttccaactggagatttaatggagacctggatcaaacattacatactttgttacatctttttgagaatgagttggagtgaggggatgttatgttgaaaaagaagaggcaggctgggaagggtggctcacacctgtaatcccagcactttgggaggccgaggtgggcagatcatgaggtcaagagtttgagaccagcctaaccaacatggtgaaaccctgtctctactaaaaatacaaaaattagctgggtgtattggcgcacgcctgtaatcccagctactcgggaggctgaggcaggagaattgcttgaacccaggagggggaggttgcagtgagccgagatcctgccactgcactccaacctggcaacagagcgagcaagattctgtctcaaaaaaaaaaaaaaaaaaaaagaagaagaagaggcaacacttgtcttggcaaaccatgactagtttagactgcaagctcaatgaagatcaaaactaggttggtcttgttttgtttcaggcactctctgtatgtatttgttgaatgaatgaatgaaaataatagttatgattataatattatctaagtatgaagaacatgcctctggatcagtaaagacacataaaatggtaggagggttaaagaacatcagtgggtaccaactgttttgtcatgacagggggatatctctgaaaaatttctgtattaattggaaaagaagcttatggtgaacttttttttttttttttcgagatggagtttcgctcttgttgcccaggctggagtgcaatggcgcgatctcagctcatcgcaatctctgcctctcgggttcaagtgattctccttcctcagcctcccgagtagctgggattacagacatgcgccaccaccccggctaattttgtatttttagtagagacggggtttctccatgttggtcaggctggtcttgaactcccgacctcaggtgatctgcccgcctcggcctcccaaagtgctgggattacagcgtgagccaccgcacccggccatggtgaactctttttaaatgacacataaaatttcctgatttgtcttttaaaagttacatctagattttcatgtatcatttttcttataaggatagctaattaatatatagattttatgtatggattttcatatttcatgtatataacatgaattaaactgttatttgtatgaagtgccaagctccttttgggtagtacctaccaccctgtatataccacatgccaaatgagtttttaagatattggcatgtcccaaattcaccatttacattcttgaaagtacttcctttgttccatacagatctaactaaatattagaggtatctgaccttttattttttgaaaaaatgtttgatgttctgactatttgcaacaaaagagctctgttctcaaatgccctgtatggagagaatttctcggttcttttgagagggataaaaaacctctcttaagtctgtgagactaaagataaagggcatcccagcaccatgtatctgagggataatgactgtccgtatcggagagctgggcggtgatgggtgtgttggaagcaccggctggaccaatggacttggagctagaacttggttttgctctcggcgttgccgcagggtggctgtcttgccttatgcaggttttgattctcttctgtaaggatctggtagctattccaaagccaacccatctgtgctatgggatttgatgccacatgactccagctaccctggtaggcctttcccaggcgttggtcagagatatgatccaaaggctgtctgtagaagattgttctctcctgagtgttctgatgcagccagcacaagggtttcctaaggaaaggaacctggtcctgcttcggtcgttttcgtatcccctaggggctgctgaataaagtactagttcccaagctttctgtcatatcttctctgcacacttctggagtagagtgggtgagggcaaggccaggaggtcagtgccacagcgtgggaagagaggaggccctgggccctattctctctggggagctttacatcacccattgctctctccatctccccagggcccagatggctccattctagagcttctcctccaaccccttcccaccttccatcccaaacactttcctctctccttcttggtctctctctctctctttctctgcccttccttccttccctccttccctccctccctcccttcctctctttctccctccctccttccctccttccctccttccctccctcccttcatgttttcctttcttccttctttctttttctttttttttgatacagggtcttgctctgttacccaggctgaagtgccacccctgtgatgcctagtggtacaaacactgctcactgcagtcttgacctcctgggctcaagcaatcttcctgcttcagtagctgggactgcaggtccacaccaccactcccagctagttttttaatttttttgtgcagatagtgtctcactatgttgcccaggctggtctcgaactccttgcctcaagagtcctcccatcttggcctcctgaagtgctgggattacaggtgtgagccactgtgcccagcctctctgctctttcccttccttctcctcttagttaaaattgtagccgtggtcagaggtggctctgtctcctcgtagaaagcagggagcaagactacaaaagaaatggtaaaattttaacgaattttaaatgaataaatccctaatttcctatggaatgacaaactaaatgatggtttgtagttggaaaattaagcaataaaatacttttttattttttgagagagagtctcgctctgtcacccaggctggagtgcaatggcacactcttggctcactgcaacctccgcctcccgggttcaagcgattctcctggctcagcctcccaagtagttgggattacaggcacgtgccaccatgcctggctaatttttgtattttagtagagacggggtttcaccatgttggccaggctgttctcgaactcatgacctcaagtgatccgcctgccttggcctccaaaagtgctgggattacagacatgagccactgcgcctcgcctatttttttttttttaataagtctataataggtatacacagggcctgactattccagatagtgtcagctgtgtagttttcttattagcagacttgggatctatatttatagacaattgaagttttaaagatgtaaagaatttatttattcattcatttattcttttgagagggagtcttgctctgtcgcccaggctggagtgctgtggcacaatcttggctcattgcaacctctacttcccaggttcagtgattctcctgcctcagcctcccaagtagctgggtttacaggtgcctgcaaccacgccctgctgatttttgtatttgtagtagagacggggtttcaccgtgttggccaggctggtcttgaactcctgacctcaggtgatccagccacctcagcctcccaaagttctgggattataggtatgagccactgcggctcatacataaagcattatatacaattgtcattatatactgtaatgtaccttcattccttctgtctgaacaatgtggattttagaaataattaccaaatataaacactactaaaatgtgtagatttggtggtgcagcacatcaaggagcacaaattttacaaatttctttttaaccatctctgcgttgtattttcagaatacggatgattcattttaatcctggtgtctttaaatgattaaggattttcatacatgaggtatttcccacagggaaattctaaggtaatttgggtatgattcgtttagagtttttcattatttacaacaatttagtaaccattagactttcttccttgcatgtgaatacatacatatatttttacatcaagtatttccatcgaattttagctgcttatattttctttttaaccattacttggaatggtattttcctataagcggggaataaagaaactacttctgtctctcgggtatattaacagggacagtggggcctaatttcttatgtcccctcagttagcctttgtcacagacactcctgtgttttggggtcaggagggaagagatcattgcagactacagtcatggaatttgattcatttaactgaaaactttttattttactttacccatcttaagtcctcctgatagccctataaagtaataaattgtccaaaccccttcaggaaactattcttaattccatcatcatttatagttgcctatctgcccaataaaccagaatttagccttaaagccatcgctctcttaatctgtattatgatcttgtctttatatatgagttttgtttttcaaattagtggatggccttaggtaccattttgttattctgcttgtttgtgtcttctgaagacagtcacagcatcatagaatactacagattggaggggtctatgggatcatcagaaccagtgcttttcaaaaaaattttaactgcaaactccccatttgaagtgaatttttgtttgtttgttttgtgacaaagtttcactcttgttgcccaggctggagtgcagtggcacaatctcagcccactgcaacctccacctcctgggttcaagcaattctcctgcctcagcctcccaagtagctgggattacaaccatgtaattacactcggctaaatttttttgtatttattagagattggctttcaccatgttgaccaggctggtcttgaactcctgagctcaggtgatccacccacgtcggcctcccaaggtgctgggattacaggcgtgagccacggtgcccagcctgaagtgaaatcttataagaccctcagtattggtccagggagggtagacttcctcatacctcccaggaggcccgagggctccattgcctctaatttcctctagatgagagaactgacacctctagagataaaattagctgcccaacattttggtgagggaggaagagtccatttttgttgcttagaagcttcgaaatcagcagaggtcagtgtatgtggagattgctggtaataagtctggaaacagagcagaaggttgcaggttggaacctggcttccctggaagccaacactcaggtggagctgggcatgcaggatgtttactggaaatccacacccgtagaaaccaggaggatgcaggattgtaccaaggaaaaagtcaaactgccacacaggccaacaaagccttggccagccccacagggaagcgctggagcataaatggcccatcctcgtgtcctgtgttggacttgatggctgggcctttataccctcactgctatcagtctttggatgtgaaccaccttgggaagggcaggcccttggccttctgcagcattctgtggctttcttcagtggaagcaaatcctgaagaagctgtcagctggaagccaattgcccacagctggggcaacaagtcctcccttgaagcaagatctagaaggcacatctccatgtcccctccacatggccccaggattgctggtgaacatgagagacagtggagaggagagtcccgggaggcagccttcccagccaggccaccccaaacttctggttagggattcccagcttcacagcactacgtaagctgcttgccaacagatgttttgacaacatctgttgtcaaaggttgacaacaacctttggtccttgcgatggctttctcctgtgtttcaagatggattcctattggcatctttcatttccacctctgtttcaccaagtttagtgaccattttcatacattggggcttaatgtggtgcagtggaaagtgtagcagattgaatgtggaagatcgggttccagatctcgttcaggaagttagtagctgtgtgaccaagagcaagtcgttcagcttttctgagccatgattcctcaggtgtacacaccaagtgatgaaacactttaaaaactaagaaaacagtgtttgaaatgcccctcaagtgctggtgtttccccaaggatgttctagacccttcaccattccattcattcattcattcattcatctattcgatgattagtgtgatccctaacttttttattgttgttgttgagacggagtctcgctctgtcgcccaggctggagtgcagtggcgcgatctcggctcactgcaagctccgcctcctgggttcacaccattctcctgcctcagcctcccaagtagctgtgactactggcgcccgccaccacgcccggctaattttttgtatttctagtagagatggggtttcaccgtgttagccaggatggtctcgatctccttacctcgtgatcctcccgcctcaacctccccaagtgctgtgtgatccttaacttttaatctacagttcctcttttttttttaagccaagtagatgggtgattttgttttctgctaattattttggtatctttcattccacctctgtttcaccaaatttagtgaccgttttcatacattggggctaaatgtggtggtcgttctccagaagagtgagtgtaagttcgctcttactttgagcagcttatctctgtttaggcgatttctttgtcaccattaatggaagtgtgacacctttctgagtcccaaatgtatcggtttatcaaaaaccacatctgcaatgctgcaccttgtactgagttcacctcagtctggtactttctttgccttttgtcttgtttgcctccttgttagattagctccttaaaactttttcttttcattttccactaagtcataactctctagactaaatcctattaaagaaacatttaaagtgtttctttactgtgaagtgtatcatgcatgaaaatagtgtgtgaaatggaggtagatgttcagtttaaagaccaatagtagagcaaacgtctatataccaactcctcaggttaagaaatcctcttgtgatatatttatgcacgtggagtagctactttttccagaatttggggacatgtaatgatgactgagagatcatatagtctacataaaacagctcatcatcctagaatgagaaagagagaaaccagccaataaagaagggcagtgtgtataggtacttacaatgagaaatacaaacaagatgggattggagccgttctctatgtctgggagagttagaaaagtttccaagaggatgagacttttgaaaagtttccaagaggatgagactttttaagggatggtttgcctgaggaagatgagcgttccaggtaaagggaacagcatagcacgtgtagtgattcttctccctcctcattcccctctcaccattctgaccattcaccttcagtttcgtttccactctcctatcctccataaatgttggtgttcccataggtgttgcattaggatctcttctcacgtcattcaattttcatccattcacttgctcaatgtcaatgaagcaatgggtctccagaaactcctgcctgcagaactatctgtggagcttggtaaaatgcagatggtcccaccagctcaatcagaatctttggggtagggtccaggtatctttagtgcagatgactgggactccacatggagaaacacaggtgaacagggagggttggagagaccactcaggaatcagtcacaggtgaccttgtgcttcctgctaccatggctgcccctcccagcctgcctcacctgtgcctttctcccttctcccttcctgccttcagctcctctgttgcttcttcttccttaaacatcttcaccggttcctgtgctattacagagccccgtctgtgggtctcatgtctctgctccatgccacgccctcccttgggcatcatctgggctttggctgggtctgtggagggtcctgggctgcagtgccatgaacagtggagtggggcatgcgaagttgacagtcacactgaaagctcctgcctcgcctctctaccttcttctcttttgggggtttctttcctgaggcagggaaaaagaaacaggaacccagaccaaactgaggaaaacacgatcagagatgagatggggtcagaggcaaagggctgtttgttgggtttgcactttcattactgagagcattggaatagttttaaggcgtgcaaactgtgagactagacaatttcacttagaaaatgaaacgtgcatgcagatgttattctcatggggatatatatctgcatctgtttgtctacaagtgttcccttgcagagtcacagacatatacaaaacctgggttccatcagctttgtctgcacatacgtggctaaatgtgtacagggatgtacaattaaagattttaaacacttgattttgacagtatattttgcagctgctgtgccaagaaccctaagctactgtgggttaattggagttgtagcaagtatttctttctcggctgtctcttttagcagagcttctctctctctctctctctctctctctctctctctctcttcccctctctccctgtttcacccctccctgcctgcctgcctctgcccctccctccctccctccctctctctctctgagatagcagacaccagagtgaaactggtgcagcttcctttgagaagcgtgcttgcatgtgcggattggcaggattgtgtgagctcctctcccatccatgcactgttcttggagggaaatgcaatgttggagcaggggctgagctgcactgggaaggtggctgggagctcagtgaggccaggatcatggtttagccaaaggctggaatcacaagaatgtttcaccagggtctgctctgagagttctcagacccccatggattttagaattttccagcctttcctccttcaccttcgcacaattttactttctcctgagatggccccagatctgcaagagacatttgagagaagctatttattagcagacgtgaagaaatggattctgcacttgattatttagccatgacttatcaatgatgatggattggaaagcagtgtaagtaacgcagttatatatgttgctggagttaggtggtctgttttcttgctattttttttttactttaactttttcagtttccttttgagaaaagtaaaaataaaatgcataaaccatttcaaagaagttaggagggtccaggttgtgcaagctttcttcttgttcaatggacttgcagaatacctagttctatcagaagagacacacaaactaccgacatagaagctacaaacatcctccggaggatgggaatgaaatgggtaataaatgaagaaggtttctgaactgacagtcattgctataatcaggcttattcagagttgctaaaatatttgacattggctcatattagaatcaaagaactaaaatgtattctctttacaggatcataaaaatgaagttagcctgtggctttcagagcaggttctttctggctgcgtaaatgtgagggtttttgtttgtttgtttgtttgtttggttttgttttttaactaatgtcaaatgttgactatgtttcctgtccatttcaacttttcttgaggtcggacatctccctattctagagtacaatgtctggtcactcttgggttgcaggccactgtctagtggaaagctagtcattgctagtttataccagtcagagacttttccatctttctgtgtgagggcttcgtttaagcacttcaattcctaagtattcagggaggaaaaacaagtcacttgaagaccaaaatcagtttatttcacaagagaaaggaacggctatttaaaagatgaaaaattgaaatttaaaaatatgatctgccttttcttcaaaatctgaagtgaggttaattttgtgtaggaagagtaacataagctttcttgattaaaaagcagtatttagaggaggcttttaagatcataaatcacttaggtaaggtcatcaaaagagatggctgatattttttatggtcatttgcaactttttaaaaaaagtccatacggtaatgttaatgcagctatttctggcttcttaaaacttgcatagatttggaagtgggatttctaacaataagagtcgtgagtttttctgagctatcattgcctttctctgtctatcacattcatacctcaggcagagctactgtccctcccacctgtccaccctgcctgtttcccagcccccatccttctctctgagtcttggaacatcatgaaagactcttctgcagatttccttttaacataccctgcccagccttggacagagggagtactgtgaagcaacatgcagggctgccaattttggaaatgaatgagcttagttgattcctgaatattaaatcagttctgtgagcagtagaatgagatcatatcttacaaacctgacccaaagtgttcctaacaactttattaattggggtttaacatcatcaagggctgtagcactgggcacccgaggggatcagcctaaacccaaatgaaatccccaaactccactcggattcctgctggccaaatgcacctagggccacgccttctaaaatatgtcctttgttatcaagggaaatctgagacagaaaacacatgttggcagcatcatgtgagcgcctctctgcacataaagtggttgtatcacaaggggaaagctttcgatcttgtgccgttttgttttggtttcttgtttatgtggactctgttagactcctgcatctggaagaggcttgaagcagagtggaaaacctagagcaaaaatcatgccggggaaaggaaaatcattaaaaaacaatgactaaaaacagaataattttcttacccaaattccagttctcatccttgttttgggttccctgttaaagcagataccagttatagccttcctgggttaggggagacagacagtctttcatcatgcccctggattttgagcaaaggagaaagcttgctccagaaatagaaaagaaaaggcaaaaagaaaccatctttcgagtttctgctcactaacagaggaagcaaccccaccctcctccacaccctcctccacccccacagcttgtgcctctcaactgcccctggtggacagctccaacctgcacccccccccaaccccgccgccccctctagaatctcacgtgttttcgtggaggaccgagagtgctttttagcagtgaatgagcaaagagaccagatatgctgatacctgcacatggtctttgagagaggcagctgattgacatcgggaaaactgctgagcaattaaaaaaaaatactagagtcaaggtgaaagaaaggagagaaagagacagcgagagagacaggtgggttgtctctaaagtttcaagcaaagttctgtgaagcacctagcaggtcaaaactgataagggcagatggtgaagaaaagtcttaaactgatcagtgccttacacatggaacgaagctttcatttcggcccgatgttctgccagaaagctttgcttgagatccaccgccagtgttcttgctttgctcaacgatcccactatgctggtatgttctctctctggacagccgtctttctaacaacgggtgctgttctgaaaagctgggagcccaagaaatgttgtaaaaaccaagcgtggccttcagctgttggaccctgaggaacagcacctgcattagggccttgctcacgtttcttactagacaggttgccagctctcatttttgccctttgtctgagctaattggccttagtgttacatcggcccacatttttctccctgtaaactccattcctccctcatttcatctacactgcagagaactctcaagctcctggtgagttttgctgcaaagcctgtggcacgctgaaagaatgcaccccttccgaacctcatcttcccacttcttccactggagacactgcgggggagaaacatgtaaatatcgttaataacaatgcatcgcgtccttgaaaattgctgctaagagagtagattgtaagtgttctcaccataaaaaagtatgtaagataatacatatgttaattagctcagtctagctattccacaatgtgtacatattttaaaacaatgtgttgtacatgataaatatatacaacttccacttgtcagttaaaaaataaaaaataagtccaggcgcagtggctcacacctgtaatcccagcactttgggagtccgaggcgggcggatcacttgaggtcaggagttcaagactggcctagccaacatggcaaaaccccgtctctactaaaaatacaaaaatgttagccaggcatggtggcgggcgtctgtagtcccagctactcaggaggctgaggcaggagaatcgcttgaacccagaaggaagaagttgcagtgagccaagatcctccactgcattccagcctgggcgacagagtaagtgagactccatctcaaaaataataataataataataaaataaaaaatagacatttatataatgaaggtttttaaaaaagaaaattaaaataaatttggagaatgacctgtgaaaaatgcctctgcaagttttcctgaccagaggaaggacttggcttctctcctagacattttttctcgtatcttcctctaggagtcagtggaagagtggcgattaggtaacatctgaatgtagtagaacccagagctgttacctccatttgagctactgctggtcattgcttgacttctattctctccatcagtaaaatgcacgcgaagcttacctcattaggtttttcgagaattaaatgagataatgcatggtgcttagcttagcgtctggccatagccttgatgtcaatactgtcctcatgttctcctgtcagcggtaggtctgtctctcagacactttccaacagaggacccagatccttaatgacaggggacctgggaagacagggaggcaatgtcacagaatggaaagcgtgctcgagtagaagtcaagacctgggtgtttgagtcccagctctgtgcataaccatttgagtgatcttaagaaaatgatcaccccctcttccatgctacagccctagatgggttactccttactccaccactctcctcaccttgactcgtgccggtccctcagcacgacgggtcctcctcctggctggctcctttcttctctccttctatgagactcccctgatcccctgagcccgagggtcagggcttctcctctgccatcctatggcacctacatctctccacgcttaccgtgcagccatcactgtctgcctttcccactcgactgtcatctctgtcttaaagctctgccttcggtgtcaagaccgggcagcactcaatgaatgtttcccgaacggatacgtaaatgacagaaggaatggatgaagagtccctgccctgcctcaggtcttgagtgaagatgaaatgaaataatgtgtgtggaaggcttggatgagtagagtgctgtgcagttgccttcagttttaagttagtatgaggacaaagcattttttataccaatattttagttggtttctcagatactgagattcacacattttagtgaaacaaaacaatattctcttttataccatccttgcagtgtgggcccattatttgttgtagaagcaggccaggctttatgtgggctagaacctctgatggttgaaactgtgagcaacaaaacttttcattgcagaatgacaggtaagattctgaaagccagtggcatgggagggctcgctctgtaactcggcttgtcccagggtatgaatgagggagttcagatccctgcctgtgagggtggagaagggaaaatggtttctaaaagcagaggaggaaagagaaagaatcatcatggaggcagcatggtcagggaaggggcagagggtgttgcatctgacaaagctgggtttggacgatagcctcatacttgggtttctgttgtatctcatgagtcctctccctggaggagtatttggattctattctgcttctcccctgagtttgttttcacggtgggactatccaggactaaagagaatggcaccgtattgctctctctttctgaacccggacttgcaggccatatctggatttatcctttttatcagcagaatggtacatttcccatagcaatgcttgaactctggtccgtgatgaagcaagctcttccatggtgttagagtctgtttttccttcagaaaatgctatttgcagaacggcaacaacaaaacgtgtaacaggaattgtccgttcccatggccagtcctcatgtagagccacaagatggcgcagaggatgacatgaaatcatgtacgcgagcgtgatttgctactaggcagctctgtagggctgtatgtattgatatcacatgcgtctatatgaacgccccgctgcagctgcctttgctatacagtgaatacactgtgggtctattattcgcctcttcagatccagcccaggagttggtgcagactcatttttcactttcctttgaccctgggtgtctccacaaatgaaccacctgctgtgtcttggtgggggtggagatgtggggtgaagtaatgagcccgcaaggcctgtctgtgcctattggctgctctaaagggaagttgaggaatactgcaaagccacaaatctgagatgtcagctcataaatctgtaagctccttgcttaagtaatacgctccttgacggccaaaactgtcatttgcacattctcttcagctgaacacaaaagttccggttaccagactgtccctggatactggggactaaaagctggtgattggcggagtttgggggtggggagggggcgctgggctgattgccctggctgctccccacagctccacggctgctgctttcacccccacctgaccatggtcgcagtggggggctttctcttggtatttaattagtaagtgtaggcaaacatttgcattgtggcactgggataggaaaagagttgaacatgaatataaaaatggggatggggccgggtgtggtggctcacacctttaatcccagccgccaaggcgggcagatcacttgaggtcaggagttcgagaccagcctggtcaacatggcgaaaaccctacctctactaaaatacaaaaacattagccgggcgtggtgacacgtgccccagctagaggcagggaggctgaggcaggagaatcacttgaacccagaaggcggaggttgcagtgagccaagattacagcactgcactctagcctgggtgagagagtgagactctgtctcaaaaaaaaaaaaaaggaaatgggagaaatagtttccagcatttagcttttggcgacaatgactaaatcaatacaaatgttaatctctgttgcattatgcttttgaaactgtattggcagtttaggaaaaatccagtcaacagtttaatatgaaaatagagacctgtagaccaaatggagggcaggaagcagatatttgccacacaaacatttattgagcgcttgatgtattataggtgctgtgtaaagttttggagattcagaaatgaatcaaagagaggagtgaacatacaaattatcccaactataataccggtgataagccacaaggtagctctgctagcacggaacatatggaagagatgaataattctgcttcggagggaaggagtcatattagagttgggtctagaagaatgagcaggaggtggctgggaagggagggcgtttgggcagaggaattggcatgattctctgtgtatgcacaggaccatgaaagtgaatggtgtcatgtaatttttttttttttttttttttgagaatgagtctcactctatcgcgcaggccggagtgcagtggcacgatctcggctcactgcaacctccacctcctgggttcaagcaatcctctgcctcagtctcccaagtagctgggattacagacgcctgccacaacaatcggctaatttttgtatttttagtagagacgagggttcaccatcttggccaggctggtcttgaactcctgaccttgtgatccacctgcctcagcctcccaaaatgctgagattacaggcgtgagccaccgcacccagcaggtgtcatgtaattttattcatatttcctgatgactaagacaacgtatttttcagattctcaaaacaggcaatgattagtaatagatcaccttaaataggatgttataatggtgatgaagaccaatcacagctgcctggaaacagtagatcatgggtcaataatgggcccacacctgggttttgttactgagtcaacctacgctacttgttcatgttgtacctatttatcttgagctggtattagtatatccatttctaaaaatccttgcttgagaaggaaaaactattcaggagaaagaagaggagataaagtctaaacaacttgatttcacttgaaaagtcctaagtcgtcccttggaaactatctatagtaaaaagcatgggattttataccgtgttttaggcaactgaaaggcttttttacaattgtagtaaacactgactgccagcattctggtaccagttactttattaaggtaaattcccaaaactcacaatagtgggaaaaaatactgataagccttctaaaacaccaaagaagtgtagaacaacatcttggatgcttttagtcacgagtcagaacgccgcggtggttacagagcaatagcatttcagagctgggagagaccttagagatcatgtattttgtggattttcaaatctttgaagaatgatgttctgggtaaggaagctgctaagagtccatgagctagttagtgaggactgctacactcttacacactcactcccggatccctttgtgcatgatttctgtcattcaaccagtgttcataaagcccttgtaacatggaggataaatatttgaataagatactggctttaccccgcagaagcttagagctttgaaaggaggtaagacatataggtaaataatacacataggaagttattttaaaaatataatgagagttattagagttcagaagatggaaacttatttcctagtgaaatggatgactgtgtcctgtaatagaatatttactatatttagtaacagatttatacagtctcatttgttttagttaagaagtttgagtatccaacagagaaaaaaggttaggtaaaaattaagtacagtgaggccaggcacagtggctcacacctgtaatctcagcactttgggaggctgaggcaggcggatcacttgaggttagaagttcaagaccagcctggccaacatggtgaaaccccatctctactaaaaatacaaaaattagccaggtgtgatggtgggtgcctgtaattccagctattctggaggctgaggcaagagaattgctttaactcaggaggcagaggctgcagtgagtcgaggtggtaccactgcactccagcctgggtgacagagtagaaccccatctcaaaaaaaaaaaagaaaagaaaaaattaagtatagtcatgtgtcactgaatgatggggatgtgttctgagaaatgaatcattaggtgattttgttgttgtttgaacatcatggagtgtacttccacaaatctagatggtatagcctcctacacacctaggctagagggtaggactgttgctgtactgaatagtgtagccatttgtaacacaatggtaagtatttgtgtccctaaacatatctaaacacagaaaaggtacagtaaaaataagattatcttatgggaccaccagtatatatgtggttcgtccttgactgaaacgttatacggtgcatgactgtatttggtttagcccatgtttttattttgaagaaatgcagaacaagtttaaaattgaattgttgaattgttgtcattagttgatagcctaataagaacatattgttcaagtacaagaatatcattgatttaattaccctgaaaatataattttgaaaaatatctacattttttaaaaattaaattttcgtagtgtaaactaaaattaaatactcaactaactgagagagagagagagagagagagagagagagagcccttccccagctagtctggcagcaagtgatttctaaaggccagaaataggaaaaaaaaaataatcgaatcaaattgacttttggaattgtccttatgaagcacaagtctacaacctttaactcatagagaacacagtgagcatatctgctttgactggcaacttcaaaaaacccctctcccagaggcttgggaaaacacatgttggacacagactaatgataatgtggaacaattattacaatgaacacaataattgtatttgttttatgaacatgatagcctgaagaaacccataccaagaaatattttacgtgttgtcatcattaagaagtcagcaaaccttaaagacaaacacaatctattcatccatccatccatccatccatccatccacccattcatccatccatccacccattcatccatccatccatccatccatccatccatccacccacccacccatccatccatccatccatccatccatccatccatccatccatccatccattctgtaagtgtttattgagtatccactgcatagcatgcaccattcctggcagttaagaaaataaaaggcctcactctcatggaacttacatcagaaagggcaatattaatgatcagccctgaccacatgcctttccctattaatgatcagcccggaccacatgcctttcccttagggaacattgtaggatgaatgttccctgtggtctgaatgtttgtgtctccctctaaattcataagctgaaatcctaacccataagatgatgtcattgtaacattgtagggtgtattttagttggtgtggatatggaggcagaaaagcaaggatactggtgaacctggggaatgcttaagaggttggactgtgctgtacccgttaaaaagcaataaacaggctgggcgtggtggctcacgcctgtaatcccagcattttgggaggccgaggcgggcggatcacgaggtcaggagatcaagaccatcctggctaacacggtgaaaccccgtctttactaaaaatacaaaaaattagccaggtgtggtggcgagcacctgtagtcccagctactccgaaggctgaggcaggagaatggcgtgaacccgggaggcggagcttgcagtgagccgagatcgcaccactgcactccatccagcctgagtgacagagcgagactccgtcttaaaaaaaaaaaaaaagcaataaacagaatctcatgcttctatacaataaaaataaccatcttccctatagatgatgaagagtctgttaatataatctgacaggcttgttttggaaaatatttagatacttatacatccagatatattccaaaccatagccttgtaaaacctctgagctagcgcaatccttgagtataagtctacctccacctagaccaatgtttccaaaccattctgtggctgggaagactggaaggacccccaggctgaccctgttgggaagacatgcaacaaggcttacttcttcagtggtgtcagtgattttgagccagttctgaccatccactcatccgtctgtatttgtgtagtgctcactatagacaaggcaattttggggaatgcagttgtaggaaagatagacatggctcctgaccttatgaaatgttcagtcttgtgaggaagacacaaataattacagcccattgtaagaagcggtaaggtgcttttgtacccttttggtccatttttctttttttttgttttgagatggagtcttgctctgtcacccaggctggatggagtgcagtggtgcgatctcggctcactgcaagctctgcctcccgtgttcacgccattctcctgcctcagcctcccaagtagctgggactacaggcacccgccaccatgcccggctaattttttgtatttttagtagagacggggtttcaccgtgttagccaggatggtctcgatctcctgacctcatgatctgcccgccttggcctcccaaagtgctgggattacaggtgtgagccaccgcgcccggcctggtccatttttcatcttgaccatggaccacgctggtagatgcctgggggcatgagggacatagcaatcaggctctgtcagcctttgtgaccagcacaacttatttccagtgcattaaagaaaatgatactgcctatgcccaatttagatgtgggccagctgtgttagttagcttaacacagcattttgttttgcatatgtattgattttgcgcacatgctctctaagtgcctcagaacactgcctacagcatcctggtgaggttgacaatcagttgtcctgtccctgttcatctggcatggggacacactgtcagaggaggaactaccaagtaagtaattgcctccagcacacaaaaactgcagacacatggttgacataagaatctagtttcagctggtggttttcagggcaaagcaactgcactaacaggagatttccctgacagctgatttaaggctgtggaagaccccagtttatcagctcaaattgagaatgtccttttttgactagaaacgagaccctcccagccaactgcacaaccaaaacttatattcaggatgtccaggacctgaaactgacatgggagtcaatattctacagccagttgtggtgtcgacagggtctgggggaaatcttcagagctgacttgtgatgtagcagggcttacagcaaaggcatccctttcaccttgctctttaggattcatattctaagaagctgctaagaaaaaatgtctaaacggagacacttaggatatagttttcatattaatgttttattttaacaataatgggagcaaacacctaccaggtgtttactctgcgtcaggaactgttctgataatcttatttgaactttgcaacaattccatgaggctagctactcttaccatcctgttttacagctggggaaactgtggcacaggaaagttaaggaacttgaccatggccacagagctctgagtgtcagaaagaagatttgaaaccacacagttggcttcgcatcctgtacgcttgactatttctcttttctgcctctcttgggagaactctgaaatactaaagtactatattactaaataaatgcttgctaaagcatttatttggtcccatattctcaatttacacaattcttttctccaatcacatttcattttagactttatgagccctgttgaagtcatcagcttaaaagtgcccttgagcaattctctactctagattgagttaaacagagtatctgtagataatctagaatcacagacaatacctgtcttagttcctttgggtcgttataacaaaaataccatagtctaaatttataaacaacggaagtttattttgtacagttctagaggccgagaagttaaagatcaagagaccatcaggttcagtgtctggtaagggcccactctggttcacagatggtgccttctcgctgtgtcttcacatggcagaaggggcaaacaagctccctgggctccttttttaagggcactaatcccattcaccagggctccaccctcatgacctaatcaccttctaaatgccccatctccaaataccatcatcttgtgggttaggatttcaacttatgaatttaaagagggacataaacattcagaccacagcaacatctaattttgagccacctaactttgaaagaacaaggattgattaatccaatgtcagcatacagtataccattagatgtgagcccctcttggcaaacttgataaaagtgtgagaaaaaaattacctagaagactaataaatacagaatagtcacatataatttctgtttaaagatttataccttaccaatttccccaaaatgatttaacacaactcattaaatatttgtaaaataatttaaatcttaaaatatatattgggaaccagttaggaggagagagaaaaagacaccggttcctagaccagcttggttattgtacttggacatttcttaggctctgaattttatggacgctaaggcaaatggatcacaaaggagtaaaagataggggaagggaacaaaagcatttagtgtgctcccactgtgtgcagatcattctgttggccactttcccataccttacgccctttattctcacaacagacccttgaggtagttaccgttattttcatccacatcaaagtatgtggcagaggcaggatttgaaccaagcctatttgactccaaagcctgtatgtatttttttactaggtttaggttttattattcttacccaataaagtgacatatgatttgtctggagatacctagtcttcctttgaggattttttaaaaaatggatccctatgtagagaacattgggtaaaatcatagtaacctatgaaaagtaggtattcaatcaatgtttatggaataacatgagtaaataaatgcatggataataagatgaaggatatcttctttaattttataagctaagtaactgttttttgtaaatgcttctatgttaactattaacctctataaaaaacaaagccatatcttagcttcataattcagtctaaggcagttaggtaaatacttaacaatttaatattttatgtttttttctttcatagtttaatttctcaaaagaatagccgaggccccccttatctttacttcttccacccctatttacttctcaacccactgaaatgtgctccgtgtttcctctgattctgttcaaggtcaataatgaactcattaattctaatccaagggacactttgcattctctgtcttttttggtctctcaggggcatttaacattcttagccacttgttccgtcttcctctttacctctctggctgctcctttgtaatcttctcttttatattcactcatgaagtattgaggattttcatggatctgtcacgggttgtgttctgcttgccttctactctgcacctccctgggtcatctcatccactctcataactccagctgccagcttcatgcagaagactctcaaatctgaaaactgggatcaactattttttatatccaaatactctaaatgaagatctaagccaagactgtctatcttgaaagtaagttatttctgtctatggaggcaaaggctcacgtaggaagtgaagaatcttatatatttctaagccatttcttggcagtcagtcacgtattaggagtcagttctgtgtgtttttaaatacagcattgaacgactcagtgtttgttgttattagtgatttgttggacaggatagagagaaagcacagttatttaaagataaagtgtttgtagcccttctcaattgaatagcatacatacagataagatgtctgtgaaattttaatagaaatcaatgtgaaataagattcaatttataaaatctcaaattacaggcaacttgtcaaagcctagctgttgtgtaaacgtgggaattcacacaaggaaaagatgattgattggttgattgattatataacatgagttacattctatccaattgcacctgaatatattcacagacgcagctggatggctctgatttagagaacaagtattttcttcttttcacacaatctgttcctagaagcgccatcaaaacataaatattattttctcataataatataaggcatagtgattttattcttagccaaggatttagtgttgtagaattagttataattaacaatgtgttagtaaagttgagatagtattttaaacctatctgagtacttaaaataatgtaattttgctccagattctgccaaaaaaaatggaaattatttaacctaggattctaataactaacagtatccatagcattaaaaattacctttacatattgtaaatgtcacctgcctacaaataacatgtccattaaagtaaacattacttaaatatgcagctcaacagggcctggtttctttacaattaactagaaaatttgaactaaatcttcctgaagatttcttctctattaaaaacaaaagctgcctcctttccttgcttcacagctttttggacctgcctgtgatgagtgtcctttattgcccagtgtaattttgccatggtttttagcaatctgcaaacactccagcccaggtaacctgacggtagcatagacaggaaaggaggggatgtgaatttctgcctctctgcctctagtggggctgctaaggtaccagccatctaaacatctgcccaggtcttggtgcagtccagcttttcagcagagtcaagggcagaaattctgcccgacttctgtgtctggtacctatttgtacaatgcagaggtcccatgcaaattgttttcctttgaaataaccttaatgatttcttcaggtttcaactacagtaaataatttgttaaataaaaatattagaatgaaaggggggaaaagaaattacttcctctagcaaatgagactcttaaattcaaatttaattaaccaagacgcccccaaaccacagagcatgtcacccagcgttgacaattaattagctttgctctgaaagagctacaggtacccagcaaagagttacggattaaaggctttactcgctctgcgaaggctgcccatttctagctatcacaccttgatagtggtttgttgcttcaggcaacaaattacatctgaagtgtgtgatttcatgtccgtttttaatttcacacaattgaaatatgggaaaagtgaaaataaagctctacttcttttcaaaataaagctctatttctttcaaaataaagacattaaaagtgaacaacactacttcttttcggtttctcatgctgttcaagataattttctatcaaacggtgaaggaagataaatactaaggaaaactctaaaggaatgagtggtcactcttggcttttaggcgggctctctgtttatggtagaccattcagcttcttccttttagcattaaattagcatatgtataaatgatttaactagaaacttggagctagcatctaaaaggcagcatggtgtaatgaaaagaacattagattccttcgattcttgaaatcagattatctgggatatgcttatcccttgaaggaatcttaattttagttggatagtccttaaactagaaaagatatacgtacatattttatagacaattgcttctcagccgaaaaatcaggcactgacattccatgaggaatggactttaattagccggtgattgtctttctctgtctatatttataggcaaccgaaatagctgggttgtaggtacatggtttcatcaattccatttaataagaccagccagttcactatcattcatgttcatgaaagataggaataacgtcagttaactaaaatcatttatatctggctttgggatggctttttttttttttttttttttttttttgagatggagtctggctatgtcgcccaggctggagcgcagtggcgtgatctcggctcactgcaagctccacctcccgggttcatgccattctcctgcctcagcctcccgagtagctgggactacaggcgcctgcaaccacgcccggctaattttttgtatttttagtagagacggggtttcaccgcattagccaggatggtctcgatctcctgacctcgtgatccacctgcctcggcctccgaaagtgatgggattacagacgtgagccaccgcgcccggcccgggatggctttttaatgcatgtttaaatggatctggtgtcttaggtgtttacagttcttttaatttatgtattaagcccagtttccataattgcatactaggtggaacttaggaaaaggcaagaagctattaagtttccctggtactaagcaggcctgggggtgggcagatcaggccaggaacataaagacctgcagtcagggagcatccgataagaacggattgatggtcaaaaggtcagctggcacagggaaaagtacgtgtgcacctaagtgcagatgaaaaagaaagatccacccacactggcgccgaggcttgcaagtggatgtctggcaagcaagcagaagccgagatgcagatcaggaagctaaaataaagaagctggggcatctgggaagaccgagacccagggctccgcacaggctaaacagcaggaagaagagcgagtagaattggggtataggcgtggccaggtcatcagttacccaggtgcacggcggctgtcaggaggtcaggcagcaggcaaaactctgttcacaggtaggatagtgtgagggatcctgcccgctgtgctttctcaagtagggactttttacctctcattgtccaacgtacttctgcttttctcctccctgatgaagatcttgtgactgtgtactggcaggttggagcccacccctccaggacagcagggagcaaaggaagggtagctttgtaggtgtgggtggagataaatattcatgcatgggcaatgaagcagctctaagctatggaatcacatgtcaacccatatgtcacgtggcatcaaaggcagtttatacattggtaaaatgttcctttgaacttttctattccacaggaattgggaataagttttgggttatttcatcttccagtgtccttaaaaatgtggagcatgctctctcttaaaaatatgaatggttgctgtggcttagagcaagtcgccaccttcccgaggtcatccaactctcagaaacagaacttctctgttttaatgagtgtttttctctagatcttgacctagaacttgttgtctaggcagtatctgggtctgacttactaggtttgctggacagacagaaatagaaaagtgcaatgagacaatcgatatgttcttaggtgcccacagagtgtggcaccaacttgtcaagttctggacaaaattagattcattagtgcagaagtcctcaaccttctcttgggtcctgaagcccagcttttgcagatggcgtcttagtcattagtaaggccgctccatcggagtccccgtcatacaaaatattaaaggaagctgtgaagatcggttgcagtgtctgctatcctgctgtcgtctggccagaggtgagccgagactgtggggcagcggggtactgagcagctgctgtataatgagccgagaggggttaacccctggcaaggcaagcagaagagtcattcttaacatgcttagaatcccaatattcattgcagcagcttcaccaaccctgaaaaaccacagcatcagatggtttcttagtaaatacacttatcagaaacagaggcagagggtgcttccctttgaacttctgagacaaaagcccccagcaaggcatggattctgccaccgacggagtatttatttggtctttctaaaatccagatctctgcagccaggaaataacaaactcttgctttgtacttctgtttagccttccatgccaatgactatttttttaattaaatattttctgctttatttttgtgtacaaaagtgtctattttcacacagggaacttggctcagcaaacattcgtagttacttggctttaaacaaaggagaaggttttacattgaatagcttttatttaaaaattggtttatactatcgaaaggaaacattgaggaaaccccccagggcatttggactgggcacagatttcttgaggaacaccccacaagcacaggtaaccaaagcaaaaacggacaaatgggatcacatcaggttaaaaagctgccgcacagcacaggaaacaatcaacaaggtgaagagacaacccacagaatgggagaaaatatttgcaaactatccatctgacaagggattaatacccagaatatataaggagctcaaacaactctatggaaaaaaaaatctaataatccaatttaaaaatgggcaaaagatctgaatagacatttctcgaaagaagacatacaagtggcagacaggtacatgaaaaggtgctcaacatcattcattgatcatcatagaaatgcaaatcaaaactacaatgagattatcatctcaccacagttaaaatggcttttatccaaaaatcaggcaataacaaatgctggtgaggatgtggagaaaagggaaccctcatacactgtggatgggaatgtaaattagtacaaccactgtagagaacagtttggagcttcctcaaaaaactaacaattgaactaccacgcaatctagcaatggtagtactgggtatttatccaaaggataggaggtcagtatatcaaagagatagccaagctcccatgtttattgcagcactattcacaatagtcaagagttggaagcaatctaagcatccatcaatagacaaatgaataaagaaaaggtggtacatatacagaatggagtactcttcagccataaagaagaatgagatcctgccatttgcaacaacatggatggaactggaggtcattatgttaagtgaaattagcgaggcccagaaaaacagacttcacatgtttttatgtgtgctgcccagatgacacaattcaggaaaatctttcagctcctaccagagagtaaagctcttcagctgtagtgggtttacctgctgtgtgtcttcaggcttctcccagttctttatctctgctgtggagccaatataaagttatcaataacatttggtggtgtagatgcttctcatctgtgcaatttaggagtagactctaatacagagcagctgctgggtgaaccaaagatggctttagtgatatttatagcttattgattgcatagttctttgtctgtgattatcattcaataaatactgatggactgagtttcccggaacactgagattcgttttaagcagcttccagcattctttctgtgtatgtggggggaggttcaggaggcagtagaaggtggccataataatgttgtcttgtggtggtagtagttgttataatttcccttttatatcctaattctggccacgacctaactcactgtactgagacattttccccctataatatggagatatgttgctaagcaaccagatcagtaattggtaagtgcttatgtataatatgatttgatttgagttacatacaaaaatatgtaaatggttttttatcttcattattagataaatgattatcatttggttttattttgcccaaataaaataactgctttcatttaccaaaattaacatgatgtagtagaaaggccttggatttagaggatggaaacacgaatgcaagtcccaggtctgagagtcagcagccctgtggccatggctaaagtcagggaacttgccaggcctcgttcttttttttcaacccgtaatgtgtggtacaaataccttctctgctggcctcccagggccaggttaaggatggatgtgatgatgtatagaaaatgttttaagaaaaaaaaaatccaaggtctaagcattgtctagaattccaggctacttaatcttggaactctgagtctgttagtataattccaaaggctggattgactaagaagtactgtcctccagcagggcacagagccatagggcaggtctgcgcctatagaagaaagtaaacacatggcatggaccctgaataagtgaacagtgcagtgatggtggcgaggcagaagcaaaaggccacatggtcaagcaccctgtcattaagcattaaaacataagatagatcatctcaagaccaactgctggccaggtgcagtggctcacacctgttattcctgcactttgggaggctgagatgagaggatcactcgaggcgaggagttcaagaccatcctgggcaacaaagtgagtccctgtctctacacaaaaaacctttttcaattagccaggcatgatggggcacacctgtagtcctcgctactctctaggatcacttcagcccagaagtttgaggctgcagtgggctatgatcatgccacagcactccagcatggtgacagagccagaccctgtccttaagaaaaaaacaaagcaaacaacaaaaagacaactgctataagacttcaaggggaaggacaatgatccacgggggctgaagtcactgatgagggcaacttctacaagtccttgaagcataggaaaattcttttttcttttcttttcttttcttttcttttctttttttttttttttgagacagagtcttgctctgtcgcccaggctggagtgcagtggcgcgatctcggctcactgcaagctctgcctcccgggttcacgccattctcctgcctcagcctcccgagtagctgggactacaggcgcccgccaccatgcccagctaattttttgtatttttggtagagacggggtttcatcgtgttagccaggatggtctcgatctcccgacctcgtgatccgcctgcctcggcctcccaaagtgctgggattacaggcgtgaggggaaatttttaagggtaaattcacagcgatgatttccattggttaactctgtgcattaacatgcaaatgtcaatccatttccaaatgataacagtgcctggctgtagtattttaacatgatattgtttgaggctaatggccaccatgtttgcctcctagcagtaaacatgttatttgaagtcatgtcatgaattaccttcctgcactaatgaaatagataatttacataaaaatcaggaaaaaaaaaaccccagccccatatgcttttcaatctctagagccatggaaatgacctccctgacagccaattagaaaatacaaaggtgaaggtggatgctcttattcccgatacggagaagttccagaatgactagcgtgcttcttggctatgcccaaatacttttaagtaggtgttatttcataataaagcattaatggtgtttgttacatgtggatgaatatcttcactgtgtctgggagctctgcctcagaacgtaggatcttgttccctatccctgctgtttataatctgttttattaccttctcccactgtgtcatggaccggatggtttttctaggggctgctgtgatctgtcttgtcattgcttattatcagatagccttaatcctcagaacattgaaatagttctataatggcacgtgagccatggcagcccacagcagcactggccattttcacatgaaatggcagcctggattgtcctttacatgctgacaggggagactgtccatctgccacccctgtcctgggtcgggaccctttctgttcagcaggtgcagtggctctgagagtctcacagtttttcagttgatatctcacccatcaattacctgggttggatttgtagagctcgaatgacctcttaaattttataaacactttacccacctatttgagcatcccacacttgagcacccctcagacaagatgaaatattcttaggatagggttaggaacacacagtattcctgaaacttttaaagatatagaggtccttaaaaattaccatattgcctgattttcctgtctgtgccccaaggaaagttctattcttcatgaagctaataatttttaaaagattgctaggtcaatattttagtaatctttagacactaaggataggagatttcaatttaattctcatgagatgcacttagaatgacgggttttccatttgaacaccctgcagttctcacaatccagggtaatagtctgacaaatagtctattatacaattacaaaaaaaaaaaagtcaaaatcaagttccccctctaatctacataattgagacctaagactttccctgcacttaaagccattgaatccaccagatgagtgtggacctcatttttttaggtttgggtagatctggccaatgagagcaagtaaccatcctatgtgaagttcatttcagttctaaactgatccttgaattcagatattgtcatattgatgcattaggagaattgtcttgggtgtgagatgagtgaggctatggagagaaaggactggcactcagagggaagactgagcttactgggacattctagccaaggacaggctactgctcttctcctcactgcctgataatgctcagtgtggcaccactttttttttttttatttctgagacagagtctcgtgctgtcccccaggctggtgtgcagtggcgtgatcttggctcactgcaacctctgcctcccaggttcaagcaattctcctgcctcaacctcctaaatagctaggattacaggtgtgcgccaccatgcccagctaatttttgtattttcaatagagatggggtttcaccatgttagccaggctggtcttgaactcctgacctcgtgatctgcctgcctcggcctcccagagtgctgggattacaggtgtgagccatcgcacctggcccactttttgtttttttataggtgttcaggaaatattaatttcatcctgctagagagactttttccttgaaataaggcacagataattatatgaagctaatggatgtttaaagatgtatgctgggataaatagctttaggaaatatattgtactatccttggtaagaataagacaagtagtttttaagttatggtagtttttaagttaatttttctgctactggaaatcttataaaacaacccattcattttttcctatgaaagaaagaacttatcaggcattaattacataaaatatacttctaatcaaaatgtctttaccttttcttttttttttttttgagatggagtgttgctctgtcacccaggctggagtgcagcagcacgatctcggctcactgcaacctctacctcccaggttcaagcgattctcccacctcagccacccgagtagctggcattacaggcatgtgccaccatgctcgactagtttttggattttagctgagatgggggtctcaccatgttggtcaggctggtctcgatctcctgaccttaagtgatccacccacctcggcctcccaaagtgctgggattacaggcgtgagccactgcacctggccgtctttaccttttcaattctctcatgactgcctctcctttatgtccctaaataatacaattatacgtgaatgatttctcaaccttaaccttctcttctctgtgtcattgaagtgctatatgaaaagaactgaagctgctgacctctaagacattggaatatataaaaaaagatcaaacagctgcttataatgatgtcaaagataaaatgctattatagaatctatggctgtaaaaatgtgatttatattaatttttagtattctgaaaatttcctgatatatttattttatacacacattttaagaaaataattttatatgcattctcaagatgacttcctctatcactgtttttctgcattgaagccaacggaggctttcctaaatggagtagagtccaggagtcattgcagaatctctatactggaaatcattctggttccccactgcacgcatccctctccctcgtattcctggtaagcagttttctacccaccatttggatattttcagtgacaaaacacactcactattttatgaagccaacacatcactagtgggttattccaattttgagagaaatgtcgcttatacttatcaagctaaagatgcttttatgtttcacctgctgctttggtacctgtattacataggtttaacccctattcagatacaatacggtacaatacaggacacataggcctagattcagccttggctctactacttattatttattatattctttcaaaggatcattgattagtgtactaaatgctttacatgtactgtcattaaattctcataaaaagtctaaaaaagtaggtattatttttgcttcatcttcctatgtggaaactgaggcttgataataatatttataatagtgatgatgatgatgatagcattgtcatgtgccaactgtgttccaggcactgtgcttgggcctttataaacattatcagaatttaggtaacttccctaagattatctacctagcatctaggaagctggatgttcaaactaagtcagaaaggcctcaggatttaactgccttgagcttcacttgtttgtctgttaaatgggggtaatattgttctcctcacgagggcttctgagattcaaaaaaatggcttatgaaagtatctggcatccttgcttgaaagatacttccacatgtcatttattcatttctttaaagagagctttcttgaaagactctttccttcctctttctccaggtttcttttctccaggctaaatatccccagctcctgtagtcttcgttcattcattcaaaacataccgtgagctctcttccctggtaaaatttacattctagaggggaaacagacagtaaagcaataaacatggtaaccaagtaaagcatctgctatgttacaagataataggtgtcatggttgtgaacaaccaagataatggaaattaggagtctgggagtgagtggtgttttattgactgtggctgtgtgacaaattacccccaaaacttagtggctaaaagcagcaatgatcatttatcatctctcgaggtttctgggggtctaaaattcagataagacttagtgggtgtgatttatctctgttccatgatgtctgggacctcaggcagaagacttgaaggatggcatctggaatcctctaaaggctcattccttcatatgtctggcagttgatactggctgtcttctggggtcctcagttcttttccacttgaccctctccatgtgacctgggcttcctcacagcatggaagctgcgttcccacggtgagtgtctcaagaaaggaagccagggagaggccattattgccttttgtatccaaagctcagaagctctacagcatcacttccattacattctgttggccagggcaatttcagagttttgcttgggttcaagaaggaacatagacgcccacctctcaaggggagagtatcagtgtcaggttgtaagaagtgcctgtgggagacacatggatgcagccatctttggaaaggactgtctgccatgatgggcaaggtaggttcacggataaggtaacatttgagcgaagatttaaaggagatgagggagtgagccatatgcccatctccatctcggcagagcattccaggctgactcaagagcctgtgcaaaggccctgagatggggattggaccaagaatatttggaggctaggatgactggagcagaatcatcaaagaagagagtagtaggaaaagtggtctgagggatatggggggaagggacagaccacgtaggctttataggccactgcaagtactttggcttttactctgagtgatatggagagccaaagggagggccttgagcagacttaaatcttaaaagagttactctggctcctttgtgaataggcaggtggagagcgagtacagaagatggcagacaagttaggagactgtggcagcaattcagcaagagaagtctgtggctctgaccaagatggtagtaaaggtggtgagaggtgatgggatcacagatctactttgaagttttagccaacaaaacttcctgatggattatgtgtgagaagaagacaggtcagcatcgaagaagtcattggaaggatggaattgccattttctgatacaggaaatgctgaatgtgtaacagctttgcaggaaaaacatcaggacttcagttttagggttggcaagcttgagatgtttattagatatccaagtggaattgttgaagaggtaattagatacataaataaggatttccagagagggatctaagctggaaataaaaattgattaatcataggcattaaggatgttatttaaatcatgatcctggaagaaaacaccaagggattgagtgaagcagtaaagaggacaaggactgagccctgaggcctccatcgttaagaagctgggcagaagagaaggaaccagcaaaggaaactggaaaggaatggccagggtgtcctagaaaccgagcagaaagggtatcaaggaggaaggacctactcactgctctgagaggtcaagatggggctgagaaccattaacttgagcaatcatggtggtcattgggaacccagacaagagcagtttcagatgagtcatgggacacatgcctgaatggaatgagcttatagataatggaaggagagggcctgcagaaggccagcacagacaacactttccctgagttttgcggccaagatgggcaaggaagtagaacagtagctggctggggaagaatcaggagaaggatttgtgttttatgttttaagatgagagaaataacaacatgtctatgtgctgttgggaatgatctagtagcgtgaaagtttgtaggagggagagggaggagggaaaccttggagggatatcctggggtgtgctttactttcagggatcctcgcttttctcctcagcaggggatgtgtggggtgggcctgggtggcagagataagaaaaaggaaaaagccatgaggctactgcccgttctaagctgcctttcagtatcactcccttcccctgtctgtctctccatgtggactgggaaccccagcaggtaggggagtgggaaccatagccattgcctggtcctttttacactgtgaaaaggaaccttgaatgtagatggataaacaccatcttttagttcctggcagatcactgtcttccttcttgttctagtcctctgagacataggcaggctggcttgagagcagggagggatcgctgagcagaggtgtgtgcgggtgttagaaggtgccatgatgccttgtgccaatgactgacctgggatgagtcactgttcatttagggagagaatttcaaaaggaatgactggtcattgaataattccatttcacccttgattttagaaggaaagtgccaggaagggtagcaatgagatgaaaaaaaaagtattcctaggtttttcttttcactgattgaaaagaaagtgtcccgtgccttccctttctcatcatcctacaatagggtgacttagggtatcttcccatcaaaatcagtaattcctcacatatctcttccccctgtatttcactcttgtgaaacagattttcagttttacagatgagaacaattaagctttgaaatggtaacaccatttgctatatttgtgcagtggcaattttttagctcagaatttatcaaaagcatgacacttaatgatacagaattaaaaccagctatcccagaccattgaaggagaccggggtcggggagggagaggcggtgcaaacggtgttgcttttgtctttctgacctgcttctctcgtgatgtgttctgcaactggtaagaacattggatgaattataagattttaatcagtagaataaagtcagggcggtcctttcattttaagcagcagctcaaacatttgatgaggaaattagaatccttagaataagagtttagtgtgtaaacatcaagaattcatccagaaatgagtatattagagtctgtgaaatgccttcgcctcacactgccccttcccctgttttcttcttcttttctgtgataagatgatcatggatttgttttgtttttcttttgagacggagtctcactctgtcacccagcctggagagcagtggcgctatctgggctcactgcaacctccgcctcctgggttcaagcgatcctcctgcctcagcctcccgaatagctgggattacaggcatgcaccaccacacccggctaatttttgtatttttagtagagatggggtttctccatgttggccaggctggtctcgaactcctgacctcaggtgagctgcctgcctcggcctcccaaagtgctgggattacaggtgtgagccaccgtgcctggccaagattatcatgttttaagtgttacaggacacttgaatgatggacgatgtcattggaacagcctatgttattaatgatgccggcagcctcccctcccacctttccctgccttcacactctgtgcccccttcagtgctttgaccccttactcctcgcacttgaccatgaattgcattttgtatttaaagacctccctgcacaatatcctcttatctacgtaagcagcccatagcctcagcgccctgcaccctggttggagttcaccttctgatttggtggtatatttctaaaaccagtttgatttttcctgttgcactggggcttgtgtttttcttccagtgccctgtacatagcatgccttgactggtctccacatcgttcttcatcagactggtttggattttacaaggtgttagagtttttaaattagctcatgaggtctctcgcacctgagtttatgccagagaagttgtggagtgatgaacttaatgggtgcccttatccccaaagatgcccagctttgttcctgcttaagctgaatgttggtggataacacatcattctttgtaaatcgtgattgcagaatcctgctattttatggctttgtttttccttttgtcgtataaatgattgggtagctcgttaacttcactctgttatagtaagggactgctacagaggacactgagcaggaggagagaaggaatgattaggcctcagaaagaacgaggggttgtttaagagaaaacgaagtaagcctagcagatctgatcgtacaatcattttccccttattgttcctttttccactccagagctgcccagaagttaaatctgtcttctaaaaagaagaaacatcggccttccacttcttccgctgccgaaccaccgctctttgcaaccagcttcagtgggattctgcagacctcccctcccccagccccaccctgcctgctgagggctgtcaacaaggtgaaggacaccccggggctgggcaaggtaggaccatccgccgtccctgccatttgcccagtgtgcgaggttctggatcaagtttcaggaggaagaaaatgaggcctccaatgtattaaaataagacgttgccagggagaaaaggaggcaagatgaaattcatttgaaagtcctgaaaattgtcatggttgcatacactaagtggtaaactaagaccttcagattgtaagagatctgatttgcttttggtgggaaaaatcagctttgcattgtttgacagaatcgtagccatttaaagaaaagacacaaaggcacaaaatatcgaggcaggggcaggagaccgagggaggccacagcacaaggtacagaaatgagacgtaatgaggcctcataatttccctgtgacactttcgagtttttgcctcctcttcagagaaatcctgacttctgctttgaagcagcccactgaggggattgtgaggaacgctgcagtcttgcctttctagccaacaagtgcgatttcgaattgttacaaatgctcaggaagagatgtaggatcgtgcttacaagctgttgctcagctacacttgggatcactttatttttaaatgtcatttctaaattctttctcccttccgaggaaagcgtttgggtgaagtaacttacggtttactcatcattggtgaataagccagggctcatacaaacatgtagtgaaagaaagacgtggcggtttaattttttatttttatcaaaagtaggagtggtgcacacgacctcactggtcctttacagacttatcgtgactccggccctgggcttcatttggccgccgttgctagtcttgctgaagctccggagcaactactaaactgtggggatttagattttacttgttcagttcgcagactgccagtcccctgggtacccaaacacggtcatggctgggtttctgggcctcagaaggcctctgtctctctggagtctccccttgcaccctctaccctctcttcttttcacctttcccagtttctcccgtgtccttccatgctctcccaccctcaatctcaccacctcgttgggaaggtattaacttcatgtggtacttttcccaagaagagtttaaattttaagattacatggaataggtcaggcactgtggctcacacctgtaatcccagagctttgggaggccacagcaagagaagcacttgaggctaggagttcaagaccagcctgggtaacatagcaagaccctgtctctacaaaaaatttaaaagtcagctgggcacagtggcagatgcctgtagtcccagctactcaggaggctaaggagggaggatcacttgagcccaggagttagaggctgcagtgagcaatgatcgtgccactgcactctagcctgggccacagagtgtctctattttttgaaaacttacattgaacagagcagtgcctcctctgaggggaagcatccagtcctggagctttccttggtggtgggcagggcagacagttttcagctgagggctttcccaggcccagcagcaaagtaagacccaaggaggcagggaagtggcctgggctgtctacagggcctgccccagcatcactggacatggaagcaggtggaaaaaacagtgtggaccaggactcctgtccaggagaggactcagtgggtgggagcccccgaggaggggccgtggtacgccacaggggcacacgggtgtgatcgtggatggttgattcgctgccttctaaggagggtgggtccaagtaactgctgggatcttctattcttttttacattttttatttttaattgtggtaagatacaggtaacataaaatgtaccatctgaactgcttttaagtgtacatgggctcttgttttgcaaagagggatttggaacttcagtgccggagctgaactgctctggacacagtgaaatcaagctgtcagtgcagtgaccttcccctcctgtactctaagccagttctcttctgaataagtgtgagcaaatgtttaagtggtatctccttgaaaaggtgccagatgatcagccagcctggggtgctcatgtaccccaataccgccctgtccagggcacctcaaaatgaagcacatcagaaaccgtcctcctgcacctacagtactggccttgtctgtggttcctacaagggttgatgtggatgcatcttcaggtggctccgacctctccccctctatccctaatgacctccctggaattctgagacaaggacatcagggtgccaaggccagggaccaaaacagcagaaagagtgtcccagccagcaggatgacccagcactgacacaaaaatagtttagagggcaaaggacactggtccaatcttgatttcatgatgtaccatatgtagtgaccacagataaggggccttacaatgaggagttatgcttgttagtaaactaaagtttgcatttcacacttttttaaaaaaattaaagatatctctctcactgatttgcaatccaaaatgtaatcaaagccctgagttcacccatgagactgtgtcgaggagcggggcatcggtctggggtcacagaacatcataagagaaggtgtggcttccatctgcccagtggccacgtggcagctgaggccaccctcctgatctgctcaggcttctggggcatgggtaacagtgagggggaggaagtgacagttggagagaatgtgtaccatgattggaacaagaagttggctgggcgcggtggctcacgcctgtaatccaagcactttgggaggccgaggcgggcggatcacgaggtcaggggttcgagaccagcctgaccaacatggtgaaaccccgtctctactaaaaatacaaaaattagccaagcttggcggcacgtacctgtaatcccagctactcaggaggctgaggcaggagaatcgcttgaacctgggaggcagaggttgcagtgagcagagatcgcgccactgtactccagccttgacgacagagcgagactccatctcaataaaaaagaaaaagaaaaagaaaaacgagaagttgccaagaccctgcctcttcctgcacagagcatctggttcttccatttcagcaggctcttactctgccctaccatatggtgccaaactgcctgacctcagcgaaggcccatcctcccagactcctgctctctccacctccacggatatctcaccatcattaggaacagcagttctttatacccatgtggaaaaatttccatcaatttatctgttgcataatttatattttaatatcaccaagaaatacagtggagtttaatatagaacataaataattggcgctatatataaatcggcaggtttgaggtagacaagtttgatggaattcccaaaagcaagttgattgattatttaaacctgacctggagtctcctagagtggaggaggggagcaggaatctccaacgcttgagatggccctgaaggtgagagtgttgtcacccagccggaccactgcccctcagcctcagccacccaccacctccctctggaaacctgggaggccttcctccataggaacagatttcatgggtttatgtagagcaacttcttatttagtagacaagaaaactgaggcccagtgaaggtaacaggttttccagtgactccagaagcagggcaagaagtcaggacctttcggccattttatttcctactgtatcactggctgtcactagataaacatgacccttgacaatttggggtggagacaagagtgtcatggaactgcagtggtagcaaaataacgttgggaaccaattgcctttgtccagtggggaaagacatacttttcagagtcaggattgggagaggaaggggaataacagccaagaatagatacacagaatgagggagaagggaggcgtgctatcccatcccttccctccttcccactccctgctgtttccagcaacaatcccactccccagccaccaccagggagtcatttctggccactgagcacctcttgaggcaaaagcttttctggaggccatggtgatggaagaaatggaggtaatttccatgtacttggagttgaggcatgcacacgcacatgcgcgcacacacacaaaccatctcaggatcctctgcccctagagcatttcctgatacacagcaatttttttttttttttttgagacagagtctcactctgtcccccaggctggagtacagtggtacaatcttggctcactgcaacctccacctccggggttcaagtgattctcttgcctcagcctcccaagtagctgggattacaggcatgcgccaccacacccagttaatttttgtatttttagtagagacggggtttctccatcttggcgaggctggtctcaaactcctgacctccagtgatctgcccacctcggcctcccaaagtgctaggattacaggcatgagccaccatgcccagcccacagcaaatatttattaagcacctactaggtgttaggtactgtgctgagcggtaggcttaggtttgaaataatggacaaggcagagcacctgtccttaaggtacttataacttagtgctttattccagtcagtcttagaaagctcaccaatttgggccaatatgaaggacaatctgatttaaggaaaaatcaggattgtaggcttaaaatgattctgtctcactttgaagttacataaacaaattatgctactaagtagtcttatagagatattcttaataagcagataaagatgattagtggatcaaagcagcttagtccccattcatatttcactgatttggcttatatgtaaatgatgattctaatctgtttgaaaacggttgcttctcctaagtcagttcttcatgaaatttgtttgcacaattaattaacatccatgtttaaggttcatttgttagtatgtcacagcttaatgtcagagctttctgtcttggattagaagcttccagagcaaagcatgttatctgtttgacttgctaagtatatggctctgcagccacaccatggtgcatcaacatttttaaaagtgagaatggtaatggtgacagtcatattggattgatgacaatcaaccttttacccttttagggtagaagtcattcagttactaactccttgtgacactgtatggaagagaaagacaagatttctgttcagtttacattcttcttagaggaagaggagaacaagatttttaaaattagattaaaatactgtggttttttgtttgtttggttttggttttgttttttttgttttttgttttttgagtcagagtttcactcttgttgcccaggctggagtgcaatggcacgatcttggctcactgcaacctccacctcctgggctcaagtgattctcctgcctcagcctccctaaaatactgtttttaaaaaaggtactcggtagctgttattcactcagtcaacaagtagaaacagtggggatagctctctgttgttcaggaggtgatgccggggaaaatctcatgcctttcagcccaccaaggtgcagtttatttacacacagattgtccaattcctcattattattgctgtccttcctcatcctgaagcatgaccaaagagaaaagctctgagccagaattaacatctttacttcaagtattcataaagaattcaaatgtgatggacaattctggatcccactggatcccagtagattctggatcccgctagatcccactacactcacaacttcattcttaaacactaaagttgggaaaagcaaattgtgagttctcttttattttggttcactgttggagggggcgggaacggcataaataatacctattcatcactatagctagcctgatagctttgtaaattaaattgttagctcttctgggaaattaactcatgtgacgttaaactccatagttaagcttacgtagagttgggggtggtggttgttttccctttcttcctttatttcttattttgagccttccttcaaccgatacctccagagaaaggcgacttggggaaaatgttctgactcttaatcttcgcggtttcttttttcccacggatgtagatttcgccagcctctggacagcacatgcgcagtatgctgctagcgccgccccaggcgcccggagctcaggaagcgcaggtggcgctgccagaagggccatgctatttctggggcaaacctgaaagacctcagacacaggggctttcttctatgccatgccactgttgaacttagcactccccgttcttgcaaagagtgggaactgttaggagaatattctccgttagaggttactgggcaggaaagtcatcccaaggacgtgtataaagaaagtgtgagccaggcatggtggctcacgtctgtaatcccagcactttgggagattgaggcgggtggatcacttgaggtcagaagttcgagaccagcctggccaagatggtgaaaaccctgcctctactaaaaatacaaaaattagccaggcatggtggcaggcacctgtaatcccagctactcaggaggctgaggcaggaggatcacttgaacccgggaggcggagttgcagtaagccaagatcgccaccactgcactccaggctgggcgacagagcgagactccatctcaaaaaaaaaaaaaaaaaaaaagtgtgaagccattttcattcattattaatatgatcacctttaattctgctgatgagggtgtgtggatatcattttctgttgtcttcattatcaaatggagaactagaaggggtaagcagcacattttggtttaattagatcagatttatgataggatggcatatcgctacatataaaatactcattttctggcgttcctggccagagatgtctacacagagcaaaatggatgaaaggacccacagtgagcagggaggactggtttggtcctgtagcccagagtctcctatcttatataccaggtctgttcttgagctttcagagtgcaagtagagaaacagaatttagcatccactttctccgtggagatcctgcatttcctacttctctgaacttcccctgcctgcttcatatgagtagacaggctcttctgaacacatttttgtttaagtttcagggacctgacgccttccaggcactgatatgtgtacatatactccacaagacgtatctatgggcaagctagaattcagccccttatgtttctagtggaatgttcatttcagtttccgtcactaggttgttagcttcttgggaggaggaaacatgttcttttcatctttgtaccctttcagtgccagctcagtgctagaaaggatacacaatgtggttgaacttaaaaaaaaaaattctatacagtccgtgtgaagtcttgatggggcgctgagcactgtgtagggtccgtcctgaaagaggcagctgcaaaaatgaggcagaaacagtgaaaacatggacgtgaccagaacccagtggtccttggctccacctgctcttcccagggtgcgagttgtcccagggttttacatcaggaagaaggtgacgcttcatgccacacgctggcaaagaggaaacagtgtccacattcctcactgaggaattttctcgaagaccttcttgtcctgtcctctcattttgcatgtaaggaaactgagggccagcaagaggcactaacttgtcatcccactttgtgggagaagacaaaagtttaaacttctgaatgtaaaagatgatttgttgtggaaaactgttaatcagaatttgaataagagattcgtaatcttttcctcccattttgcaacttttttttttttttaaaaacagggtttcactcttgttgcccaggctagagtgcaatggcacaatctcagctcactgcaacctccgcctcccggtttcaagcaattctcctgcctcagcctcccgagtagctgagattacaggcacccgccaccatgcctggctaactttttgtatttttagtagaggtggggtttcaccatgttggccaggctggtcaactcctgacgtcaggtgatccacccgccttggcttcccaaagtgcttggattacaggtgtgagtcacagcgccctgccccattttgcaacttttgatctcaattctgctggctctattttaaggtattaaatggagatggtaggcttgtgtatgtgtgtgcacgtgtgtgtgtgtaagtgtgtaggaggaggagaagaaagataatttttataaggggactttttaaaagctagcaacctttatcataattggtggacagccttggggcctcctggaatacctgtaattcctaattagcatcctgatttatggaataaaaacatgagataaaatgagggaattctctctggaataaatgccactgtctcaattaaccaaagggcaataagatggattataatgccagaatagggcttttgatcagtctttgtccaaaaaccacattttagttaagctcagcacaattagaccattactgatatcaggagaatggaaacagtaggtatattttaagctaacattcccagcatcttatctttctatagtctttctcttgttaatggatgaaaggaaagttaagcatgatttgttataattatcccattaaaatgggatcgatagaaatattttatgttaaaaaaatggtgagtccaaactgctgagttaattagaaagttttcctttgtgcctcaaacagaataggaaatgctgttcttgcctactgaattgttcgtatcaaatagaaaatatttgaatccctttctaatgcctcattgaaccaaaatgtattattatggagggggagaataattccgatacattctttttttttttgagacagaatcttgctctgtcgcccaggctggaatgcaatggcacgatcttggctcactgcaaactctgcttcccagattcaagcgattctcctgcctcagcctcccaagtagctgggattacaggcatatgccaccacgctcagctaattttgttttttagtagagagggggtttcaccatgttggccaggctggtcttgaactcctgacctcaggtgatccgcccgcctcggcttctcaaagtgctgggattacaggaaaaacaaccaaaaatagaacaattacagtagcaccgagtgctagagacaaatttcctgccaaatctcttttccagttccctcagtctgcgtctgtgttctgtgccacaaccaaagattcagatatcaattttgtccacttgtagctcatttgagatctgttaagcaacaacagtgaatgctgggtggattcgttagtggagctctgttccagctgtagctaataaagttattttctcgctgaaatcggtgatggtaaaattggtctgttttccaatgctagcttcttcagtttccgctgagttcttttctcctggagtgtgagatcacaatggcatgccttacaaaagagtgctcttgcctgctccgtcctggctgctcccaggccgaccctggctcctcaccagcaccctgctgtaaacgctcagctgccccttcccctagcagcagcgtcggcactacatttaggaccctttctgtatgtaccctgaaaacccaccggcgcagtggttaggctggagcagctcaggccagcctggggcaaaaggcagaggactgagaccatgcagtgagattggtgcagtcagtattggtggaggagctgctgggggccaggcacatgctggaaaagtggcgtgttatgtcccggggtctgaagcaagaatgggatcaggcagtgtggaaccaatttgtaaactcctcactcactgactgtcattagtaactaagttgctacaagctctttttttgtgagcctcaaaacaggaagcccagaagagtttacaacaatggaaactctcaggtttctacaggaaaaaggagaatgttgttttccccaaaggttatttccttctgcagcctggccatgtgcccctttccctcaagtttgggaagcaggacaaagggccctggggaatgccttagcccatgatgagctgagggacagtcatttttgtcccgtcatcatgcatttgatttgctccttgttttatgtaaatatataattttagacagcgtcttccttcgtcagccaggctggagtgcagtggccctgacacggttcactgcagcctcaacttcctgagctcaggggatcctcccacctcagcctctcaggtagctgggaccacattagccaccatgccctgctaattttttgtattttttgtagagacaggatttctccatgttggccaggctggtctcaaacacttgggctcaagcgatccacccgccttgacctcccaaagtgttgggattacaaacatgagccactgcgcatggcctgttttaaacattttaagaaaatattttatcatatttgcacaagaagattttcagtgaaggacaatgttttgaaaatccaatcagtaagatactcgctgggaggtatttttatagaaatccatggaaagctaatcataggaaatcggaaaaacagagagcagggtttgtagcttggcctttcccctaccttgttccgcattctataaaaagtgaaaaagtagcaaagtagcaccctacagggggctcagaggtgctggaggactaataacgcaccatttgcatgtccacgccacgcgaccctgcagtcacgctctgttacaagtacagatggtgaaagtgtggccaggaatggatgccggaagcccagaaggaagttggctcttgtctggaggctcccagggtggatctgcacagccttcccttggctgattcctgtccatcctgtggatatcagtgaaatgccaattccttggggaggctttccctgccaacctccccaaccccaggttatccaggctgggtgccccctcgtgtgcttccgtaaccccccaaagtttctcctcattgcattcatcactctttagatgactgatctgcgtaattccatgttcagtgggtctccttaacgaatgtaagctccatgagggcagggccatgtccttcttgttcccctttgaatccagagcactacacggtgcccaactgtcataggtgtcataggtgctcagtaaatactaggtgtattagccagagttctccagagaaacagaaccagcagggtgtgtgtgtgtgtgtgtgtgtgtgtgtgtgtgtgtgtgtgtgtgtgtggagtgggggtgggggattgactgattttcaggactggactcctgtgactgtggaggttggcgggcaggctggagacgcagggaagaggtgcagctggagtccaaaggcgggcagccgacaagcagaattccttcttgctcagggaaagtcagctttggttctattcaggccttcaactggttggatggagcccaccacattatggaaggtcgtctgatttactcaaactcagctgatttaaatgttaatctcatctaaaaaaatacctccacagaaatatgaccaaatatctgaataccggggcccagccaaattgacacattaccatcgcactaggggaatgaatggaatgatgacactggtttccattctgttgcgatgatccttcccatccgtataaggcctgacaatttccatgcccttgcacctatgtcatcttcctggattttttttttttttttgagacagtctcactctgtcgcccaggctggagtgcagtggggcgatcttggctccctgcaacctctgcctgctgggttcaagcgattctcctgcgtagctgggattacaggcacatgccaccactcccggctaatttttgtattttttatggagatggggttttaccacgttggccaggctagtctcaaactcctggcctcaagtgatccacctgccttggcctcccaaagtgttgggattccgggtgtgagccaccgcacacagcctccctggattcttaatacagccctgagaggtaggcagtggggcagtgcggggaggcaggggcttgttagatgctgcccatagatgagaacactgagattcagagagggcaaaataattcctagaggtgacaccgcttttcagagtggatggggtgacaccatatgtttgtttctactgttcttttccaaatcatacaacatatgagccattcatcttgtgccaagcactgttcagaaggctccatcctcatgacacccctgtgggaagcttccaccatcaccactcctcttttacactggaggaagctggaccggatctaaggaatctgcccagcatcacatgcctggtctgtggtggagctggcctatgaacgccaactctggaacctgtcctctggatggctgcatgagactgtctctctataggcaccttatgtggtcattttggtttcagaagaggtacagtaagcaaatgttcctggctggcgtgctgcagctgccttggcggggtggcaggcagggggctgtggcggaggctgaggctggtcgtcctcctctgccgctgacagtcccaagctctcttccctcatcatctcagatagctttgtggttgtcactgtgttgttttatatatgaatattttttatggatttttatatatggattgccgtgtgacttatgtttccctgccctaagcacaccgatgaaagtacattaatactcaaaatgactttgaaaagaccaaaagaaacaaaaaaagtcctaaattccgtgggaggaaaaaccatgatcctttagccctactccggaatagtaagaactgagagccaaagccaaggcggggacagcaccctgggagctgatgggctggttagtcccatcccagattatatggaggcacccgggtgattccatttcattgagaattctgtgtctagagcaccagacagtgaccacagaaatgtttaaacttcagcttttgtttaaagagatgtgctgtgagtatttatcgagccatggtctgtggggacactgctgggagagggagcatttctggaacccatcgtggctttcttccttgtctggcctcggcttttactttccttttttcatggacccctctatctcttgtgtccaaacccacctacttttccaggtctggctaagtgccttcttcctcccatgtcccacccctgtcccctactgagcccccttttctccgtgttttgtatcatgtaccatcccttgcccagatttctctgattaaccattcaccactctgttgctgtcaccgctttatgggtctaggttttctcctccactgagtctttaggctacttgagggtgggaatctttgttcctattgcgttcatatccctgaaaatgcttagccatatgtcagacagacagaactccctgaactgaaaaacacaaagatgtggagaatagcacagtccttatatgactttttccctgcttgtccctatcatttacccatcacctcttagtccatctggtcatccattgattcattcagaagacaggtattacgtatcttctatgtgctagttactttggggatacccagatgagttaaacatggtctctatccttaaggattccagaagttgctatcagaaagagttaaaaatcattcttcaggtagatagctcaaactaaaaatacctgttattatggccatcactccggcttaccatggcagataaggctgaaatttgtcccagataattggcttcctggtgagctttctccctccttctttttcactgagtatacgctaatattcctccagtattcatactgcatggtgaggacagctgacggtatagcagccagggaaggctgcacctgtgtttccattttagcgctttgatgtgctgcatgcggttgccctgcaattagttcatatgcgtgaatcacaatggcatatgtaaaacgtgtgctcatacagacccctctccaaagacctcacgcatcctttgcttctggagagaattcccctgaatgtatgtgatgaggaagttgggcttttcctctctgtgccaggctgaagcgaggggctttgctcaaggtcgtatagaaagtcgtctgcccttccaggccgtgctcttccattggaggcaacacctgggcgttctttgttttgcctttgccgcagagggagaaatgtcatatctttcaaaattccagtgtttcctagtcttctttgagaatgcccctgttaagataggtgagaagcaccaggggtaggcgagattcttggataatgtgtgtcctggaaggtggtgtattctggaatggggatgggaggaggggaaaaggataaagaagggaattcttttcgtttcaagcaatagaaattcaaactgtgatgcctcatggaaccagaccatgagaaggtcatgagcgcctggaactaagatctctcgagtgctccgggacgcttctcgcctcgtctcttacgtgtgcttcttctcacattttggcttaattcttcatttcaggccagctttctctcttacagctgccaccagcagactggacagactcctgtcctctctggccctaaactcaaaacttccaggagggagctcagatgagcgggcggttgggggtcaggaagcggctgctcagatgaagggggtgctggggttggggtgctcaggagcatctgcctgtgtggaagacgctatcctacaagaaggctggaaagacagacaaacgtcaccccctgcattttttgatggtttgtaggaagtgtcagtgagcatttaggagaaaaacccaagaccaggttacacagagcatgtcaggtctcaaatcccgacatgactcctgtcaaacccagtgccagggaggaggggagcccttcacccaatccgtatttaccgagcattgactgggtgcctgtgaaatgaggacttgggggggttcattttgtggaccactgatttcacaatcatttagcagtttccagggggagaaaagtggcctgcgtattcaacagagcttagagaagagactgtgtagggatttgcccagggagtgcagtagggagaggtgcatcaccaagaatatcggagacttctccttagcaggctcatcgtttccaaagagatggagatgcagtcccgagatagcgctccggcttgctggggacactggctccaggtggacagtcttacgtctgcctggcaatgctggctatgctggctatgctatgacctgcttcctctgtgaaacagctgctgaacaaaaatgcccaaattttagcacatcaatctcttcttcttcctcctcctcctcttcttcttcttcttcctccttcttcctccttcctccctcctcctcctcttcttcttcttcctcctccttcctccctcctcctcctccttcttcttcttcctccttcttcctccttcctccctcctcctcctcctccttcttcttcttcctccttcttcttcttccttctttcttctttcttcttctttaagaaagggtctgcttttgtcacccaggctggagtggagtggcgtgaacgaacacagctcactgcaggctcaacctccaaattcaagcgatcctctcaccttaggcccccaagtagctgggactaccagcatgcaccaccacgcctgggtaatttttgtatttttttggtagagatggggttttgccatgttgcccaggctggtctcaaactcctgagttcggatgatttgccggccttggcctcccaaagtgctgggattacaggcatgagccactgcatctggtgtttttgttgttgttgttgttttgagatggaggtctctgtatcatcaagaatggtctcaaactcctgggcttaagtgatcctcccacctcagcctctcaagtagctgagtttacaggtgcaagccaccatccccagccaagcacattaatctttatgaaaatgttttgtttctgcctttccccactcttgcaatggctcaccacagtcatcccattttcccagcagcgtggaactcacagtcagaagggcccattctccaaaattaaccccacctgagagttacattatgtaacacactgggagtgggggacaaggaacatctgtctccatctgtgccaggtgctaacttcctgtgtcgcccaggaacactcacctaacacctccgagtgcctccacaaaagtgccaggccatgtatgtgggacacttgctctgcagtgtaagcaaaaatgggtgcagttttaaaaatattgtagaattctagaactttccaaataagttggataatatcagcagttggtattcatataggttgaccttcacttggcagaacagtctgaacaggtgcgtagattttaagtagacttgaatttgaaggctaaggtcatccagatctctttgcggatgtggagctggaatgaagccctcctggctttgcctcctctgccgtcgtcgcagccggcaggtcccagctctcctctttcaattgctgtgtgaccctacggaagatattcagtttttctgggcctgaacttctttatctgcaaaacaggaaaacgaatcatacttcctcagagggtaattgtgaggctccaataactgtgctggagaaagtggggtatgaggcccggtttggggctgtgggagcacctcttccttctgttggtcctaggagctcagcgcttggtgggatgttccagaccaggagaggctgggactaaaattccagagtgatctatgggtgcagaagcttcagacgcctgttcaagagatgggtatcaggtgaggtgagtccatatttaggtctccagctaggatttaaacctataaggggaagaagcacaggtgagctacagtaattttggctaaaggtccaaactgaggccaatctcagggcatgtccctctaactagaggtaaggcatttagtcaacagccctccaagctcaaataggcagagggtagaactgagggggaatagcagctgttactaggaggctggtcactggcaaccttgggtttcaggagcgagaaatccatcctggatactgcgaacgcccttgattcttagaaaagtagggtcctggcatcaaagctggagcagtatggaacggatgactgcttagacacagggccagtgggtgatcaactacagcctcgtagatttctctttggaggactggagtgactcccaggctcagtaggggactctgtaggggactgagcttggagaagcccacggccaccctgcctccattccaaacaagattattcactccactcctgtttagctggtcacatggctcccccattccttgctctccattgcccttagtccaaagtccaaattccccagcccaaggctgcagggggctggctccctggcctctagttcctgcttctctcgcctgcccccttgactccagtgagtagtttttggtgctgcaaagaggacacactttctctcaccttcgggcctttgacctgcccgggcagggccctccccatcttcctcctttgctctgaattcatccttcttcttcaagctttaatttggatgttatcccttcaccccgcttccccaaggaagttccctcctgcccctgaggcctcttgccatgctgggctctaagtgggcatttatttctctgtgcagagtttgtccttctttgaaccaggtccctcctggacaaggaaggtgctagatacatgtttgtctagccacagggatcagagctcagaaggttgcggggacagggcatcctgcctgccctctctgaatgttcactttgagttacttcagttactctttacctggacaacataacgtcggggaaaactcatttatttgcaaaaggcaaaatacatgacactgtttcactcagaagcccctcagacccagcatctcgccaacctttgggcttaagaagtggtgaaaagatggggagagagtgactgaatgcatttttctgtctaggcaatttagtattacaggagatgctctcaaatccttgaccggagtgaaggcagagttcttgtcagttatgtaagaaaaacagctcattgttatatgatgcacactgaacaccatcgtgtgttttctcagtctttgtgtgtgcggacacgtggcatttaaattaaaatttggccaggcacagtagctcatgtctgtaatcccagcactttaggaggccaaggcagaaggatcgcttgagcccaaagttgagaccagcctgggcaacgtagggagaccccatctctacagaaatttaaaaagtagccagccatggtggcacacacctgtaatcctagctaaggctgagacaggagaatcacttgagcccgggaagtctaagctccggtgagcctgtgattgtaccactgcactccagcttcggccacagagtgagaccctgtctcaaaaatagaatattaattaattaaaatttaaggaattctgtttttactacggtgagtaacaaggttttttttttggtttttgggtttttgtcgagacggagtcttgctctgtcgcccacgttggtgtgcagtggtgcgatctcagctcactgcaacccccacctcccgggttcaagcgattctcctgcctcagccttccaagtagctgggagacaggcgcacgcccccacacctgcctaattttttgtatattttattagaggcagggtttcaccatgttggtcaggctggtcttgaattcctgagctcatgatccacccaccttggccttccaaagtgctgggactacaggcgtgagccaccgtgcccagcctatttttgtttttgtagagatggggggtcttactatgttgcccaggctggttttgaactcctggactcaagtgatcctcccacctcagcctcccaaaatgctgggattacaggcgtgagccaccacacccagcctaacaaggttttttgttttgctcctgtaggtctattttttttttttttccaatcagtattttcaatgttttggctccagacagatttcagtggtgcatcacatgttaccgacgtgcctcccgtgcctccctgtctgttcatctgctgtcgtctctgccagggatgctcgtctctcattcgtttttttggcgtggaaacacgctgctcagtcctcaggcccagctcccgtgtcacctgccacctgcaggccttcctcttgtcccttctccaggcactgtgcctgtgtcccctactccagaccgtgagttgtggatgaaaggggctgtatcttacttgcccctttttgcatttattcatgtggatacatagatgctcattcgcttcaattcattgaacatctgctactggccagggactttttcccttttggaaggagacccagataccctccagacataggtccggcctctcaggagttttcattctcctgagagaggagagagacttgttgagctatgcgtggagtgctgcctgacagcttgctattttctttctttcctgtgagataaaaatgtaccttatggtattactttattttaattctgccatgacatttgtggcggttgttttaagattcagagattactgggtgttgatctccttatgatactctcggttcctaattatgttagaaaaaaaagcaaagcgggaacttggcttttgtgttgccttcacagagtgtggaggttgaaaacatctcagcgcacttcacggaggttctcagagaccccataagtttctggaaaagtgggaaacgcaaacctgtcaacctgtcagtctctcccctctcacggaagcctgacatgtaaatctcaagttgttaaacctgctgtcaaatgagctgcctccactgaagactcccctccgctcctcgcactctcatcactgcccctcactctctgtccccacagcacagggacagcctccgcagactcccgtgtgtgtgctctggagagaaaagattctggatttgggcggtctcacctccaaaattgcagcccctaaggggagccgtgctaaggtgtgatacaggccatgccccttctagccccatgggacacctgactgatagcagcctgtgcagatgtgaggaacagaaggtggccccagaccccttaggagaaaccaaagtgcctcagagacaggacaagtgctaccccggaggccagtcaccaggtgacctgggagctgggaaccttttcagcctatgggtggctgtttatcacgaggggcattagacagacaggaggcagtgctgaaattcaacagcacaaagcaatttccagcttcatcttggcttattaataatgaaacagcaatagcgcaggcacaaatcaacagtaagtaggtgggtgggtgagacaagttggacatttggggaacagcctgggcagctaccgatacagagggaagccatttggtgtgtgtacctcccctcttccctgggataggagcaaacctgaaatgagaacggcagtcatctgcacacaaaaactaggttaggaaactgttttctaaggggccaggttgggtcactctttgtgacaagaaccgtgtgaaccacttcttacctgtaattctgactcagcattgatatttgaaaattcttccctagggctgggtactgagtactgttctgagtgcattacatacaacagctcatttacatacgtaatacattcacatacatcaatcatttgcatgtatcaactcatttatgtacatcaactcatttgcatacctcatttcatttgtacataactcatttgcatataccaactcattaaagttgtctcttttactagtgaggaaactgaggcctagagagtcatgtgcatgctgcatctctgcatgcttcctctgatggtttgatgtgggtcaatcctacgtctgtgcacatcttaacaactatcgtaggtgtagggtgcctttggtttactagaggtttcatcagtccacctgattctcactactgacgtaaatgtcagaggtggtcctgcctcttctcagtctccatcccaaggctctttacagctttctgtggcctgattttcttgctgtggatgctgaagggcactcttcagtggtttctcccagggccgttgcggattgcagctgtttcatacccagatgacctggggggcatcttcagtgtgtgcagatcagactcagcactgatactcgtcctccagccgtactttgtctccgcggtggtgctcagacttaaagcacttctcagctgtgctagtggtcccttcagagaacgaattatgctgaggcagagagggacctggggagggtagggaaggtcacaaattaaacagcagattagaggacagaaattcggtttgtggctttaatattttatactcagtatgacaggcagactcttcaaaaaaacataacctagtggcccaaatcgcaattttacgttatactttcaatataggaggaccctcacattgcttaaaaggggtcttcagggagaaatttacccaaaatttcatgcttggctccgtggtgacggcacatcctcactctgagaaccaggaccggcctcgggagtccaggttctgttcccagtttgtatgcacaccgatttccccactgtctgtcacaaccagtcaacttcccatgtgttaacagttactgaatctacctgtccgcacgtggccaagccccgccccccccttcccccatgctcttctctctgcctggccaactcctcaatcttggcaaagtccttcagaacccttgggtagtgtgagttaccttcctttgtatagaatctgaaaaatcattgccctttttttattagagtcaggatctcattgctctgtcacccaggctggagggcagtggtgcagtcatagcttactgcagcctcaaactccggcaggtctcaagtgatcctcctgcctcagcctcccgagtagctgggactataggcatgcgtcaccatgcctgactaattgtgttattctttgtaagagatgggctctcactgtgttgctgaggctggtctcgaactcctggctttaagggaatcctcctgcctcagcctcccaaagtgatagaattacaagtgtaagccaccacacttgtccatcattgccttttaatctttgcatcctgccacctccccagcacagccagcataggagccggcacttagtacatgtttgtttggggaatgaatgtgaggtcactagtcaatgattctgaaatgagtctattgaaggtggaaaccagcacaattcaaatgctttgcgttaaatgccagtcagtgtctcttcccaaagacccccactgaacccatcagatgtaaaatcccccattttatcaccgaacaacctgtttccacccatttcccttattcactaaacaacccgtttccacccatttctcttgttccttcttattgcagtgggggacgtgtctttgccttctttcaagggttaatgtttccaagtgggttctatcttctcaaggatcactggtctttcgcatataccctcttgctcccgaatcattaagaactcctgcccattggatgatgttgctgtatctccaattatattttgaaactttctccctctcacttactcctccacgtgtcccatttctctgccttcttaatggccacttctcaaacacatggctgacagattccggaggccttcaactcccacctatgaagcagccagtggcctcgggagtggggctgcttgagactgtgggaacgatgttttcgttaagaatggactgcctgtataatggtggtcccataagattataatactgtgtttttactacaccttttctatgtttaggtatgttgtttagatttagaatatgtaacgcaattaccgctgcgttaccagcaatcccaagaggaccccagaccctctgaaggaagcgggctcctgcaggacccgggagacagtgttgaacttgaccttgctctcctcctcgggtcaggcctgccgaccctgcactacaggttcctttttctctccctgtccgtgcatccatctgtttctgcactctcttcggtgcatcctctgaaccaccagaattaggttcctccacaccaaatgtgatcatttcatttcgcagctagattgctcgtgaacagctaagcaggtcacgctgagctcgacacagtccaatcccaagtaccagtcaggctcccaccgtcccttcctatcccaaaatgtcacctcccctgtgttgcagccacactgaagcctcaatgtcccctaaacattccagaccctcttgtgactctgagtctctgcccctgggttcacgccacttagaatgagcttccccccattttctgcgatacacactgtcactttccctgggaacagattcgacctgggcagaatgctcttcagtttgttcctatctctgccgggatctatatgttctggactctcttctacgacacggagacctttcccggagcaggaacggggccacggccgtgtttgcattttctgaacccaggatggtgccactgtggtttgttctccccgttcaagtgttgctgactggtggggagggacagcatcgcctcagtgaaagttttgggttaaacactgtctgcagtaattcaaaaggataagaaggactcctttcactgtgcatctttagacgaagcatcaacaaaggctttttcactgaaatccaaactcaaggtgtatacatgtcacctcccagcacagcaaatggcacagactcgagggaatgttttccttccggaacaacattataaagcagcagcccccagcctgtaggcaccagggactggtttcacggaagacagttttcccacggaccaagggtggtggtgggggatgatgatttcaggaagattccagtgcattccatttatcattagattctctcaaggagcgtgcaacctagacccccacatgcacagctcacaatagggtttgtgcttccatgagaatctaatgctgctgctgatctgacgggaggcagagttcaagtggtaacgcttaccttctgctgtgtggcctgcttcttaacaggacaccgactagcactggtccgtggcctgggggttagggagccctgctctgttacagagaacaaaatttgttacgtagggatcacttgagcccaggagttcaaggctgcaatgagctatgattgtgccactgcttttcagcctggctgagcgagaccctctctataaaaaatttttttaaagagtaaaatttgtatagtttttgggaatttactatggtgatattttatagcgctgtcaggaatgctctagctattggtgggccctcagagcacagtgaattcgagggctctgatgtattctgttgttttttttgggtttttttgttttttttattttgagacagagtctcactctgttgcccaggctggagtgcagtggcaccatctcagctcactgcaacctccacctcccgggttcaagcaattctcctgcctcagcctcctgagtagctgggactacaggcgtgcaccaccacgcccagctaatttttcctatttttagtagagacggggtctcactacgttggccaggctgctctcaaacttctggcctcaagcaagttgccctcccgggcctcccaaagtgctgggattacaggcatgagccactgcgccgagcctctgatgcgttcttgccggtcatttgtacagtgttgcttgcatgtgagttcttcttcaggtcgagattaagggtatgacattagtactaaccattattcaacctctgaaatatacgcacatgggacaaaggagataatttcatttacttatgtggccttactttgaagatattcatatgttagtccattttgcattactataaaaaatacctaaggctgggtaatttataaagaggtttaattggctcatggttctgcagctgtacaggaagcatggtgctagcatctccttggcttctagtgaggcctcaggaagcttccgatcatggcagaaggtgcaaagggagcaggcatgtcacatggcaagagtgggagcaatagagagaagggggaggccccagactctttaaaacaaccatttctcacatgaactaactgagcgagagctcactgatcaccaaaggatggtgctaagccattcataagggatctgcggccatgatccagtcacctcccagcaggccccacctccagcactggggattacatttcaacatgagatttggaggggcaaacctctgagccatatcaccatagttagtgcatgccagatgatttttgcgtttcccacaggatgtcagtgagcctttttctcagtcatggccagccccaacagagaggcaagatgagttcctcttggttgtgatgcctcttttcttttcagttcacactttatgccctttggcttgctgccaggtgctacctttcacccaaaagaaccacaggctcctcacggattttgcattccttcagggtcctgccagttactggcaaattcaatgataattgtgctcactgtataaaatactttctggaataaggtaaaatatgaatgaaaaaatgcacaaatgccaaacaaatacagttgcttgtgctgagattttgttttaaagaagaaagagaaaaacaaagaaattaaggacagcattgcgatcacttttcttcctccaaacaaaagctttcaagcgcaacatgttgatttttaaaattcctttctgggctgggcgtggtggctcacacttgtaatcccagcactttgggaggccaaggcaggcggatcagaagatcaggagttcgagaccagcctggccaacatggtgaaaccccatctctactaaaatacaaaaattatccaggcatggtggtgtgtgcctctaatcccagctactcaggaggctgagagagaagaatcacttgaatccgggagatggaggttgcagaaagccgagattgcaccactgcactccagcctgggtgacagagtgagactccaactaaaataaattaataaatacatgaataaataaaaaaataaaattcctttctgtagccactgtgagccaaaagcacgggcttaaactgcagagtgctgtgtgtgcactcacaaatcccaggttcccagagtggagagccctgcaccccagccgcggccaagggtcagaagtagcaactggtgattaatcaagtggctcctgtcttaggacagtcagcgtttattgtctctgcaggccagactatagaaataagcagacccacaaaagccagcaattaatatttccccggagagattccagatgctgccgggtggactgtgacatgctagcattcttcctgctcctgatttattccattgtgtggaagagcttccacagaaatgactctttggatttttcaggaaatgtttcaagccttcttattcagacaccctttcagcgtccagtgatggacgaagctgtgccctagagtcccaccttcccaaacagtgggcaacttgctttctccagcctcctgtccccttccgagcacccttcacccctcccatccccaggagtcgctgaataggtcccatgggagagaaatgacagcttgaagtgatgacccatcccaccccatcaaatgttggcattttactctggcctccaaaggcatggggggatgacccatggcaggaatacaggccttacagagaggttcactccaaccaaaccatgctgctcccccagtggcccaccatgaaaacctctggaaaaccaacttatttgccaaatgactcccatgagcaggcctttgcaaaatttcagagtgttgtacagctgcatcccaggacaaaactctttcttttcagtactaacagtgcaagtagaatagggtcgtggtggagcatcccattgtcttcattcctggtccactaattttcatctgagttaagagttttgggtttgaattcaagggaaatgaaaagttcttaaaggggccgggcacggtggctcacacctgtaatcccagcactttggaaggtggaggcaggcagatcacctgcggtctggagttcaggaccagcctggccagcatggcaaaaccccgtctctactaaaaattaaaaaaaatagccggggttaatcccagctactcaggaggctgaggcaggagaattgcttgaacttgggaggttcagtggaggttgcagtgaggttgcagtgagccgagatcatgtccctgcactccagcctgggcaacagagtgaaactccatctcaaaaaaaaaaaaaaaaaaaaaaaaaaaaaagaagctctcaaagggcctgagccaggcaccgtggctcatacatgtaatcccaacactttgggaagccaaggcagcaggatcacttgagctcaggagttcagcctgggcaacagagtgagactctatctccacaaaaaatgttttttaaaaattagccaggtgtggtggtgcatgcctgtagtcctggtgggtggccaagtcaggaggatcgcttgagcgtaggaggttgaggctgcagtgagctatgatcatatccctgcccttcagcctgggcaacagagtgagaccttgtctcaaaaaggaaaaagaaaatggcttgaaaggcatgtgagacattacatagtttgaggtatttcctttgctatatgcaaaggcataaaaatgaacagggagctagcggtttattgctggtccgaaccagcaacatcacagctggccctgggcgtcacagggtctcatgggggtaccttaagaggattcttaaatgaaactcagaacacagagaagtagttgattttgtgtcttgcatgttctgactcttcatttagtgtcacagcaagggtcaaggatatgggaaatcataaacaatcccaagagtttcatgatctttgagaatcttaaagcttcatctaagctatgcttttgaattgggcagaaccagaatggatacaagatgaatacagttcaaatgattctaaaactagagattaaatcctgtgaatttcctactctcagcaggaggagattacaactatttccaggtttaagatgatgaacatgattggttttgccccgtgctcactgggctcagatgagaaatagctttaaggtgcatccagggtttggttggttgtgaagaagaatattccttgtcgtcaatgaataaatgttgtgataggtcattagaggaggatctagagccctttgctggaaattgtttgaatttgaagccagagaagtaagcaagtaaccactttgttctccttctttctctttgtttactccattgtacattgactgtctcccaaagtatcccaccgagccttaagaaaaagttccccttaaagataacagaactggaggattcagctaggggctttttgattagtcaagaagcctttgattggatggacatgtaatcccagcactttgggaggctgagacgggaggattatttgagtttaggagttcaagacaagcctgggcaacatggcagaaacttgtctctacaaaaagtacaaaaaaattagccgggcatcgtggcaggcacctgtaatcccagctactcgggaggctgaggcagaattgcttgaacctgggaggcagaggttgcagtgagccaagatcctgtcactgcactccagcctgggcgacacagcgagactccatctcaaagaaacaaataaacaaacaaacaaaaaacaaaaattagctggatgtggtggtgcatgcctgtagttccagctactcgggaggctgaggtgggaagatcacttgagtccaggaggtggaggtttcagtgagccatgattgcaccactgcactacagcctgggtgacagagtgagaccctgtctcaaacaaaacaaacaaacaaacaccttgattgatgatccaatatagttcttttgttgttctttgggccttcttttttttttttttttaatgatcacttatctttcccttgagggaaacctacgttgtaaatagagaattttttttttttttttttttttttttgagacggagtcttgctctgtcgcccaggctggagtgcagtggcatgatctcagctcactgcaagctccgcctcctgggttcacgccattctcctgcctcagcctccggagtagctgggactacaggcgcccgccaccacacccggctaatttttttgtatttttagtagagacggggtttcatcgtgttagccaggatggtcttgatctcctgacctcgtgatccacccgtcttggcctcccaaagtgctgggattacaggcgtgagccaccatgcctggcctgagaaaaatatttttgatttccactttatagatgagagaattgaaattcaggttaatgatgccactcaggcttgaaacttcagcatcatttttgtgtttcttctgcacatcccacattcggtccatcaccaaattctgttaattttttcctcgtgatgttactggcatctgtctttttctcatcacatccactgataccaactggggctttctggatgattatactggatttttccattaccttccacatgctggtcttacctccttgatgcctcccgtaagtattttggatcttgggaatatgaattcatgtctgttcccttcgtttggcacccccatgggttgtgggcacagaggcagggaggctctgagaggcatgggccaggaaaggcttttcagagatttctgagcatacctgtgtcccttacaccttattctaattcacaccagctcttggtgtttgctcttcgactgtggacctctgtggatggtagacaatttgtgtgagtccacgagcccttcagtgttaaacatcattaaacataaggtcgcaaaagtcagctgatgctcaaactgaaattgttgtattttgttttgttttatgttattttgtttcccagaatgaggatatattggtcttattgtgctatgtgttagagccacatattctttcttctgattctgtgttcacattgccttccagatatcatcaaatctaacatgttaaaatctaacataatgagtgaaaatatatcagcgagaatgataatagtatctgctttctaatccatgtgttcatcatgggaaataacaaagctgcatcatatcctgtcttgtttctatcatgtcctcttctccagttagatcctaagtccctccatgacaaagacctggattcgttcacacatttagtgattcagcaaaacacctagtaagtaccccttgtgtggaaagccctgtacttgcctttggtcctatgggagttgcgttgcttgatgttagtgatgtacctaagggtggtgttaggactgaccggggctcccctcccaagccccacctatgtttttaatcacaataccatgcaacttccaaatcaacgctgttgatagaaagacacctacccagctctgaagagttatttggtccctagatcaaggggcagataagtcagatttccagaaagatagagcctgcctctttgtcattccatctccactattccttcactgatgagaaagtgatcagatcagaactgatgttgtataaactgctctgtaattcctgcctgattggcttttcttgagaggtgcctgtccattagcttttgccttccttttgtcaggctctctaaacactttaagtaacagaatcaattaagccttcctcacgattttagaaaactaagtggtagctcaggaggggagtcatcctaacaagctgtctgtgtagacagtggattctgtattgtcgcttttgtttctcaaaggtttgggtttggtcagaggttaccaaggaaccttcgctatatttccacagattcttttgtgagcctctagttcacgccctgtaaggacattcatccttctctgtccttgggagacgtaggaaaattatttcctggagaaatcaggcgcttgtaagagccagcctttcaaagaggtatctaccatcaaaggggctaatcgtccgagtgacagacacgcatggctggcttccctctttactctgccttgattgagacaagatgagcgtgctgctggccttagcaatgggggattctgttagaacaatatcctcagggaatagcttttatctgctaagtatgacaagtgtggcaactgtgcacagagtccagatctcacgacctcgctttgcaaaggctacaagaccaagggcttgtgtacctgccccaacagagacaggctgactcttactacgtggccgtaggaatggtttgcccttgctcaggacttatttacctaatgtcgtttggcctggaatgtttcagagcaccctttcatgcctggtcagggttgtgatcccttttggagacagaaggaggtagacgtgcttttgtgtttccgacactgaggacattgaggttctgggggattcatcacttagctcccaactcttattgggagcagaagtgccactggagtagggtggctggtttgagggtgtggccccgggaaaggtggcaggacacacttctcttgttctccagcccattttcaggcacggtatcctgcgctgctagcaccgtagccatcactgacctcaggaccctcccggtgaacactcagttaaaattcctactcgctgcagtgggaaattttatgttatgtgaattttatctcatgattaaaattaaaaatgaaattttaaaaatgaaatattcagttgcctttcctagaaggaatcatcccgatgatactattccttacttctcacattcatcccattctaatgcccacatttacttcataatgtattacctacgtatagtgtatgttgttcgcttcatttagcatgaccctatgaaatgcctgtgtgaccaaaagcagatcaactgataaggccttttgtggctcagatgtgtctttgcggggaaatggtcaggcgtcctctgttggcaagggcacctgtcccaagcagaaatggagaaacacgtcctcacctcctcctgccacctgctctgaacagattctgtagcgtaaaattctttataaatacacatatcaatggagttcttgacattttgcccagaacctgaggaagaataaaacctttcttgtccaactaaaacacacacggaataacaagcaaaagcaaaagagaaatcccaagaaaacagaccagaaacaaagggttatgctccgtcattgtccccaagagggttacacatgagactcacagggcaaattttatctaaattaaaatgctgatttttcacattacaggcccaaagtttaccgaggtcacagtgcttttaaaattaatgaggccgggagcagcggctcacgcctgtaatcccagcacttttggaggccaacgcgggtggatcacgaggtcaggagtttgagaccagcttgcccaacatgacgaaaccccgtctctactaaaaatacaaaaaattagccgggcgtggtggtgggtgcctatagtcccagctactcaggaggctgaggcagaagaatcgcttgaacccaggaggtggaggttgcagtgacccaagatcgagccactgcaatccagcctgggtgacagagctagactttgtctcacaaaaaaattaaaaaagaataataataatgagtgaagattagcttcctctgaagtcagttccttgtggatcatcttattgcttattttttaacttatttgatatctcactgacccctcccgaggcagaaatttgcttttgctcattgcaaactggccaaggaaaaaaaaagaacaatttcctctatagagtagttcccccttatcctcagatagccttccaagactcccagtgaatgcctgagacctcagaaagtaccgagccctgtatgtgctgtttttctgatctggtaaccagggcggctactgagtggttaacaggcaggcagtgtagacagcaggaggtgctgggcaaaaggaagactcacatcccaggcaggacgaaatgagatggggtgaaatttcatcacactactcagaatggtgtgcagtttacaacttatgaattatttatttctggaattttccacttaatattttcagactaaggttgactgtgggtaactcaaaccttggaaaacaaaaccgtgggtaagggaagactgctttaagatctgagaatgaggactgacatgttttggtttggctggtggtttcagatccaacctcagtagttcctagagaccatttaatttgtttttgagatggagtctcgctctgttgtccaggctggagtgagtggcgtgatctcggctcactgcaaactccacctcccgggttcaagcgattcttgagcctcagcctcccgagtagctgggattacaggcatgtgccaccatgccaggctaatttttgtatttttggtagagatggggtttcaccttgttggccagactggtctcgaactcctgacctcaggtggtctgcccgcctcgacctcccaaagtgctgggattacaggtgtgagccaccatgcctgaccgagaccatttaatttgaataagtgcccaagaagcaaaggactgagccaggcaagatgatctgagagcaggaaggtgtggccaggctggctgagccatgaacaggctggttgctccagggccggtgtctcccctggaaggttctggagttcaggctgtgttggagtccaccttctgcccctcaagtccatggcagggccgttgactgctgctcttgcctgagtctcctggttgcaaaggccaggcaaggcactgcctaacgttgtgactaacatcgtgggtgtgacggggagtcagggtggcttctctgttgccccaagtatgccctgcacatcaccatcttccttttcaaagaatggtgaaaataggaattgtgctctttagggaagattgtcttttttatatctttttcttttttttttctttttttttttttttttgagacagagtcttgctctgttgcccaggctggagcgccagtggcgcgatctcggctcactgcaagctccacctcccgggttcacgccattctcctgcctcagcctcccgagtagctgggactacaggcgcccgccaccacacccggctaatttttttgtatttttagtagagacggggtttcaccatgttagccaagatggtctccatctcctgaccttgtgatccacccgcctcggcctcccaaagtactgggattacaggctcaagccaccgcgcctggccttttatatctttttcaaagaaaaaggtaggctgggggcggtggctcacgcctgtaatcccagcactttgggaggcagaggcgagtggatcacctgatgtcaggagttcgagaccagcctggtcaacatggtgaaacctcatctctactaaaaatacaaaaattagccaggcatagtggtgcacacctgtagtctcagctactcgggaggctgaggcaggagaattgtttgaacccgggaggcagaggttgcagtaagctgagatcgtgccactatactccagcctgggcaacagtgtgggactccatctcaaaaaaaaaatgtagaaaaataaaaacaatcatctattcatggctaggtagaggtcagatttcactcactgacctgtttttagattttccttcgatattccaactcttagatatgtcaggttgctggagttgctgactgcactaacttctgcattctccaactttcccctcagagagtggcttgtctaaatcacccaaattaccatgtgggtgagaatgttggggaaatgaagatttaaaatccacaatattattagtgctgtcaatatcataatatcataaatgtccatacgaggaaaggagaccttggcagaggctaccttttctatctgttttgtgtgtgtgtgtgacattcttcatgaatgacttcttgaactatgaaaatgaggcaactgtggcctgaactctctcatttgcctcctccccttcctggcatttacttaagacatttcctgatgcttcccgggggtgtttcatgctggtgtctaagccagagatcacacctcccacccaccatgcctgcacctccactcctgcaaaggtttttagagtcagggtccctatcagtgtctaagcatcaggctcttcagaccctgacctttgaaaagtccaaatggctcttgagtgccccattttctcccaatctgaaaactgtaagaatgaaatataacaattaagcctcagaggatcacaagcgcaggtgatcctcatgagcccagactgatatttctaaattatctagatcttccttgaacatagactccagagttaccgggacgcagcgttcccattccactgggcagccatctatacgtgaagtgtcattgttggtggtttgggagttttattttccctttcataacacgtctcctgtctcctcagctcccccagaactccctgtaatcatatttgctatcagttgtgtttgtggaggtgtagtgaatttttcagggatgaataccaatgctgagaccctccaagaagacctgtgaggtcagcctctgtcagcgtgacagcccagtgggagggggccccaagctacacagcaggagatgattgtcacacgtcctggtgagagagcctgctcaccagctctggacctgcactccgtgtgcctggccagtagataggtttccctggtgttccccaggccttttctgcttcatgacattgattatatagctagcatttcatttcagtagggcttgggaaagggggttctttattgcagctcctgtaaaaacccatttccacacgaatcacctctggcctttttctgtctggcacattgtttagacaggaggggtttgtgtgtatcacttccctccagcctctcctaagtggaagcctgggatttggaaattgggatttttttccttctctctaaatgaatgccttgttggataccttgttgataaaatgccatttctcacatctttatagcttaaggggctaccttagccacaaggcacagtcccttattactgataagagctactgtcatttcacttatatactttgggagattcatttttgcttctcagcatcatttatgttatgattcatatctaaatttaaggtaaaattttatgcttcaccatcgacttttcaaagtttgtctttgaaaatgatttttaaaatgatctaatccaaacctctcagtttacaggtgagaaaacaaatctagggcagagtttttccacaggggcacgagtgatgtcatggaccagatgtttgtgtcgtagggggatgcctggtgcactgtagggcatttcctgggatctcaagcttctatcctctggatgccagtagcaccctccaagttgtgaccaacaaaaatgtcccctgtcacacagctaagtcataacagagtcaggcataagacacgggtgtcccgactcccccatctgccctttccaggttgggcaacagaattaagctctcaacccacacagagctcagagaattagtcaagagcacttccacaatctccagggagagaagagggtttaggagacaaaagagccaacagcatggaagagctttgtggaactctgggcgatgcatcccctacatggaagagctttgttgaactccaggcgatgcttcccctatacggaagagctttgtggaactcggcagtgcatcccctacacggaagagctttgtggaactccaggcgatgcatctcctcaccggaagagctttgtggaactccgggcgatgcatctcctcaccggaagagctttgtggaactccgggcgatgcatctcctcaccggaagagctttgtggagctccgggcgatgcatcccctcaccggaagagctttgtggaactccgggcgatgcatctcctcaccggaagagctttgtggaactccgggcgatgcatcccctcaccggaagagctttgtggaactccgggcgatgcttcccctacaaggaagagctttctggaactcggcaatgcatcccctcaccggaagagccttgtggcactcctggcagtgcatcccctacacggaagagctttgtggaactctgggcaatgcatcccctaaccggaagagctttgtggaactgcggcaatgagtccactctccccagtctccctgtctacgaatagaacttggcccagtgagtcactgactcaacttctgtgatcttctactagacgatatggtttagaaattcataagatgtgtgtcaggagttaacaggtttaggggaaagaacagaagaggcggaggaatgtctccccatgaatgctgaccctccacatacccagaacctgggactagccccttggcaaagactccatgagcctcatacagtgaatgggactcgttctcagccaggtagacatcagcttgggtctgacccccatccttgtgtgcaagtcctgattcacagagtttctttggcacttttgcttaagctgtaacaaacagccagtctgcacagggctcccttctgtctttccctttaagtcggctcacatttctctcctggtcacagctgtagaggacacacacagcacgaaacatgaggagtgtggcaagtaatgaatgcccccagggtattgccactttctgacagatgaggacaaatgtaatttccagggatttcatagctgagagattagaagctttcctgctgggcctaattctggagccaggtatgaacctgtgtttcccttgtataaaggtaaaagaattctgttactggggctgtggatggagccgattttaacatttgttttttgagctccatctatagctcgtaaggtccaccaggctggtccaaggtgcctttcctctagacacaggatttcatttagtggctgtgcctacatgcaaagcagcaacttcattcaactctctgggtctttgtcttagtgatgccagaaataacaaaatagaaactgaactattacatgaaatgacttttgggttggaaaaacaggctctaagaacagagttaatgaactgagagaaaatagtttctggttatgctactagaaactgtggtttttatcctcataaatcattgctttagggaaaaaaagtcctttctaaacttttcctgtcctgtttccttttcattttttgaatgaatgaacagtagggtattctctgtctttgagttattttcttcctagccacctggtcataatccagagggaaaaacaaattagatggattctgtgagctatatttcattgctattggtgtgtggatcacaatgctttattttccaccagttaaacgaagaacattctggaaactttgcacaaagaaaaattagtgtttatccctacagttgaaattttctaggaaaaaaaaatagcaacaaattaagttttgaaaaaggagagccaggtgcagtagggtgcatctgtagtcccagctactcaggaggctgaggcgggaggaccactgcagcccaggagttcaaggctgcagtgagctatgattgtaccactgcactccagcctgagcgacagagctagactctgtctctaaaaaaagaaaatttaaaaaggaggcttggctgggtgcagtggctcaacgcctgtaatcccagcactttgggaggctgaggcgggtggatcacctgaggtcgggagttccagaccagcctaaccaacatggagaaaccccatctctactaaaaatacaaaaaacaaacaaacaaacaaacaaacaaacaaacaaaccaaattagcccggtgtggtggcacatgcctgtaatcccagctgcttgggaggctgaggcaggagaatcacttgaacctggaaggtggaggttgcggtgagccgagattgcgccattgcactccagcctgggcaacaagagtgaaacttcatctcaaagaaaaaaaaaaaaaaagagctttgattttcatgaataccagtctatttctgaaggtttcccccttggaggaacagtggtggcgggctggccctctcagtcaaggagacgtgagcattccatgagacacgggtttcctctagggtctgcccctgaggtacctgaggtttggatacctctgcccactcccctctgccatgtttttccagctgtaccgtgccgataatcactgtgtcagctgtcattaccataatgctctgagcataactgctgtaacagctgggaaagaactctgcctttgcaaaacaatgctgcgtcataacacgctaaaacccccaatgtgcccacccaatatttcctatccatttgccccttctgcactccacaggcatgatcttccctttgccagtgggacatcagaatgagactctcttctgtcctccctctccttccccaagaacagtccttgcttgcaaatgcaaacagagaaaaagatactacccgagtgagcaggtgtttccgttggggtctgacaggagaaagacaccacacttagatcgggactatttagaaaagtatggatggagtgtagaaaatgaaaagggctaattagatagaccagggctagtcatagcagagtgccaggatggcctaggtccgaagggtcaaaaggagggaaccatgttggggggacagaggaaaggaaggtgtggcggagcctccggactcgcctcctccctccagagggcaagggggttctgctgatgcagtccaggcaggcccactccctggacaccaggagagtggaaaagggtggagactgagtctggagggcacggaggaaaattggctcagcatggattagaacagtctttcgcttcctggagcttaaaagccctccttacttacccttagctcctgccacctctctttgtccttggatggatacagcgcatgcctcctgcctgccacctcatctgtggtttctcatcctgtttgctgtcctccttcctcgttctgcccatgctgtcataatggatggaaaagctaaaggtgatttccagtcatctcttttgctgctgacagcatgaagtttgttctgctattagaatgacgcagacccgagacaagggttttgtcctgagttcattccattaatttctctctgcatagagcatctttccagcagctcctgcatgattaaattctggctgtgtgggacacaatggcacaggaagagcgttggccactcatcagccaggtcactaaaaggcaagttccacacatgaggagaaatcaaatgctcaccctttggacatccatccttttggtcctttgagtaacatttaaacaattgtttcttcagatacatggtccacactcaagagacctacaacagttggtatcacctggataagtattcaccaggctctctatgcccagttttttcccaagttccaaccaagagctattgatggctttgctcttgatcagaatagcattgggttttgctgcaaatatattcttgagcattatagtgatgaagaaagaaagaaagatagatagatagataatagagaaatagaagataggtagatagatagagaaagaagcttgcgtgtgtttgtttcaaagaatggggtcagttttcttacagccacctattctctcgcctggacatatattcagtgaatgcttctgtttgtaagatggctaactgggatatgggtcttacaggtcttcagttcctataagagtctacaaccacagcctcattaacacatgctctctggtgaaaagacattaaatggggagggaggaggtgtggatgctacgctggcttcaccacatgtaattattgaactttgtatatcactttacctttctgggtctcagggaccttgtctagaaacccaacaaggcaggctgtggtagctcatgcctgtaatcccagcactttgggaggctgaggtgggaggatttcttgagcccagaaggccgaggccacagtgagctgagattgggccactgcactccagcttctgcaacagagagagaccctgtcaaagagagaaagaggaaggaaggaaggaaggaaggaaggaaggaaggaaataaataagcaataagcatgaagtggcagttattctccaagtgaacagtgtggagtaactgccattttactggtactcaagtacttggtgtaactgctacatccaggcaactgctgagacttgagcaaggacctttacagcctttggaagtcccatccgtcagacacaccagggagcccgatgctgaacttcatgtctgtgtttgctgaatgatgagcaggtcctcttcagcgagagctacacgagctgtgaatttaccacgtgcccgtcaagggggtcattgtgttcctcactctgtcaataaaccacacagtaaagatctggataataggagcagaacagtttcaaaggacttgttacaatgtatcaagtcaataacttataattttagaaaatccctgaatacaaatttgcacaattttgagttgttttacaacttaccaggccgttaatctaagttttaaaagtctcttaatatacttaatcatagcctgtgcttttttttttaagtgctgaaatatgtttcagcattactgaaccacagcagcacaaggaaaaaacgactttaactcgttccataaaacttgcaaagcaaccataaatatatacagtgtggggtctgttttgtgcacaatttatatgcaataggctgggcttgatcgagaggatttatgcttatcgtctgtctccccaggcagacaattgtggtagaaaagaaaatgcacaggacctagagtcagggctgggtttcaatcccatttctgccacctgctttttgtgagaccctagggaagccttttgctcctttgaacctgtctcctacttaacaataatatgcccaccttagagggcagctgtcaggattgccacagagcaaggcagaggtgagccatctgcagatgcgtgctgaatttaaaccaatgcatgagtgacacggagcatgagagtggccagcatccttcctctctccctgcaccccgcaaaacaactccatcccccactctctctcagaggtggcagcggccataattcagacacatgcaacccagccagcgtaaccaccccctactcaccccctgaaaatagaagaagaaaggatttagagtctgggcagattgcttttaaaacatttccaaccttcgatctaatttgtcattattatttgtagagctttctttctcttccttcgtatctcctttcatatccggagcattcccagggaagatcccgttgctgaatactcgtgtctccagttttctacccggacttaaagatctactggtcctgcagagctgagctccagtggtgtgaaaggcacgtgagcgatgctgggcttgtggagatgagtaacacacaggcttgctttcaaggcactcacagccttacacatttgaaaatgagtttttcactggagcctgaaacttccagatttgaaaccatctccggggccaagcctggctgagactctctctctctgcatgagctgcctgccaccatcagttccccacccagatacccaagcctgaccttgacctgctgggggaaattcattatattctcgtttactccattttatagacgaatgtttcttatcatgaatgagagttcgttaaatcagctggttctaggtggagttcactagagccctctccaatgctgccggaggacctgttgccgtctgggctgtattgtaggtgggtggtatcataataagatccgtggtacacgaatgggcttcagggcaggcctgggttacatcaccacctcactttcggtgtgtcaaagctggaaaaaacagctggaaggtggccagtgttcgcttacccaacgaagcatgactttgcatctcctctaccctgcccagtgagggctccctgttttgaaggactggcatattctggaatgcttccaccaaatccaaacatcattctggatgaactgtggagcagttcaccgttcacagttcacaaaaggaccctctgtagaagcagaggatctttccctggggaaattatcctaagtcttctgattttaataactgatatagttcaagtatttgtccccgcccaaatctcatgttcactgttaatccccagtgctggaggtggggcctggcgggaggtgactgcatcatggatccctcgtgactcggtgccatcctcatgatagtgagttctcccaagatccggtcatttaaaagtgtgtgtttcctgccccgtctcatgctcccattctcatcacgtgatgtgcctgctcccacttcaccttccaacttgagtcagagctccctgaggcttccctagaggctgagcagatgccagtgtcatgcatacacagcctgcagaaccatgagccaattaaacctcttttctttataaatacccagacttgggtatttctttatagcaatgcaagaacggcctaatacaataattgttttccacatgaaataaacattgaccgtcttatccaactatacatgcttcttgactctagaaattgttgaatggaagtgctaaagattatcctcaaacacactcatgtgcacacagtttcagtgccagaacagtgtcctctaggaggaaagatggtcccagagcaattactggtttcctttaattttggcttcctaatgagtatcattttggtacgattccaatgaattgtttatttgaggaaagagaaaaagaaaagaacctataggaagagttggtttggattctatcgcgggcagtttatgcttctacgatagtaataaaagcaatgagagaaaaaagctacagaaccaaataaatatagatccaggagttgtacaacttttaaaagaaaaattctttagcctattgatccttcctaaggtaaacatttattttatttcagtttagaactcaagaatttttttcaagtacaactgaggaatagagtcagaagccacttcgattttgacaccatagaaacattctttctttagttactagaatcttttaaattgataagattggcattttcccaggatataacattcacctccactgtgtttttaatttgcaatagattttgagggaaagattccacaaggatttggccaacatgcctcctgagcagtgggtctcaagtgtggtccccagaccagcatgatccccatcagctggaaactgttagaaatgcaaattgtcaggccctaccccagacccactgaatcagaaactctgggaggggaaaccaacaatctgtgtttcaacatgaagtctgagaacttaaactatgcaccgttcttggtaagaaaataagagttttcctttgtgtgcgtatgtgaaaccaattccctgcaacccacagttgtttaaacaaaaacgtgtctagggagttcaaattaggtggccaattgccttataaaagtttacaaagtaaagagtctgtgctgtttccgttaggagacagaaacccaatcactaacttggagtatgagtcagaggcaggacagagaaatgtctgtctagtcggtgagctaattaatacgtgatcctgaggatggaggagccagggctgccgttccttctccactagggaaaaaaaaaaaagatgtttctctgtcaggcagctccctagctacctccagtatgttctattccatggctagaggagtgcagcctacatcctgtggatttatgtatattactgtaaaacaagctttctcttctcgagagttccgaagcagatctgtctctgattctttccatgaattcaaatacattgtcatccttaggtttcctaggtaaaggagactgcattactcatcagcatttaataaatattcatttgttggttgactgattcattatccttcatgccaatcacatggctgctactagcatgcatacagccgactcttaactacagttgtgtcatctacacaatccctgcagaaaactcattgaacacgtagtcgacacatttaaaaatgctgtgctgtggaagtgcaagttgcacaaacattttcatctttagcttcacttagaatacatttttttagttttttaatgtttttagagacagggtctgcctctgtgacccaggctggaatgcagtgctgtgtgatcatagctcactataacctcaaacttctaggttcaagtgctcctcctgcctcagcctcccaagtagctggcactataggcacacaccaccatgaccagtgtgtgtgtgtgtgtgtgtgtgtgtgtgtgtgtgtgtgtttgttttaatagagacggggtcttgctatgttgctgatttcaaactcctggcctaaagcaattatcctaccctggcctcccaaagtgctgggattgcaggcatgagccacctggcccatctataactaacttcataacactccaaattggaagaaagttggtggtgttattagcattattttacagatggagaaattaacacctggagttttgtgattacagagcagtggtaatcacccagttattttccttctctgtccctccagtggccctctgttgtctgggttaagtacagactttttagtttgaggaaaggagtccctccacaatttgtcattcctctattcttccagccaaatttcttacttctcctccaccctcaactacagtcaaacatcaaacaggccgggcgcggtggctcacgcctgtaatcccagcactttgggaggccgaggcgggtggatcatgaggtcaggagatcgagaccatcctggctaacaaggtgaaaccccgtctctactaaaaaaaatacaaaaaattagccgggcgcggtggcgggcgcctgtagtcccagctactcgggaggctgaggcaggagaatggcgtgaacccgggaagcggagcttgcagtgagccgagattgcgccactgcagtccgcagtccggcctgggtgacagagcgagactccgtctcaaaaaaaaaaaaaaaaacatcaaacaatactcactgagcccttcccacgtgccgggctatttgccgagaacttctcatgcattatctcatttaatcctcatcacaacttctctcaggtggaggcatgattgccatcccatcatacgggtgaggaaactgaggctcatagaagtaccttgccccaagccccatggctacttgcaggttccaagacaccggtcagcctgcccccctgcaccttggccatgctgcccactcacctagagcgcacagctgacactgagtcctcttctgaacctcatccatgaacatatttatgaaatctttcctggccccaagtggaaatgccccctcatttgggtcctcactgaaccccagtacacaactcttttgtactactctattatgctggggtgtttttttattgtctcacctgataaaccgtaagccccttgaagacagcaactcgtttttaagctctttataaccccagagcctcgcacagtacctggaccagattaaggggtacttaacagatgcttagtgaaggaaggaatggatttctcacctggttgcttatcttctagactcatttggggagtggccaggagtccgggagagctgccggccattgttccgtcccgtctgtatcccttgggctagtttcttctagactgaggtttctaagtccaaacaagatgaactgtgcacagtgcctcaattagggaacagcagcttgagtgctttggaaatacaaaagtgtagtttgtaggttcaccttgaaggcaagatcagacagctctacgtaagccagagctctgaaacaaagcttcaggctgggaccactttgcagtctcagtgcctggtagtggggactgttctacagagccgtgatcaaacctccaactgcattctggtcttggaggaaagctgattccgtatgaagagaaaaggcctggtgagagtatttgcagggctgaagaaaagttaacatctatagtttggcaagcagcagctgcaaagcatccgtcccagcacatgataaatgcttctgacgtttccttcagacacagtgtgctaggaaggcttttaagttctcaaatgcaggagtctgccttattgatcaggtgcctttcattaaaggtttccaagcccctcggctacagaggaaacgctcccctcagcctcctccacagccccagcctttcatgcagaggggattatcattgttggaatacggcatatactttaatttggtgaggctttttgtttaatgcttatgatatgcacactggaacagactgggattaggtaattttcacattgagttggtacttccctccctaacccccatctgatcttccatatacacattttaagaagaaaataaagagaagacacgtcctcctaatgatcctccgtattagaacttaccattctgctttgaactcctgctgctttgagtctcccactgccagcaagcacttctctgccaggcggaggggcggtgaagggaattaaaggggcagtcagtggcttgcctctggcgggaggtggcggagcgtctcattagcgtttgctcctttcctccagctgggcttcactgggcccctcttcttatcaacccgtccttcacttcacccaggctgtcccctgcactcagaccccctccagtccttccaacaagatggcagcaggatgactgggactcattggagctaagcagagaattaaagttgcttttgttccaaacctaaaacttgaaaatgaaggaactcttacgtggaaatgccaccatctcccttttgttttatgcgtaaacccaactggttccccatcctctgggtctccttcctgcccctcgctggctcagggcattgtacatactgtgtgttcaacacatgctgagtggaattgaacagatgcagtcctgggaaagggggccttttggaagaactgatggggaaagaattggggtaactgtgggcagttactggacgttcttgctcttacttattggttgaatgagaatgaaagtatctaagatgtaccaagtcccagggatagtggcataatttctctgttcctccttctgactccctcttctcccctcttttagtgtggggaagttacgagaacgtagcgtttggtgcagtgatccattcagtatacgtcgggctcttaagaaagttaaatttacctaacatcctacattttagataagaccgttccagatttccacctcttgacccaaaagatcccttcggtggttttccttactagggcaattcccttagtttcttggattcttccttcctctccttcctggaactaagctgcagagtcccaggctggagaaatagcccactgcccaggggtattttagaaagggcttcccaccttccgcagtgggcctggagaaggacgccttcttttcaccaccaggctgtgatctcgcaggctggcaaggcctttatgatgaactgaatgcggtctgtatttacgtgcctgccatctgtccccaggcggcactgagaagggggctgatgctgtcacccctagctccttctgcaggtctcctccgtacgtgccactgccaggaacaaaattatcatctcatgggagctgcacacatttaatggaacttgggagccagcacagaccgttttcctcaaagacagttttataaagaaaatggactttggggaacaacgccagaaagacatccagtatacctaattattaggcgagtgtggtcattgcctctttgtcttagataactaggttgttgattacggtgctttgccaaactccacggtggatctggtagctggtatttctgggcagacaccagactgagttacttcttttcagagttctggacgttactgatctaggtgaaaggccagaagcagtgggatattgaaattctcagaagtggagagactgtggcaaggaggtacagaagacactaaatcgggtgccatgttagcaagctcaagttttcatattgatcatgcagtgagctgcagagaagaaaagcagctttgcctgggtcctgttgttctccaagccaaatagcatctctgtgctgacagacgagtctgcgtctgcagacgcagcatctcttgactgtttgctatttaacgacagtcgtaacacatgagtgagctttactcatgtgggccctttattaacaataagccgcctctgtggcggctgggccccgcggggtcggggggtgggggtgcccaacgtggcagggaggcctgcaaggggaggccgaggcgccggtggaagcacaaaccacccggcgagtcagagcaggggtcggggcccctggccgcaccgtgccgcgcatgcgcagggtcccggggtccctggggtcccgggtttgtgcccccggggcggctgggccccgcgggaggggacggccaacgcggaaatgggccctttattcacaataagtgccaaaatccaaactgaacacatctaaaaaaattctaattaaggagcgtccactgctgctttctcaaaaattccttctgtgctattaaatattttctctttccaatggatatttaccatttctactcacagtagtttttctaccaagtattcagaaaaacctccagttgtcacttacccagtgtttaccaaaaatcaggcagaagagcgtggtggaagttggaagaccttagtgtaacccgcgtctataaaaactgggcgtccaggccgggcacggtggctcacgcctgtattcccagcacgttgggagtccaaggcaggaggatcacttgagtccaggagttcaagaccagcccggacaacatagaaaaaccctgtctgtacaagaaatttaaaaattagctgggtgtggttgtatgtgtgcgtcatcctagctacttgggaggctgaagtgggaggatcacttgagcctgggaggcagcggttgcagtgagcagagctcacaccagtgcactccagcctgggtgacagtgagatcctgtctcaaaaaaaagaaaaaaaaaaaaaaaaattggatgacgttgggcaagtgtggtgtctgtctcagctctgtgagtgtaggatgattcagaatctaatgattaggtctcctgaactcctaggtcaaacgtggttaaagggagatccagggaagcagtgaggaatgggctcttacaacactgtcatggacatgggttcaatatgttggcaattattatttattgaggacgtactttgttttaagtgcttaggataattatttgcttaatagtcacgtaagtccttcaagataggcattattatcgccattttactaatgaggaaactatgttaaaataatatattcctggtcacacagcgaccaagagtcaggatctgtctgccttcagagttcatagtctttccagtagcctcagtaaaaagtaataatagctaatatttactgagcacttactatgtcactgacattgtggaaagggatgttatgggcatttgctcttttaatgatcacagtaactctgctaggccagtactgttattatggccgatttatagatgtggacagaggaggttaaacactcgtgcatggacacatactgatcaacgtacagccagcactcaaacccaggccgcctgtctccagagcctgtgcccccaagctctaggccatgtgccctgtaagtcgcagatgggacgctctgacagcgagtgtcactgaggtcggagtgggtcatcaggcatgcctcagaatcccattccccacttcattcacacctgagaacgcctgtctctggatgcatctttacaccagctcatccatttaaaatcagttccctaatacaacaagctgaggatgaggccccttctaactaggccaccgtcagagtcccaatcctttctgacagaccagcccccgacatgtgtctgtctccatccttgcagcctggccagccctgtcccacgcctgctaattggtggggggacctggccccccaagcctgccggccattagcagtgcctcacggggaagggctttcttccttggtttcaactccctccctccagcgcgcagtcccttgccgggcttgcctggtgacagactcgtgttgatgaagacctttagggaatttccttccccctccgctccccgaagcgcttcttagagcacatctcattaccgggctccattctcccgtcctgcacatgctccctcacacttagctttattgtgccaccacttgtcacctttcccggcccggtttttaataatgcaaatcttccctctctgatggcatcgctgctcattatttgctgtctggcaccacgggagctcacccagcggcacctcggagaagccagccgcccagggtgcaggcgcaggccccactgcccgccccagtctcctgagagatggctccgctctggctatgacccaagatgctcatggagggaagagcagtccagggccagggcccttccaccttcgccaggcaggtgcctttgagcaagtcaatctctgcagcctcaaaataggaaagatggtaataattattataataatatccccttaacaaagcagttatggggcaaccaaatggaagtaagatacgagaaaagtctgtataaactgtaagatttgtaaaacttgtaaagaagttgtggtggtgttgctgatggatgattgattgatttggtcaacacggagcagtcgctgccccaaagtaggcctggagggcaccccagccccctcatctgccctcccacccccaaactcagcatggaatcatatggctttggactttctccaggtggataaagccccctgatctttgaacatgtcatgcaggattattattgtgtgttttgtttgggcaaagaaatttaagccaatttacttttgttctgtaactcataactgaactgtgctcagagtctctggggtcctttcaggcatgggtctgtggttctgtaatggtaactatgggttgatggagcaatggctttgtaaaatatgtttaaaagctccctctgaattgagggatcacagcctccttagttgtcccctggatttcctggcattggagttatgtaagacctccatgatcattgccatctggaatatgactctttggtaccccaaaaaacttctggagtctttcagtcatatggaatcaaaaagatcttcctttggaagaagcaattttagatcactgatggaaattttaccagaaaagtattcaaatcttttccttttataaaacctgggtttgttttttgttttttaattatactttcagttctgggatacatgtatagaatgtgcaggtttgttacataggtatacacatgccatggtggtttgctgcacccatcaacccgtcatctacattaggtatttctcctaatgctatccctcccctagctccccagcccccaacaggccccggtgtatgatgttcccctccctgtgtccatgtattctcattgttcaactcccacttatgagtgagaacatgcagtgtttggttttctattcctgtattagtttgctgagaatgatggtttcctgcttcatccatgtccctgcaaaggacatgaactcatccttttttatggctgcatagtattccatggtgtatatgtgccacattttctttattctgtctatcattgatgggcatttgggttggttccaagtctttgctattgtgaacagtgccacaataaacatacgtgtgcatgtgtctttatagtagaatgatttataatcctttgggtatatacccagtaatgggattgctgggtcaaatggtatttctggttctagatccttgaggaatcaccacactgtcttccacaatggttgaactaatttacactcccaccaaaagtgtaaaagcattgctatttctccacatcctctccagcatctgttgtttcctcactttttaatgatcgccattctaactggtgtgagatggtatctcattgtggtgttgctttgcatttccctaatgaccagtgatgatgagctttttttcatatgtttgttggccacataaatgttttcttttgagaagtgtctgttcatatccttctcccgctttttgatgggtttgtttttttcttgtaaatttgtttaagttctttgtagattctggatattagccctatgtcagatgaatagattgcaaaaattttcttccattctgtaggttgcctgttcactctgatgatagtttcttttgctgtgcagaagctcttagtttaattagatcccatttgtcaattttggcttttgttgccattgcttttggtgttttagacatgaagtctttgcccatgcctatgtcctgaatggtattgcctagatttttgtctagggtgttttatggttttaggtcttacatttaagtctttaatccaacttgagttactttttgtataaggtataaggaaggggtccggtttcagttttctgcatatggctagccagttttcccaacaccatttattaaatagggaatcctttccccattgcttgttttgtcaggtttgtcaaagaccagattattgtagatgtgtggtgttatttctgaggcctctgttctgttacatttgtctatatctctgttttggtaccagtaccatgctgttttggttagtgtagccttgtagtataatttgaggtcaggtagcgtgatgcctccagctttgttctttttgcttaggattgtcttggctatatgggctcttttttggttccaaatgaaatttaaagtagttttttctaattctatgaagaaagtcaatggtagcttggtgggaatagcattgaatctataaattattttgggcagtgtggccatattcacgatattgtttcttcctttccataagcatagaatgtttttccatttgtttgtgtcctctcttattttcttgagcagtggtttgtatttccccttgaagaggtccttcacatcccttgtaagttgtattcctaggtattttattctctttgtagcaattgtgaatgggagttcactcatgatttggctctctgtctattactggtgtataggaaggcttgtgatttttgcacaatgattttgtatcctgtgactttcctgaatttgcttatcagcttaaggagattttgggctgagacgacggggttttctaaatatagaatcatgttatctgcaaacaggcaatttgacttactctcttcctatttggataccctttatttctttctcttgcctgatcgccctggccagaacttccaataccatattgaataggagtggtgagagagggcattcttgtattgtgctggttttcaaagggaatgcttccagcttttgcctattcagtatgatattggctgtgggtttgtcataaatagctcttattattttgagaaacgtttcatcgatacctaatttactgagagtttttagcatgaaggggtgttgaattttgttgaaggccttttctgcatctattgagataatcgtggtttttgtcattcgttctgtttatgtgatggcttacatttattgatttgcgtatgttgaaccagccttgcatcccaaagatgaagccgacctgatcgtggtggataagctttttgatgtgctgctggattcagtttgccagtattttattgaggattttcacatcgatgttcatcagggatattggcctgaaattttctttttttgttgtgtctctgccaggttttggtatcaggatgattctggcctcataaaatgggttagggaggagtccctctttttctatagtttggaatagtttcagaaggaatggtatcagctcttctttgtacctctggtagaattcagctgtgaatctgtctggtcctgggctttttttggttggtaggctgcgaaattactgcctcaatttcagaactagatattgatctattcagggattcgacttcttcttggtttaggcttgggagggtgtatgtgtccaggaatttatccatttcttctagattttgtagtttatttgcatagaggtgttcatagtattctctgacggtagtttgtatttctgtgggatcagtggtgatatcccctttatcattttttattgtgtctatttgattcttctctcttttcttctttgttagtctggctagcggtctattttgataatcttttcaaaaaaccagctcctggattcattgattttttgaaggattttttgtgtctctatttccttcagttctgctctgatcttagttatttcttgccttctgctagcttttgaatctgtttgctcttgcttctctagttcttttaattgtgatgttagggtgtcgattttagatctttcctgctttctcctgtggacattgagtgctataaatttccctctaaacattgctttaaatgtgtcccagagattctggtatgttgtgtctttgtgctcattggtttcaaagaaattatttatttctgccttcatttcattatttacccaatagtcattcagaagcaggttgttcagtttccatgtagttgtgcagttttgagtgagtttcttaaccctgagttctaatttgattgcagtgtggtctgagagactgtttgttatgattttcatttttttgcatttacttccaattatgtggtcgatttcagaatatgtggtgctgagaagaatgtatattctgttgatttgggttggagagttctgtagatgtcttttaggttcactcagtcctgagctgagttcaagccctgaatatccttattaattttctgtctcgttgctctaatattgacagtgggatgttaaagtctcccactattattgtgtgggagtctaaatctctttgtaggtctctgagaatttgctttgcgaatctgggtgctcctgtattgggtgcatatatatttaggatcattagctctgcttgttgcattgacccctttaccattatgtaacgccttaattgtctttttttaatctttgttggtttaaagtctgttttatcagacactacgaccgcaacccttgctttttttgtttgttttccatttgcttggtaaatcttcctccatccctttattttgaggctatgtgtgactcagatgggtctcctgaatacagcaccctgatgggtcttgactctttatccaatttgccagtctatatcttttaattggggcatttagcccatttacatttaaggttaatattgttatgtgtgaatttgatcctgtcattatgatgctagctggttatttttcccattagtcgatgcagttttttcatagcatgaatggtctttacaatttggtatctttgtgcagtgggctggtaccagttgatcctttccatgtttagtgcttccttcaggagctcttgtaaggcaggcctggtggtgacaaaatctctcagcatttgcctgtctgtaagggattttatttctcctttgcttatgaagcttagtttggctggatatgaaattctgggttgaaaattctttaagagtgttgactattggcccccaccctcttctggcttgtagggtttctgcagagagatctgctgttagtctagggaagatgggcttccctttgtgggtaacctgacctttctctctagtgcccataacatttttccatcatttcaaccttggtgaatctgacgattttgtgtcttggggttgctcttctcgaggagtatctttttggtgttctctatatattctgaatttaaatgttggcctgtcctgctagtttgaggaaattctcctggataatatcctgaagagtggtttccaacttggttccattctccctatcactttcaggtacaccaatcaaacataggtttggtcttttcacatagttccatatttcttggaggctttgttcattccttttcattcttttttctctaatcttgtcttcacgctttatttcactaagttgatcttcaatctctgctatcctttcttccgcttgatcgattcagctattgatactgtgtgtgcttcatgaagttctcatgctgtgtttttcaactccatcaggtcatttgtgttcttctctaaactggctattctagttagcaattcctctaaccttttttcaaggttcttagcttccttgtattgggttagagcatgctcctttagttcagatagagagatgataagggatcagaagaggccagtggtgaattaactctgtagcctagaaccttgtaggggtaaaaactatttatcatcacctacacactcttactgggcatttattgtggccaagactcgggttcctgtgtgtctgtagagggccttcattgtgggtatccacaaagtgagttgaaacaaagctcatgcatgagaagcgctgatggagttctcccttgctcctgccaccttcttatcatctgtagtctttttcttactgctgagggatccttccagtggtcacatttgcccatagccctcctgaacgcttgagtctgcagaaaacctctagctggacagcttctgggtagagaaacaggccatgaagagcctcctacatgtgcaccatgtggctacgctccgtgacgagggaaaaacaggaatatctgtctgctgtgatcacgtgtagtggtcacggtgagagatgacggggctgctcctcctcagcctccagtcaggctgtgtggcagcgatcacctccatgtcgatggagtgtctgtgcagtttgggagcgaggctctgcctctctcggtgagtgtctcacagttcctttctccctcagccccatgatgccgtccagaacaaggtgctgaactgattaatgagcaggacataaagacaactgctgtccagagcaacagctgtcccaatccatccgtggaataaacaaacagggcagagcgaggtcccgaccagtggggacttgggtgcaggaaatgccagtctcttcttgcttgaatcagggtgtcagggggccttcctggccaccactcaggctgttcctttagctttctggatcccattccctgcaggtctacccttgggagtgaaatagtgaccgtccctttgagcccgagagctggggagaaggccgtgcctgttaacagctgcctggaccctctctggagagcagcagggagaggcggggctggaggagatgttgccaagaacctaagggtgttagtgacaaaagcaagaactcctggcaacaagtccgagggactttcttgatcacaagtggtatctcctaagcactttaattatagcagattaagcaggaagtggagtgccggactaaaggaataatgatacaaaggaggtgaagcagaaaaacttaatttccttcctttaagggaaaaaaaagtccatttatttagacgcattgcaaagaaaagaatggagtgtggcctttcccccagctcggagctcagtgggtttttaaagaactgtgtgtatctctttggccagaccagcgactgggatcttcagcctctctgcagaaaatgagccgcaggctcgggatttcgttaagatgcaggagcattccttctggaccaatgactcactcattcagccccttctttcccgcttctccttgtcagccctcgcctggctgagctcatattttacattcagcacctctggttacccagaaattgcatgcaaaattgtgaaatagaaaagcagtgggctgtgggctccatcagctctgcctggcgttgcatcatccttgacttgcaatgctcagaggctgggctaggagatttgcttacagaaagcctgaaggtcccagggaccttcccaaagttgcgacttgaatgcatgctcttagcacacatgctgtgtaactggggcagatctgtaggaatgagtggaactgaaatcagaccttagaaagtcacagtgaataagaaaattgccagaatggaatgcagatatacctactggttactgtcctgtatgtagcggctgtgtgggatttgactgtgttttactaataggagccttgttgggcccagtgcttcataactagctctgtctgtcgggaatcccccacagtatcctgcttgtgattcacgctatccagagtccagggcaaggagttctaaaaccttatcatgttttgttttgttttgatacagagtttcactcttgttgcccaggctggagtgtaatggcgtgatcttggctcaccacaacctccgcttcccgggttcacgccattcttctgcctcagcctcccgagtagctgggactacaggcgcccgccaccatgcccggctaattttttgtatttttagtagagacggggtttcaccgtgttagccaggatggtctctatctcctgaccttgtgatccgcccgcctcggcctcccaaagtgctgggattacaggcgtgagccaccacgcctggccgttttgtttttgagagacaaggtctcgctctgtcacccaggctggagtgcagtggcatgatcatagctcactgtaaccttgaactcctgagctcaagtgaccctgctacctcaacctcccaagtagctggcacctgtaggtgtgcaccatcacacctggctatttttttttaattaactttttgtagagatgggctctcaccatgttgcccaggcttgtcttgaactcccacctctgcccacatgctgggcattcaattcctagatctcttcctccctcctctcttgacttgcctcctcctggatcatgatatcttatcattttccaatcacagcgttaatggtaaggcttgaggctgggcgtggcacccatgcctgtaaacccagtgctttgggaggcagaggtgggagttcaagacaagcctgggccatgttcagcactttacatgcccattcactgagtttgcacagccgcccatatgacgggcattgttattcctactgtacaggtgaggaaatgggggctctgagaagtgtgactgtttgtgggaggcagcagctggcatgatggaaaaagtgtaggcattggaggtgggatccaagtccagtcttccacccacaggttcagtgatgtggggcaagttatataacacagttttctcatctgtaaaatctggacaggcatacctacaccctggagcattgggaggattaaatgagatcgtgtagataacagcatagtcctggcatatgagagaaaatggcagggatctttctatgacctcagtgtgagaagcaagatctaaaccctcagaggtagagtgcgtcccacactcgggctccttctactgggacactggcttccggatctccacggagaactgttcttaagttagaaggcaagcacagcggggacacggtgcaggacacctgcggacccagtgcccttgggattctttaccttcagctttgctcactgcagattagtcctcatcgctcagcagagagagtcgagattggcaggaggatctccgtcttgaacaacattatgattctctgagcatttctatatgttgaaaatattttatttaaaaattacaaccacccctcctcctcaaaattgcatgacagagatttcaccaaacctgacaactgatgagacaaagagaacaagacacagagaggaatttagaaataatccttgtgcataccttccgaagttgccacatattactaaaattacctgtatctgtgtctatcctgctactctatgcattacatatctttgcatcccccatgcctagcacagtgcccagcacatagtaggtgctcaaaaaaagtgcccatcatttgttggactgaactcacaacacagtaacaaagagccagttagagcaaatgctgtcccttttcccaggactgtagcttccagacccgtgtgaggcctcagcctgatttctgttcaccttagaaccccaaggctgactgtgcatttccataagcacctcgctcgcctgcaggacggggctgggttggtggtgggtaccagaggtgctcagtgttcaatcacgcagaaagtgggctaaagggcagcgcctcctgctccctccagagatgcacttccattctctgaaacgacaacttctctgcactcgcttaatgggatcccaaataacacgtcgcagaccagtcttttatcactgttgccccttggaacacatttcgaatgctggccattaaaagcaggccatttcacggttctttaatgatgacactaataactgtggatttttgtctcccagagtcctgatgagctgagccaaggagtaaattacggagctaacttttatgtgcatggtttattgatctgtgagcttcaaggaaactgcaccagcccctatagtttggcagtccagactaccttttcatctgtgtaattgggccacgagggcgcagttaatattcaatttatattaataggaagacaaagaacatgatgtgccagctccatattgaagtaatgggcatatcaaaatattctacctggtaattataaataaatcagttttcccgtgacccaccaaggatgatgttgctaattcactgtgcatttcatcataatttatcctgagaaagttcagtgctgccatgtgcatgtatatcgcagagtatacaagggtgctccatcgtaaaacacccagctgtcttcatccatgctgtcgcccatcttttcttaacaggtgaaagtcatgcttcgcatctgttccaccttggctcgagatacttcagaatccagctctttcttaaaggtggacccacggaagaagcagatcaccttgtacgatcccctgacttgtggaggtcaaaatgccttccaaaagagaggcaaccaggttcctccaaagatgtttgccttcgatgcagtttttccacaagacgcttctcaggtgggtatcagccccctctcaggctcaggcaacgttgatgaaagggcaacgtttactcattcacaagggcccttgagctgggagggtgtcttctggagcattctgatggaccagttccttcaggagtcaatctgagctccaccgaatggtccagtgcttttgaattactggtgtcagaccttgggcaggatcagtgtgcacagatttcaataaaatctgtccttggggagaaggaagtgtgagccagtcagtggatcacacacagaagcaggaagataacagaaagggacaaggacaatgcgtcaaggtgctggtgacagatctagtaggaccctactcctgcctgggcattgtacgaagggaaaaaaaaaagtgtttcagggagctgattagaattaggccatctcctaggccctgtataagcacactggggttgagggcaagcctgtagccctagtaaggaaccagagtgcaaggcagggaaaccgaggctgacatgcatcctgtggcctggctcagtggagtgaaggggaagaagagaggctcagggacaggtgttgtattcgctgaattgctgccttacaaatcaccctaaaattcagtgcttaatacagtaagcatttatcattgctcatcggtcagctgagcagctcttctggtcctagctcagctcatttttatgtctgtgatcagctgtgggttgggcaggcagctctgtggatcttggctggatatcagccaggcgaaataagatcatcctatatcacaccataggcacatgtctttgggggttggctggccttacactggtgtagaatagccttgaccaggtcagctggtctctcttccacattgtcggtcgtcatccagcaggctagcttgggctagttctcaaggcagtttccaggacccatgcatgcaggtctctggaggcctaagctcagaattgacccaatatcacttctgctggattctactggcccagcttcatgagatggagaagagattgcttctaatgattggacgagctccaagtcacattgcaagggagttgcacccaggctggggtggagaattggggccatttttattaatctactatgagcataattgggaggctacttgggggcccagggtaccaagattactgagccatgggcagccaatgaactgcagacctcaccagatgctgcaactaaagctgctagtagatatctgttctcctttggattcaccctggagctttggtgaagatgggcctctaagtggcacgaaacagcacctgttccttcaggggagggagcagggacagacgtgtagaactgattgcagaaatgaataacccaggttatagaatatagcctactttgcctggagtttgcatctttctggtaagtttctagtgcttatcaagatttacattaaacagtgtataggataataactaataatctatagcagaacctgacgacaacagtgcgaatagttaccatttgcagcctctgtgaatttcctccaggctgcatctgagtagaggaggtggcgatgttctcacgggctcctatattacaccgtgggcacacagcacatgttacaggctccattcattaagaagttgagcatgcggtttccccaaagagttttacccaagaagacaaagtactttatgaataagttctatggtttctctccttattacattttttgtgtggcatatcacccaatgggctcagtaatttaaacctgacgtttggtctaacaaatggcctacaaataatttcattaacacagttaaaacttttcagaagcaaatctccacaagttgtaagaattccaaagcaaaccctaaatcaagcatggactatgaatgcgttttagatttattccagaaaaagggtccattttaattgctagtctttgtttacatttcacactcggctgcagagctcagtatgctcaatactggagtttcgctcatttcagaatgccttactttcattcacatttccaatgttataataaattacatgtctgtataaatttgcagttttcaagacatttcgtagacattaacacatttgactcttcctagaattcagtggggtaggaagagaggcactgatgttctcatgtgacacacaaggaaaccgagactcaaagatgaagtcacttgttcaaagtccctttcccgagcagacgtccttcctggattccccccgttaacctctctgtatcctgctcggtatggtggtgtatctttgacctcctgccattttatccaatatttcctagcagtgtggcctcaggcgagtcactcaacctctctggacctcagtgtccttcctcatctgtcaggtgaggacatgaccacaatgttcctcatcaggccgtgtgattcctcgagttgacacacaggaagtgctcacagcagagccaggaacacagcaagtgctcaacaaatgcggctatttttaccgttatcactgccaatattagcagcatgctgctggccagggcaaactcagccccacagggtgggcacccctggagcccccaagcctgaaaggagggagtgtgcggagtgggcctgtgctctccagtcctcattttcagcctgtgaagccgcagccactgtggtgacccgggcagttagaaattgtgctttctcttcgtttctaaggaaatcagcttcctgaagctaaacagtgattagaacagtcctgtttcatggttgcctttgagagccatatgacccttcagtggcttcggcagtcgctggctgcccctgttgggacacgtctctgctgggacacacccctgctggagaacctggacttgtgggcaggcagagccttcctgcagacctggcccttcccatgggggctgtgctcgagaaggctgcatgcctctccaggtcccaggggaagcagcaaggggcctccggggcccctgccagctcttaacacacaccagatggacagcccgctgaccacgctcttctcagtggagagccgggtgggaactgtgccaggggatgccgccccaactctgcacagcaggtctcctctcgcccccggcctctgcacgggtgactcagtgtggtccacacacagccaacattctcccaggtggctcaagaatcaaatacagcttattttatgtatagctcaaggtgatttctcagcctcctgcctcccatcccactttatgtccaaagaaggcttagtccattgggcagccttctgcctgctctgcagacacgcctctggcaaattccatcaagacgctactgcttctgtctcagggttagcactgggctctccttgcctaagtcctggggggtttgaaagatcctgtgtgccctacagcagccctgtcctgccaccccctctggcccaggaggagccccccgccccccgcagagttgctggggaccaccctggaacaagtgacagctgttggaagtgtggtttttcaattttagtttaggagagaaaactgatttccaaatacttgggttcactgtgctgctgaataacaacattcacggcccaggtgcccaccgggaggcacgctgccccgagggctgcaaagccccatgttagcactgcctcccggagctcccacgagccctgactccggccccgagacagaaatgaaagcaacagggcacagcgaataatgctatctttctgcttctgtgacaagtctcaggtgctaaacaaagagaaggacatttcccagatctccaagttagtccacaaaaccgacagctctgatggctcgcagagctctgtattagcgggtgttcaggggaaatacaaaacatcatcgagagcctggtccctgtctaggatttaataatcaaattggagaccagacacacacacccggccaaagaacacctaataacataccatgtggtgactgatactctatatgttgaatgtatctgtagcaaaaggaagaaaaggcaggttttgaaaagaggagcatgggacgggcgcagtggctcacgcctgtaatcccagcactttgggaggccgaggcgggtggatcacctgaggtcaggagtttgagaccagcctgaccaacgtggtgaaaccccctctctactaaaaaaatgcaaaaaattagccaggcatggtggcacatgcctgtaatcccagctactcgggaggctgaggcaagagaatcacttgagcccaggaggcggaggttgcagtgagttgagatcgcaccattgcactccagcctgggcaacgagactgaaactccgtctcaaaaaaaaaaaaaaaaaaaaaaatgaggaaggtgtgaattgaaaatgaggaaagagatcaggagagaaagcagatatatatcacaaacctcttgcttacgtgagaactacggtgtttctcaaggtctcacttgtgaaatggtgggtcacctttttccctctcataagcctggcctgtttaataaactctatgtatacgtgtgtcagcagagggtgagtggagagtttaaagaccttatccgggaccccagaatggcagatgagggaagggaatgaggttcatgagcacactgtgcccccattccagcctgctcctgcctgctctacagacgcattcgctgaaacgtaccacggattagcagaagggtggtttgcagtgcatgtgcataatgctcaggcttgcaaagggcggaaggtcgccaggggttctgagcatctccaaaacttcacgacagaggccaacccacctgggaacacagtgacactgggacccgaagccccaggaaggtgggctcactttcgttgttagtggtgtctccgctgcgaggtccattcacggctcgtgtctcctcttgtgtctgacaggctgaagtgtgtgcaggcaccgtggcagaggtgatccagtctgtggtcaacggggcagatggctgcgtgttctgtttcggccacgccaaactgggttcgtgagagtttcactttctcatgcggctcgttgagctccctgtcatcccatgcattcctctgtctccctcccagagttctctgatgacaggaagggctgcgtttctcttaggtgttgagctgaataaccaataacaagttatacgacgaaaacctatgttgttcattgtaggtggacacccattcatgtaggaaagccttcaagtccaaatagatggaaagagaagtagcagagttgttcccacttggtccaggtcagagtcaagcccagaaggcaggcaggaaaatattcatttcctgagcagccgctgtttgggaagcagatagggccccttgcaccaccgcacccatgaggatgtgggttggtggttggacccctgtaaaagccagaggagcaacctccaagcaaagcccagagcccagggcgcgtctggagaaagcagtgcacaccgtcgggaacactccagcgctgaagcgtctgggaaaggaggcagcagagccccccaacaaggggttcataaatccccccacagtcccatcttacttctgacctgtggccatctgctccccaggccttgcccttacacgcttgatatgtttagtgaattgaggagcttcaaaaactgtcccttggcagagattccaacagaggccttgctggagctcacagaggccagttctcagccaggacagaaagccattgcctctctctgcacttccgtcctccccagccctttctcttgatcttgatgtaagcagtgatctgggttttaatagaatttgctcatgccataaaaatatacacagcatttaacttgagacaggatataaagtgtgaatatgtggacttaatctggggggtaactataaaaagaaccataatgatgatgaaaaagcccagccttcccactgtgtgtaaagcagtgcaggaactggatagcatgtgatatttggggtcctcctcaaggtacatggtgatttaatcttgtcacatgtctgggctcttgctttgtttcttttttttttaagagatggctctcagttgcctgggctggagtacagtggcatgctcatagattactgtaacctccaattcctgggctcaagtgatcctctcgcctcagcttcccaagtagctggggccacaggcatgccccaccacacccagataatttttaaaaatttttcatagaggcagggtctccgtatgttgcccagactggcctggaactcctggcctcaagcaatcctcccatcttggcccccacaaagtgctgaggttacaggcatgagccactgagcccaaccagcattctttattgtagccatttagttagtaataccagaaaatgccttctgttgttgtcaaatactatttctctcatctttttgttccttctcttcccttttccccccttccctgtgcctttcttctatatccttggcatctattttggagactccgtggaatgatgcctggacactgaacctgcttttcttccttccctggttctcccaggaaaatcctacaccatgatcggaaaggatgattccatgcagaacctgggcatcattccctgtgccatctcttggctcttcaagctcataaacgaacgcaaggaaaagaccggcgcccgtttctcagtccgggtttccgccgtggaagtgtgggggaaggaggagaacctgcgggacctgctgtcggaggtggccacgggcagcctgcaggacggccagtccccgggcgtgtacctctgtgaggaccccatctgcggcacgcaggtgattgcttctgaagcctggctcgccccaaggtggctccctccccacctcagaggctggggcagctccacccgtgaatcactgaacctgtaaactcagaggcttacgggtgtttactttaaagtggactggaactttatggcctgcagctgtggggccatcggcttgcccagtctaaatatttgtaccttgactctaattgacaatgagcagggaccacaattacagcatttgggggagaaatggaattcactttctttatgcccctttcaaaaaaaaaaagtaacaatctttcttttgtttaacaacaaaccggaatatttactgctctgcacaaatagctagagccattacggggctgttgatgactctataaactgtgcttctggcactggtttacagccggattagcagtgctgcaggaaaaactaataaccactttctaattagaaccgtgatataattgctagaactatggaagccaagagaagctccagttcaccatttcaggatgctaagcctgttgggagggtctctcctttgctgtttgacaacagatgtaggaatgacccgggagctgcaattcattcatatccagaataatcaatccttccagtctctaacagtaggctttattttcccgtgttgtcagatgcctccttttgtagataggtgttccgtttgataagtacctgcctcttcccaactgggattgtttgcacaggtgaggatacctcccgtggcctgttatactcattactcaaacctgaccatgctcttcccctgcttaaagcacctcagatccctccatttccctgagtcctctttcgtctgcatctgtcacctcgaggacttgtttaaacactgatcgctgggcacccccccagagtttccaattcagtaggtctagagtagagctccaaaatgtgcatttccaacaagttcccatgagatgctcatgctgccggtccagggatcacagttggaaatcactgttctgaggcatcaaatgtgcagagacagtatctacacagtgtctgtgatgcaatcagtaggactcgacccactgctcctgttccaggcattttctagacattcaaatatgctttcacccccattcatttttagaacttcattgatgaaattccactaaggggtgaaaagtctggttaaatgaaggctaagaaaaagaagaaaagaccaatattccctttaattcttgttgaaaaatcttttaaattctttggtttatttttccatagcgagacaaaattttgaacacaaaagaatctctctttgaagtctgaggattttgatggcctcaggttctaaatattggctcttacagttcaaaattatttgtatagttagagtagaaaattgtcagaatttgtaccaaccttaagacatgtactgcaaattagttctttgaacaaatcagaaacatgagttgccttttctccccaaaaagaggagtgctggttcaattctgttaatgtgatcgttgtgattcaggtttaaaataattgccaagtattttcataagattcagacgcattaccctgtgtgctttctttaatcaattaatgagtatgccgggagcatggattcaggaactaaaggtaaataggtatctcctaaatttagatgagacattcaagtatcgtgagtgtttgagggtgccctttacactggtttcttatttataactatgctagtaaatatggcctaaaattggctttaattaaataactgcaaaactaggagtcaaatgaaagctaaccaagtttttttacatctttgggacaccactgctatgaggcctcaaatcacattttgcaacctacctgtctccaaacaatctaatctttggactcaagatgcagtcacatcgctcctgttttcttaggtaaatggatagccaggggtgttggtttgccgccctctgcagagataaggatgagccatctgctcccagcttttcacacccactagttccagattctacttagactgtaaagtaggtaaaaataggtttcatccaataagtatgctcaatattaattttcagaaatgaattaattaagctgagaattgcacatgagcatagcaccttgtttcagaagggttttcagccttagaggggcacgtggctttactatacagaacacacagccagctgaatggtgctggggacacccaggcatgagtgacagcaagccctcctcagcctgcagcctcatctcttggcttctgtcttccagctgcagaaccagagcgagctgcgggcccccaccgcagagaaggctgcctttttcctggatgccgccattgcctcccgcaggagccaccaacaggactgtgatgaggacgaccaccgcaactcacacgtgttcttcacactgcacatctaccagtaccggatggagaagagcgggaaagggggaagtaagtcggccactccaccctcctgcctccttagcggctctggccccagccagaaatcccttgggcaaccatgacctttgtgtgtgtgtgtgtgtgtgtgtgtgtgtgtgtgtgtgtgtgtgtgtgtgtgagagagagagagagagagagagagacagggtcttgctctgtcacccaggctgcagtgcagtggcacgatcacagctcactgcagcctcaaactcctgggctcaagtgatcctcctgcctcagtctcccaagtagcttgggactacaggctcatgccaccacacctagctatttatttggttatctttgtagagatgggaccttgctatgttgcccaggctggtctagaactcccggtcttgagatcctcttgccttgatctcccaaagtgttgggatgaaaggtatgagccaccatgcctagccaaacttttcttaatagactacaatatgcagttcagtgactcgtaattcaagataattatagtatctgggctgaagttcacttttgaactgtccagggaaaggagtttgctttggtaaaggtaatttacaaatgtcattgccatgagaatgtgagaggtcaaagttacaaaaagaaaacaactgcctgacagtatctttttgttcacagacctcaaaaatgctcctcaagaaagaccaacatttatccaccaaagcactccggcagtgtgttatcatcattagctcgaggccactgtatggaccatgttttttaaaatagcatagaaatcagacttttgaataactacccagaccctggctgcctccctcaaatcgtcagtgaaggtttactgtcaaaacccaggtacggtgcctgctcttcgagtgagctgccctgccaggaacccaacactgtgcccctacagacccctcttggctgtgtttccaaagtcagcccgggctggggtgcaattctctgccttctgtgaagtagtgtttactctatgcccaaaagagttgagcaccagatcagctgaatgtctccagtggggatcttggaccaggggcaaagtggtctgttgatttcactgggttcctaaggcaggttgtgggtaacggggctgctgggctggccgggcagtggcttccgtggttcctccatgtcccgctctgccgggctttcaatacacaggcaactggctcccagcgctttctgcatgattgtctcaaagacactggatgccagaaaaacaatcagaaaactgagttaagagtctaaccctggactggaaattgtaaagctcattgagtaaagcagagatggtccgcaaagctgttgtagatgaagcctagaatgaagacatccaagtaggaccaggcgtggtggctcacacctgtaatcccagcactttggaaggccaaggtggttagatcacttgaggtcagcagtttgagaccagcctggccaacatggagaaaccccgtctctactaaaaataaaaaaattagctgggcgtggtggcacacacctcccagctagttgggggtctgaggcaggagaattgcttgaacccaggaggcggaggttgcagtgagcccagatcgtgccactgcactccagcctgggtgacagagcaaggctctgtctcagaaaataaaaataaaaagacttccagctgggatctatggacaggctccccctgatttcccctaagcctcctcgtggctcaaaagacctggacaacagtactcctggggagagagctctttgcgggcttctgctgtccccaggcaaaagcgcctcccttcccccacctcggtgcctctcttcctactctttagttactgttgttaaaatccaggtttattgcagtataaggtacattcaccaaaacatcactttgatgtgtctttagatgagttttggccaatctatacagtcatgtagccaccaccattatcaaaatagagcataaggctaaagttccctcttgccgtttgtcccttcccctgacctctagcccctggcaaccacggatctgattgttgtcctggttttgcgtttatccaggatatcgtgggaatggactcgtgtggcccagatgtggccttttgtgtctggcttctttcacgtagtgtcctaatgcatttgagactcccccatgctgcagcacgcgtctcttgtttcttctggttcctgctgcctgttctgcctgctcctttagtttttttgtttgtttgagatgaagtctcactcactctgttgcccaggctggagtacagtggcgtgatctcggctcactgcaacctccgcctcccgagttcaagcgattctcctgcctcagcctcctgagtagctgggaatacaggtgcccaccaccatgtctggctaatttttgtacgttaagtagagacggagtttcaccatattggccaggatggtcttgaactcctgacctcgtgatccacccgcctcagcctcccaaagtgttgggattacaggcgtgagccaccgcacctggcctctccttcagttttgactgggcctggaggcttggttcctaccctaccaccaggacagaatgaaaatatccacagctggggctggagttcctctaactggggctgctttttatggctctgaaaatcagccctgagctgcctccagtggctgctgtgaagaaccgagaggttctggtcctcacttacagcgggcgaggcgccccagggaagtggcccattagcttgagggcagctctctcgacagcccatgatggtgagcaaagtctcactggagaggagccgaggatagtgaacgggaatctctcgggagatgtattcttggtaacaggctcacaccatgtagagcgcttccgtttagaatcacgttcttaaagaaggaaacgcattcggatagggatgaggagatgcagacctttaaaatcggatagggatgaggagatgcagacctttaaaatcggatagggatgaggagatgcagacctttaaaatcggatagggatgaggagatgcagacctttaaaatcggatagggatgaggagatgcagacctttaaaatcgacagcacaattgcatccacatttctcctgactgtgtgggagttggccttgaaccctgccctcactgttttctcctgggtagtgtcttcaccctgtcaatgtaagagtctgacaaatgtttagtttattcttttaagcagctgtcagtaatcatcatcatcagagcctgcaggactttcttgtactttcagtaaagagtgactcgcaaaacatctaacccttgagccaaatgactcccaaatggcactgatcagaaaaacttgggagatgggattatctctcctccttccaggtttcaaaccaaactgaggacaactctgttttcggttttgtactttttttcttttttgcagttctgctttcgatttggaatctgaaagtagggagaaatcttgaaaacaaggaaacagttcattaaatgacttcaaatataagaacttgaaattcagattccacaaaagtttaggccaagacattccctaaacccagtgatccaccccaaatcagtacctaaggaatcctgcacccttattaaatatttaatagccagctcatcttcttcctatttttaagttgtgaaagagaattgcttttaaataatgcattcaggttaaaagaaagggcaaataccacgaatggtttccaaaacctcggttaggtccttcctaatgtttcagtggatgagaacaaagaaggggaaggagtccaggggtcgtgcgatcggcagacctgggggacatctcttccctcccgaggggaaaggatcccggccagaatgcacacggcctccccgcctgggactcacttgacttcagtgaatttataactgtttaaaatataatgaggagatttggagggttgtttaaaatggaaattttgtttacttacatataagtaataatccctgcggacctggcagccagaactcaattaggggaaagtttattaattagtcaccctgcagggaagccattagaagagatctctgccgcaagaactaaatagactctgtgtgcgcctctgaatctcatatgcacacatgcattttatacattttacacacaaatgcatcttacatttataattttacacacaaatgcattttacacatataagtagacagacaaaaaaaagttttaaacatttccagtcaaaatagaaaagtctttgttgatgtatccctgttttgcagatagcactaggttaagcttaaaatatctccctgtttaaaagctcattggaattagtgggactgatccttcagcctcatggaggccttcctctgctttgcgaagctaaatctgtaatagcttgagagcctcctcgggaatcccagcactgggaaacagaccctgaagccctactgatcagagagctgcttctcataacgacgcgtgtactgggcacctaaaacaaggtggtgcttgggaccagaagtgtttcagatttcagattgttttccgattttggaatatttgcatatgtaatgatcccttgggaatgggacccaaatctaaatacagatttcatgtatgtttcatatatgccttatagacatagcctgaaggtaactttatacaatatcttcaataattttgtgcatgaaacaaagtttttactgcattttgactgcaacccctcacgaggtcaggtgtggaattttccccttgtggcatcatattggccttcaaaaagtttgagattcttggagtattttggatttcagattttttgggttagggatgctcagcgtggactagtgatacttcagggtaatgcgctaatgatacggagatcgcacctgtcctgttgacaaagataatttcaaaagccccacttttatgagtaatctaagcatgcaagcaactgttgctcaaggtccacaatgacaccgggtctctgatttgttcattctctttattgcctctgtggggaggattagagggctttgtaggctgggctgctgtgtgcgcacacaaatgtatgtgcacatgggcacacatctgtgctacactcatctgtctacacatctcatcagactctttaatctgtttttttgtttgtttgtttgtttgtttgtttttaacactgagtctcgcactgtcacccaggctggagtgcagtggcgcaatctcaactcacttcaacttccacctcctgggttccccgcgattctcctgcctcagcctcctgagtagctgagatgacaggcgtccaccacaacacctggctaatttttgtgttttttagtagagacggggtttcaccatgttggccacgctggtctcgaactcctgacctcaagtgatccacccacctcggcctccccaaagtgctgggattaccatacctagcctaatctgctttcttttgacaatgcaaatgttttctttacatgtcatggaatggcttaaatcaactaatgctgtatttagggctgtgtggtggatatgactctggagatccattctttgggtggcagatgtgggaaaagaggcttaggaaagaaccttgcttctaatggagccacagccagtcccctgctgtccccagcagcgaagccctgtgcagcaaggatgtccacacactacagggctctcatctcccgcttggtcaataatgaagtggcagtttcatctttttaggtttttgtaatctatatgtttttaaatgttggccaggagacactattctgaagagtgcagcctggaattcccatcaccgcctccgtttctaatcttctcaagcctcctggccactctcagcaggtaactagcatcttagtcaatgagaagacagagctgacctggtgcattcctcaacttctcttcttttggtttcatagtctcctggtccctttacctcagtttcccccctgctccttcccacaggcctgctgctcccgtctcctggcattcttcctcctgccccttctgcctcttctgggacctcaccaattgggaccccctcagtggtcttttcatgcttatgttttcagcctttcctcccaccaaagtcagggttacagaaggaagagaaggaggcagggagggagggaaaaggaaaggaaaggaaccacaatggcaccttgcctctgccacgctcctctccgatcgcctcctcaacaaagacgtcagattcccctctttgtaatgtcttctttgaatttcagcagtgtgggggatgttatgcttttgccttactccgccttatattttggctgtttgtgagctagtccaagccctattggactataggtgccttgagaaagagtgccacagtgccagggctgtgtctgctgcatgctgtttgtgagcttgtccaagccctattagactataggttccttgagacagagtgccaccgtcctggggctatgtccgcagcgtcagtatccaaggcctattagactataggttccttgagacagagtgccacagtgctggggctgtgtccgctgcgtcagtgtccaagccctattagactatagggtccttgagacagagtgccacagtgctggggctgtgtctgctgtgtgctgtttgtgagcttgtccaagccctattagactataggttccttgagacagagtgccacactcctggggctgtgtccactgcatcagtgtccaagccctattagactataggttccttgagacagagtgccacagtgctggggctgtgtctgctacgtgctgttggtgagcttgtccaagccctattaaactatgggttccttgagacagactgccacagtgctggtgctgtgtccgctgcatgctgttggtgagcttgtccaagccctattagactataggttccttgagacagagtgccacagtgctggggctgtgtctgctgcgtgctgttggtgagcttgtccaagccctattagactataggttccttgagacagagtgccacagtcctggggctgtgtccactgcatcagtgtccaagccctattagactataggttccttgagacagagtgccacagtgctggggctgtgtccactgcatcagtgtccaagccctattagactataggttccttgagacagagtgccacagtgctggggctgtgtctgctgcgtgctgttggtgagcttgtccaagccctattaaactatgggttccttgagacagactgccacagtgctggggctgtgtctgctgcgtgctgttggtgagcttgtccaagccctattagactatgggttccttgagacagagtgccacagtgctggggctgtgtccgctgcgtcagtgctcaggtctcctttgtccaaatgaaatgtgtgctgtggttttaaaaatgattctctgctctcgaactcctgacctcaggtgatccacccacctcggccagcctggccaacatggtgaaaccccctctttactaaaattacaaaaattagtcaggtgtggtggcaggtgcctataatcccagctacttgggaggctgaggcaggagaattgcttgaactcaggagtcagaggttacagggttgcagtgagccgagatggcgccactgcactccagcctgggcaatagagggaaactgtttcaaaaaaaaaaaaaaaaaaagaatctctgggctgggcgtggtggctcacactgtaatcccagcactttgggaggctgaggccggaggatcacttgaggtcaggagttcaagaccagcgtggccaacgtagtgaaacctcgtctctactaaaaatacaaaaattagccaggcatggtggcgggcgcctgtagtcccagctactcgggaggctgaggcaggagaatcacttgaacctgggaggcggagcttgcagtgagctgagatcacgccactgcactccagcctgggtgacagggcaagactccatctcaaaaacaaaaaatgaaaaataaaataaaaattaatctctgtgttatctagtagagctgtgattcgggaagagtaagaccacccaattacctttcacgtaagcagatggtattaggtcagagaagcctcacaacgcaacagagtcaggaggcagtcagctgactgggcaagtatgttagagggggaattatagaaaatgatgtattcataaaggtgttatctgaaattaaataatacaaatgtatttttattcattgatcttacgaaccacaaagggccaaggctctctctttgagttttcaattcaattaatttgacttccacgaaccacattcgtattaacagttcagtttttgctttgaatttcttcaaagagatttaagagcttaaaaaaacactttacaaccaactgggtatagactttttctagattcttacagtattttccactctataattcctcattcacacaaaattcaacatcgttaaaaaaaatttttttttttgagacagggtctcactctgtcacccaggctgaagtgcagtggcgctatcttggctcactgcaacctctgcctcccaggctcaagtgatcctcccacttcagcctcccacgtagctggggcaacaggtgcgcaccaccatgcctggctaatagtttatatttttttgtagagatggggtttcaccattttgcccaggctgctctcaaactcctgagctcaggcgatccacctgccttggcctcccaaagtgctgggattacaggtgtgagccatggtacccgtccaaaaaatcctcattttttatcacatcttttcaaagcattgagttgagtttttataaaaacattaactctctttacaaaatcatttcattggcttatacagtattttatgtttttatttaaaataacaaggggcagaaaccaatttaggaggaaacacagctgacctattaagaactatgcagctgattctttttggagcaaaagtgcacaaactagaccacagcctccactaaccacgagccctcagcgtgctgtgggcgtcaggcagaacttcttatgcaggtgacccagagcattgctgaacctggccaggtggtaaggcagtggctcccaaacttagctacacattagactcacctggagggcttttaaacgcatcccagagtgcgtgctgccctccagcccaattaaattagaaaggctgggagtgggaaccagacgtcaatatttcttgaaagattccagggtgattccaacgggcagcaaagtttgggaggaactacgacggtgcgggaaggcgagttaaaagagcttctgcatgctttctggttagcttcggattttcatcttagatttagcattaattttctatgagatcttgggtgatttatttaacttctatgagcctcagtttccttatatgtaaaatggggctaatttctgcattgtgggatattataggaattaagtgatattaggagaatttaggatttcctgctaccttccaggtgcttaataaagtgtggctcaggcgtaggagacgttattatattgtttcctgtgggtagaataaggcatgtgggtaatttggtttggtcaaagtctagacttaaaatattgcatattagaatataactaaaggattactcaaggcagactgagttgtgttcctttaaccctgcagtcttgacctcaaaatctggaaagtcagtgaggaacctgcttcttacctgctattaattatcacctattgtgttcatttgctgtgtaactacactttctccccagccgccggaagtgatggaaattcttgataatagcaagtggcctgtgctgactcaccttgtactatttcaagttaagcaccatgtgtgaaattcacaattctgtgcctacggcaactccaataggcacggagcagagagtagattttccattgtctaaatgtgactcttactttgagtcacgcaggtataattataggtattttatattatcatcctcagcacagtctaaactgtgccttttgttcttgtgttctgttttactacatgtacattatccattttattccattacatcaaatggactgttagagtcagaattggtctctgtctttgccctttaatctgtggtgcatgtggaatatctgagcttctcctgtctatataattaggctgcaaaacagatgatattttgctttaaaaataactatttccatagcacgctgctgtgacccaagcttgcagggtacaaaatagcataaaacagaagtgacacattatatcttccccttaaaggggttttactgggaatagttgaagagaaacaaaatataacatccttaatgtaaaaagttctttgccatagacgtgccagtagctggagagctggaattgcaatgctttctttaagtatttctcacctttttttctcagtactagatatggaatttgaggataggaaggggtggaggcagattagccttaggacagtggttgccgaatattttcatcctacagcatgagcagtgctgcatcagccttgtccttcgggctcttctgcagacgcgtggatgcctagatccctcccacgcaccccgagtgccacctgcaatggtccagacacacgcgggtcccacacgctctgctcgctttttgtaccaacacctttcaatcttgccccaaattacttggcctccacaacagctttgggaagtttccatctctgcctttgccattttccttctgtgcagagtagggaaaggcagagggaagagttgctgtcctggcagtaacaggaggcaggccaggtatgaggctgtaagctgggccgcctggaaagatagggatccagaggcctggaggagcagcattccgctgctgcctgggattgaggcggggggaagggagacagccaaggagtgggtgatgtacccagagacacgcctctctggaagagtggggcctggggcaaaaaggcggccttctccggctgcttcgtggagctgatggaggccgcaggatgtagttgagagctcaggtcttgcagtcagtctgtggtttgaatcctagctctactactggctgcaggatcgtgagcaagttttttttttttttttttttttttttgttgttttttaacaactttaatgagatatacctgagctacaataaactgtacatattaaatcatataacttgatgttttatcatatgtatatgcctatgaaaccgtcctcaatcaagataatgaatatattcttcacccccaaaagtttcctcgggagccttgcaatccctgcctccagctcctcttccttcctgtctccagacccaggaaccactgaactactttcagtttctagacattagtgtggatttcctagaattttatgtaaaaggaaacatatcttgcagacggtactctcgtgtgtggcttctttcacttagcataatgattttgagatgtaatcatttcattgcctgtatcaatagttcatatatttatatttctgcataatagtccactgcccagatataccacagttggccgatccattcatctcttgatggacatttctgttgtttccagtttggggatattacaaataaaagtactaaaggttgagcatccctaatctgaaaattcgaaatccgagatgctccaaatctgaaactttgtgagcgccaaatgacatcacaagtagaaaattctacatctgaccgcatgtgacaggtcacaggaaaaactttttgtgtacaaaattatcaaaaatattgtctaagattatcttcaggctgtgtatataaggtatatatgaaacataaatgaatttaatgtttacgttgggtcctatttccaagatatgtcattagatatatgcaaatactccaaaatctctggttccaagcatttcagataagggatattcagcttgtgtgagcatacatgcacaagtctttgtatggttatatggtttggctctgtcctcgcccaaatttcatgttgaattgtaattcccagtgttgggggagggacctggtgggaggtgattacatcatgaggatggatgtcccccatgctgttctcatcatagtgagttatgagatccggtggtttaagagtgtgtggtactctcccccctgctcactcgctctctctcctgctctgccatgggaagatgtgtcttccttcactgtgagtcaatgaaacctattttcctcataaattacccagtctcaggtagttatttatagcagtatgaaaacagtctaatatatatatggacatatattttctttcctttggggtaaaaacctatactagaactggaatcttatcaatgtctgggaatatttgaaaaaaaaaaaaagaaaaactggaatggctgtaccatatagtagatgtttaactttttaagaaatttctcagctgtttcccaaagtgcttgtactattttatatggggagttcccgttcctccatacccccaccagcatttggtgtggtcagtcttttaagttttgcctgtttacatagtaggtttgtaatagtgtcttgtggttttagtttgcacttcgctaatgaccaatgatgccaagcatccttctacacgcccattcggcatccatacctcttctttggtgaaatgtcccttcaaatcttctgtccttttaaaaattgttttgaaagtttttaatatattctggatgcaaatcctttataagatatagtatttgcaaatattttctctcagtctgtggcttctctcttcattctcaacagcatcttttgaaaaacaaatacttgtttttttatgaagtccaatttatatgttcttttatgaatcatgtttttgctgtcacatctaagaaatctttgcctaacccaaggccaaaaaggtttcttcttatgcctcctctagaagttttgtaattttaggcttcaaatttaggtctttgatcaatttttagttaatttttgtatattttgcaatgtatggactcaagtagtttttttcaggttgagggaggttaggtgtttttttgtgtgtgtgtatgaatatagtatccaaaatttccagtatcatttgttgtaaaaagctattatttctctactaaattacctttgtcaaggattagttggccatatttatgtgcaactatttctagactctgttctgttccattgatctatttgtctatctttacaccaataccacactgttttgattatggtggatgtataataggtcttgaaattaggtaatgttaaccttccaactttgttcttattttttaaagttgttttggctattcagtgtatttggcatttccatacaaattttagagtcgctttctaaatggattacgtagaaaaaatttctatcaaagaagtctaccaggattctgattgggattgcattgaagctatagcaacttggagatgattgacctcttcacagtattgagtgttctgacccaggagcacagtatctctctctagtttaggtttttattagttcccttcagtaattttttaaagtaggaaaaagctattatttaaacatgtatttcttttatattgatatataattacacatatttatgggtgatattttgatgcacgcatacaatgtgtgatgatcaatcagggaatttaggagattcatcacctcagttatcacttatttgtgttgggaacatttcattattttcttctagctatttgaaaatatacaataaattattgttaactatagcctcctactgtgctatcaaacactacggcttcctccttttatttaactgtgtatttgtaactgttaacccacctgttttatccccctcccccggcaccccacatcccgccccttcccacacacacacattcttcccagcctctggtatctaccattctcctctctacctgcatgagatcaactttttaagctcccacatatgagtgagaacatgcaatatttgtctttctgtgcctggcttatttgacttaacataatgacatccagttccatccattttgctacaaatgacaggatttgagtttttgtataactactagtattccattgtgtatatagagcacattttgctacaaatgacaggatttgagtttttgtataactgctagtattccattgtgtatacagagcacattttcttggtcccgttccattcatccatccattgttggacacttaggttgattctgtatcttggctgttgcgaatagagctgtgataaatataggggtacaggtatccctttgatatactgatttctgttcctttggacaaacacccagtagtgggattgctagatcatatggtagttctcgttttagtttttttttgagaagcatctatactgttttctatactggctgtactaatttacattcccaccaacagtgtgtaagagttccctttactatgcatcttcactagatttcatggtgggttttttttttctgtctttctaataatagccattctgactggggtgaaattatatctcattgtggttttgatttgcacatccctgatgattagggacattgaacattttttcacatacctggttgccatgtgtatgacttcttttgagaaatgtctattcagatcctttgcccaatttttaatgggtttgtttgggttttttgctgttttgagttccctggatattaattccttgttgaatgaacagcttgcaaatattttttttccattctgcaggttgtctctttgctctgttgattgtttccttagctgtgcagaacgtttttagtttaacatactccaatctttctaattttggttttcttacttgtgctttcaaagtcttagccataaaatctttgcctggaccaatgtcccaaagcatttcccctatgttttcatctggtagagttattgtttttggtcttaatatttaagcctttaataaattttgagtggatttttatatatggtaagagatagcggtctagtttcacccttctgcttatggatatctagttttcccagcaccatttattaaaggggatgtcctttccccaatgcatgttcttggtgcctttgtcaaaaatgagttggctgtaaatagatagatttatctgtaggttctctattgtgtcccattggtctatgtgtctttttacgtcaataccagcctgttttatgttacagtagcttcctagtagtgtattttgaagtcagctagtgtgatgcctccagcttgtttctttgttttccagtattgctttgtgtgcaaggtttttctctgtgtgtttaaattccatgaagaatgtcatggatatttcgacagagactgcattgagtctgtagattgctttgagtaggatggtcattttaacaatgttaacttgaactcaggattcagaaactcactcaaaaccacacaactacatggaaattgaacaacctgctcctgaatgagtcctgggtaaataacaaaattaagggagaaatcaatgagaacaaaaagacgatgtaccagaagctctgggacaccgctaaagcagtgttagagggaaatttatagcactaaacgcccacatcagagagctggaaagatctcagatcgacaccttaacatcacaattaaaagaactagagaagcaagagcaaacaaatccaaaagctagcagaagacaataaataagatcagagcagaactgaaggagttggagatgcgaaaaacccttcaaaatatcaatgaatccaggagccagttttttgaaaaaaaaaattaaggaaatagaccacttcactagactaataaagaagaaaaggagaagaatcaaacagacacaatagaaaatgataaaggggatatcacccctgatcccacagaaatacaaactaccatcagagaatactataaacacctctgtgcaaataaactagaaaatctagaagaaatggataaattcctggacacatacaccctcccaagactaaaccaggaagaagtcaaatccctgaatagaccaataacgagttctgaaattgaggcagtaattaatagcctaccaaccaaaaaaagtccaggaccagatggattcacagccgcattctaccagaggtacgacgaggagctagtaccattccttctgaaactattccaaacaatagaaaaagagggaatcctccctaactcattttatgaggccagcatcatcctgataccaaaacctggcagagacacaacaagaaaaaggaaacttggccgggcacggtggctcacagtggctcatgcccataaccccagcacttaggggagccaagcaggtggatcacttgaggtcaggagttcgagaccagcctgccaacatggcaaaaccctgtctctactaaaattacaaaaatagatgggcatggtggcgggtgcctgtaatcccagctaatcgggaggctgaggcaggagaatcacttgaacctgggaggcagagattgcagttagccaagatgaagtcagcttcatccctggttcaacatgcaaatcaataaacataatccatcacataaacagaaccaatgacaaaaaccacatgattatctcaatagatgcagaaaaggccttcaataaaattcaacacccttcatgcctcaataaactaggtattgatggaacgtttctcaaaataataagagctatttatgacaaacccatagccaatatcataatgggcaaaagctggaagcattccctttgaaaaccagcacaagacaaggatgccctctctcagcactcctattcaacatagtgttagaagttctggccagggcaatcagacaagaggaagaaataaagcatattcaaataggaagagaggaagtcaacttgtctctgtttgcagttgacctgattctatatttagaaaactatatcattggagcccaaaaacttcttgaactgataagcaacttcagcaaattctcaggatacaaaatcaatgcaaaaatcacaagcattcctatacaccaacaacagacaaacagagagccaaatcatgaatgaactcccattcaccatcgctacaaagagaataaaatacccaggaataccttacaaggaatgcgaaggaccccttcaaggagaactacaaacaactgctcaaggaaataagagaggacacaaacaaatggaaaaacatctcatcctcatggataggaagaatcaatatcgtgaaaatggccatactgccaaaataatttatagatccagtgctattcccatcaaactacactgacagtcttcacagaattagaaaaagctactttaaatttcatatgaaaccaaaaaagagcccatatagcaaagacaatcctaatcaaaaagaacaaagctgggaggcatcacgctacctgacttcaaactatactacaaggctacagtaaccaaaacaacatggtactggtaccaaaacagacatatagaccaatggaacagaacagagacctcagaaataacactacacatctacaacaatctgatcttcgacaaacctgacaaaaacaagcaatggagaaagaactccctatttaataaatggtactgggaaaagctagccgtatgcagaaaactaaaactggaccccttccttacaccttataaaaaaattaactcaagatggattaaagacttaaatgtaaaacccaaaaccataaaaaccctagaagaaaacctaggcactaccagccaggacataggcagaggcaaagacttcatgaagaaaacaccaaaagcaattgccaacaaaagccacaattgacaaatgggatctaattaagttaaagagctcctgcacagcaaaagaaactagcatcagagtgaacagacaacctacaaaacgggagaaagtttttgcaatctatccatctgacaagggtctaatatccagaatctacaaggaacctaaatttacaagaaaaacaaacatcaaaaagtgggcaaaggatatggagagacacttctcaaaagaagacatttatgtggccaacaaacatgaaagaaagctcaacatcactgatcattagagaaatgcaaatcaaaatgacaatgtgataccatctcatgccagtcagaatggtgattattaaaaagtcaagaaacaatagatggtggcaaggctgtggagaaatagaaacgctttcacattgttggtgggaatgtaaattagttcaacttctgtggaagacagtgtggtgattcttcaaggatctagaaccagaaataccatttgacccagcaatcccattactgggtatatacccaaaggaatataaatcattctactacaaagacacatgcacacatatatttattgcagcactatttacaatagcagagacatggaaccaacccaaatgtccatcaatgatagactgcatgaagaaaatgtaatacatatgcaccatggaatactatgcagccataaaaaagaatgagatcatgtcctttgcagggacatggatgaagctggaagccgtcatcctcagcaaactaacacaggaacagaaaaccaaacaccacacgttgtcactcataagcgggagttgaacaatgagaacacatggacacaaggaggggaacaacacacaccagggcctgtcagggggttgagggaaaggggagtgagagcattaggacaaatacctaatgcatgtggggcttaaaacctagatgacagtttgatgggtacagcaagccaccatagtacatggataactatataacaaaactgcaggttctgcacatgtatcccagaacttgaagtaaataaataaataaataaataatattaactcttctgatccatgagcatgggatgtcttttcatttttttctatgttcttcaatttttttatcagtattttgaagtttttgttatagaggtatttcacctccttacatttattcctaggtattttttagtagctacagtagatggggtagctttcttggtttctttttcaactatttgttgctggtgtgtagaaacactactgatttttgtatccagccacattaccaaatttatcagttctcagagtttttggtggaatctttaggttgttctaattattatatgccatctgcagagaggaacaatttgactttcgcttttccagtttggatgccttttatttctttctcttgcctaattgctctagctaggacttccagtactatgttgaataacagtggtggaagtgggcatccttgtcttgttccagttcttagaaaaaaaaggcttttagcttttccccacttattatgatgttagctgtgggtttgtcatatatgacctttgctatgctgaggcatgttttttctatgcctaacttattgagagtttttatcatgaaggatgttagattttatcaaatatttttcctgtgtctattgagatgatcttgttgttttagtctctcatatgttgatgtgatgtgcacgtttattgatttgcatacatcgaaccatcattgcatccctaggataaatcccacttgattatggtgtattatgttattggtgtgttgttagatttggttcgctagtattttttagatgatttttgcatctatgttcatcagggatattggtatctcattttggtattaggataatggtggcctggttgcgtgaattaggaagacttcccgcctcttcaatttttggaatagtttgagaagaattggttttactttactccttaattctactgaacttttaaagtcctgggcttttctttgttggggaactttttattactgattaattcttgttactcattatttgttcagatttttttattcttcctgatttaatcttgtaaggctgtatgtgtccaagagtttatccatttcacctgagctttccaatttgttcgtgtgtagttcttcataagactctaatcatttgtatttctgtggtatttttttcatttctcattttttaaaatttggatcttttttcttggttagtctaacagtttaatcaattttggttcctttcaaaaatcaagcttttattttcttgatcctttgtaatttttgtgtgtgtgtgtgtttatttcgtctctgatctttattctttcttctgatttttggctcagtttgctttggcttttttagttccttgagatgcatcattcggttgtctatttgaaatctttctccttttttgaggaaaacatttattactctaaacccctcttactactgcttttgttgtatcccgtaggtttaggaatggtgtttttccattttcatttgttttaagaaaaaagattttatttcattcatttaggagcatgttttcatgtaggagcatggttttaaattttcatttatttgtacagtttctaaagttcttgttattgatttcgttttactgaattgtgatctaagatgcttgatatgatttcaacttttaaaaatgtgttgagagttattttgtggtctaacacatggtctatcatggagaatattccatgtactgataataaggttgtgtattttgcagcacttgaatgaaatgctctctaaatatctgttcgatccatttggtctgtagtgcggattaagttcaatgtttctttattgattttctgtctagttgatctgtccagtgctaaagcggagtggtggaccaggaccaggcacattggctcacacctgtaatcccagcactttggaaggccaaggcgggccaatcacttgagctcaggagtttgagaccagcctgggcaacatggtgaaactctgtctctagaaaaaatacaaaaactagctgggtgtggtggcatgcacctgtagtgccagctactccggaggccaaggtggaaggatcgtttgagcctgggagattgaggctgcagtgagccaagatcacaccactgctctccagcctgggtgacagagtgagaccccataccaaaaaataataaataataaaatggagtggtggaggcctcaactattactgcattggggtcaagctctttagctctaatgataattgttttatataatatatctgggtactccagtgttgactgcatatatatttacaattgttatagtctcctgctgaattgttccctttatcattatattaatataatgaccttatttgtcactttttatgttttttggctaacattgtattttgtcttatgtaagtatagctactctggcacacttttggtttctattttcatggaataattttttccatcccttcattttcattctatgtgcatctttacaaatgaaatgcatttgttggagacagcatacagttgggtcttttttttttttttaaataaatccattcatcttgtctatattttttacttaaggaatttaaactgtttacattcaaggatgtcattgataggtaaggacttacttctgtgattttgtaaactgttttatgatggttttgtatattttttgttcctttcttcctcttgtattgcttaccttgatgatttggtagtttattgtagtgatgtttgactcctttctctttctcattcgtgtatctgctctcccagtgagtttttcagtcttgcgtattctcacggtggtagttattgtccttttgcttccagatgtagaactccctcaagcatttctcacagggcctgtctagtggtggtgaattccctccattttttcttgtttgggaaagactttacttttcattcattttttaaggatagctttcagcaatatttcatctttttttaaggatagctttcagcaatattttatggtttttatgtacacattttaatcatatctctaaatcatgtgtttgatgttgttgtaaatggtatttttaattttttttgagttggggtgacagagtgacacccaggctggattgtagaggcacagtcatagctcactgcagcctcaaatttgtagtgttcctgccacctcagcctcctgagtagctaggattataggcacatgacatcatacccagctaatttctttttgtatcatttttctgtagagatggggtctcactatgttgaccaggctggtcttgaactcctggccttaagtgatccttctgccttggcctcccaaaatgctgggattaccggtgcgaggcaccacacccagccttatgttttaatttctaattgtttgttactatgataaagaaatgcattgatttttgtccattgacctcatatcctgcaaccttcctaaactcacctattagttctagtaccttttttgtggattgcatccattagatttttctataggtgactatatcaccaatgaagatcatttgactttctttccaatctggatatcgttcatttattgtacttgccttattgtactggccaggacttccagtataatgttaaatggaaacggtgagagtggacatgcttgtcttgctcccaatcttagagggaaggcatttagtcttttaccattaagtatgatgttagctttagtttttagtagataccttttattaaattgaggatattgccttctacttatatattgctgaggattttttatcaggaatgactgaattttggtaaatgctttttctgcatctactgaaacaatcatatagttttcctttcagtttgttaatatggtaaattatattgattaggttttttttgttaatcaaccttgcattcctgaaataaacctcacttgctcatggtataaaaccctttgtatttgttgctagatacaatatttttttgagttggggtctcactctgtcacccaggctggagtgtagtggcatgatcacagctcactgcaattttaaactcctgtgctccagcaatccttccttccatctcagcctcccaactagctaggattacagtgtgcaccactgtgcccagctaattttttatactttttttgtagtgatgaggtcttgctatgttgccctggctggtcttgaacttcgggcctgaagcacctcagcctcccataatactgagattgtaggagtaagccaccatgcctagccctagatacaattttctaatatggctctttaatattttatttagaatttttttggcaatgttcatgagggatattgttctgcaggtttttgtgtttttttttttttttcaaacaacatacttgtttgcttttggtatcagattagtatagtatagcttgggaagtatttcttcctattttcaggaagactttgagtagaactgttattatttcttccttaaatggtgggtagaattcaccagtgcctccatctggtcctagagttttacctgtggaaaggttgtgaactacagattctatttctttaatgaatctagggccatttttattatctattacctcttgaaagagctttggaatttttcatctttcaagacatttttccattcttacacattgtttaatttactggcataatgtttctttattatctttttgatatctgtaggaactttagatgaggccatctcattcctgatattgatcatttgtgtctttctttttcccagatcatttgtgctagggatttacaaattttgttgatcttctcaaagaaccaacttttgattcatcgacttttctccattgtttttggttttctgtttcgttgatttctgctattttttttcctttctgctatttttttttcctttctgctattattttgtctataatttgctcatctttttctaatttcttaaggtgtaagctgagatcattgatttgaagccatggttgctttctgatataggcatttaatgctatacgtttgttttaagtacatcttcagggttattcacaaatttggatgggttgcattttcatttctattcacttaaaaagactttaaaattttcattttgaatttttccttgaccataggctgtttggggccaagttgtggagtttcagaatatttggaggtttttcagatattgttctacattgacttctaatttaattccattgtatcaggcaacatgctttgagtgacatgaatccttaacatttatttagacttgttctgtggaccagaatactgtgtatcttggtaaatgctttgtgtgcacttcaaaagaatgtgtattctgctattgttgggttgaatgttctgtgtcaagtagatatttgatagtattgttcaaatttatatccttatggttttctgtctacttgtcatatcagttttgagatgggggtatttgaaattgccaactataattaaagacttgtctgtttcttcatgcagttctaccagattgttcttcatggattagaacatgagccacataaatttttttattatgacctcttgatgaattatctcatttctcattatagaacgtttttttttttgactctaacaacatttttcatcttcagtcttttttggcatttttaaattgtgtgtcatagttgtacatatttttggagtacacatgatattttgatgcatgtatacaatgtgtagtgatcaaattaggaaaattgggatattcatcacctcaaacatttatctttgctttgtgttgggaatgtttattattaactatagttcttctactgtactattgaatactaaaactcattccttttatctaactgtatgtttgtacctgctaaccaatttctctttatcctaccctctgcccttcccttcccagcctctggtagccactcttctactctctatctccatgagatccactgttgtagctcccacatatgagtgacaacatgggatatttgtctttccatacctgacttatttcatttaacataatgacttccagcttcatccatgttgcttaaaatgacaggatttcattatttttatggctgaataatattccattgtgtgtgtgtgtgtgtgtgtgtatctatctcacattttctttattaatttacccattgatggacacttagactgattctatattttggctattgtgaatagtgctacaataaacatggtagtgcagatacctctttgatatactgatttcttttactttggatatatactcagcagtgggattgctggatcatacagtagttctacttttaagttttttgagaaacctccagaatgttttccatgatggctgtactaatttacattcccaccaagtgtatgagcattcaccatttcctgcatcctctccagcatttgttttttgtctttttgataatagccattgtaactgaggtgagatgatagctcgttatggttttgatttgcactttcctgatgattagtgatgttgaacatcttttcacatacctcttggccacttgtgtgtcttcttctgataaatgtctattcaggtcttttgctcattttaaattggattatctggggggttttggcccattgagttgtttgaattcctcatatattctggttattaatcccttgtcaaataatttgcaaatattttctcccattccatatgtaggttatcttttcactttgttgtttcctgttctgtgtagaagctttttagcttgatgtaatcccacttgtctatttttgcttttattgcctatgtttttgaggtcttaccccaaaaatattcgccaatgtcctgtagtatctccccagtgttttctcccagcagtttcatagtttcaggtttaaatttaagtccattttgagttgattttcataatgtgataaaaaatgaagctctagtttcattcttctgcatatgaatatccagttttcccagcaccatttattaaagagattgtcttttccccaatgtatgttattggtgcctttgtcaaaaatgagttggctgtaagtgcatagatttatttctgggttttctattgtattccattggtcttctatgtgtctgtttttatgccagtggtatactctttgcttactatagcttgtagtataatttgaaatcagatagtatgatgtttccagcctggttatttttggtcagtattgatttatctactacgggttttttgtgattctataagaattttaagatttcttttttctatttctgtgaagaatgtcatgagtattttgatagggattgcagtgaatctgtagattgctttgggtagtatagacattttaataatattaattcttctttgagcatgggatatttttccatttatgtgctcttcaatatctttcattggtgttttataatttttcttgtagagatctttcacttctttggttgaatttttactaggtatgtttttgtagctgttgtgattgctttcttgatttcctttcagattgatcacagatagcatatagaaatgttacacattttgcgtgtttattttatatcctgcaactttattaaactcatttatcagttctaaaagttttttggtggaatctttagatttttctaaatataagatcatgtcatctacaaacaagaataatttgacttcttcctttctaatttggatgccctttatttctttctcttgccctattgtgctggctaggaattctagtactatactgaataattacagtttatagttcaccactgagcatccttttcttattccagatcttagtgaaaggttttctattttaacctattcagtatgacataagctgtgagtgtgtaatatatgacacttatcttgttgaggtatgttccttctataaatttgttgaggattttcatcacgaagggatattgaattttactgactacctttccagcatctattgaagtaattcatatattttccttgattctgttgatgtgtgatgtattaaacttatttgacttacatatgttgaactatccttgcatcactgggatgaatcctacttgattatggtgaatggtctttttaatatattgctgtcttctgtttattggtattttgttgaggatttttccctctttttatcagaaatattgtcctgtagttttcttttgttatctttggctttggaaataaggtcagggtggccttgtagaatgagtttggaagtatttcctcctcttcaattgttaaaaatagtttgagtagaattggtattagttattctttaaatgtttggtagatttcagcagtaaatccatcagttccctggcttctctttgatgggagactttttattactgttccaatctattacttgttattggcctattcaggtttttatttcttcacagttgagttttggtaggttatatgtttccaggaatttttccattttttcctagattttccaatttattggcatatagttattcataatggtcgctaatgatcctttgtgtatctgtagtatcagttgtaatgtcatctttttcatctctgattttatttagttgggtcttctgttttttcttagtctaactgaaggttttaaaattttgttgcttttcaaaaaaacaaactttttattttgttggggttttttgtattgttattttagtctcaatttcatttatttctgctccatctttactcatttttttcctactaattttaggtttggtttgtttttccttttctagttcattgaggtgcaacattaggttgtttatatttggagtctatatttttaatgtaggtatttattgctatagaactttccattagtgctactttttctgtatcccgtgggttctggcatattgtatttccattttcatttgtttcaagaactttttaaacttcattcttaatttcttcattgacccattgatcatccaggagcatgttattcaatttccatatatttgaatagtttccaacatttcttgttatttatagttttattctgttgtggttagaaaagatacttgatatgattttgactttttaaaacttgttgagacatgttttgtggcctatcatatggtctgtcctggagaatgttccatgtactgatgagaagaatgtgtattttgtagcagttggatcaaatgttctgtgaatatctgttaggtccctttggtctagagtatagtttaattctgaggtttctttgttgatttttctgcctgaatgatccacctattgccaaaagtgaggtgttgaagtcccttactgttattgtattgtagtctacctctcctgtttagatctactaatatttgctctctctctctctctctctctatatatatatatatataccctgctatttggttatatatattcataattgttatatcctctttcagaattgactccttgctgaattattatataacaatttcctttgtttctttatatagtttttcacttaaagtctattttatctgatcgaagtatagctagtcttgatcatttttggtttccatttgtatggaatgcttttggtttccatttgcatggaatgcttttcccatcccttcactgttagtctatgtgtgtctctataggtgaagttagtttattgtaggcaacatatacttgggtcttacttattaatccattcagccactccatgtcttttatttggagaatttagtccatatacattccatgttattattgataggtaaggccttcctactgccattttattacttattttctagttgttatatagtgtacctccttacttcctttcttatttttgtggttaagtgattttctttgatagcatgttttaatttgctgcttttattttttgtttatcaattatagatttttgctttaggttaccatgaagcttacaaaaacatcctgtaattataacaagttatttaaaagtgataccaatttaacttttcattgtagcagaagaaaagaaacaaaaagaaaaaaacacatgcattttaattcccttctgttcctacattttaaatttttgatgtcacaagatcaaaatttgcctacctcaaaaattttatagttgttatttttaatagttttgtcttttaatcttcttaataaaattttaaatggtttagatgccatgattacaatataacaatcacattagcattatttttcctatgcttttaagaacttctttagcatttatcataggctaggtctggtagtgatacgttttctctggaaaactcatctctccttcatttctgaggaataactgcttggtgcagtatccttggggaacattttttttttccttcagcactttgaataatatcatctcactccctcctgacctgtaaaatttctgctgagaagtctgctgccaggtgtatttgatgtccgttgtatgttatttgcttttttcttgctctctcactgtttttaggaccctctttgcctttgacctttgtgagtttaattataatatgtcttggggtcttctcacttgggttgaatctgatcggtgacttttgacctttgtgtacctgaatatttatatttttctccaggtttggaaagttctgtgttatttctttgaataagcttgcaacttcttgtctttctcagttctctctttaattccactaacccaaatatttgctcttttgatgttggtccataggtcccataagctttgttcattccttcttattcttttttttctcttctgactgtctattttcaaatagtcttgtctttgagctcactgatcctttcttctttttgatcaattcctctgatacgctctattgcatttttcatttcatttattgaattttttacctccaggatttctgtttaattttattttttaaatcttttctgtgaactttctctgagagatttctgtgagctttcttgaagttcactgagcttccttaaaactgctattttgaattatttgtctgagagatcacatattttcatcactttagggccagtcttggtgccttactttgtccctttgacatcatatttccctgaatgttcttgacgcttgaagtatgatgatatctacacattgagagattaaatattttagtcttcctagtctggctttgtttgtgcctgtacttcttcagagggtcttccagagattctaagccaactgactattgtgttccctgtgatcaccacagtaatctcagcattagaggatactctattccctggcttgctgtgagtctcacaatggctttctggcccaaacggacctggggaagacccaatgacggtacttgtgttatgtgggaacactggccaccagggacctgagtcctgaagactgtcctagtttcccagacaagtctacttcccagcaggtctctgcacaggtaggttgtgtccccaactatagcaagaggggcagaagttgagactggaccccttcagaatctgctgtgggaaggaggctgatgggcctttctcattggctgagacaggcatgtgttactcagcaagtctctgcacaagtggagtagtttcttgcccataacaggaggagctaaagccaagactgggcctcctcagggtctgctataagatggagggtggccgggtgcctgtagtcctagctactcgggaggctgaggcaggagaatggcatgaacccaggaggcagagttttcagtgagccgtgattgcaacactgcactccagcctgggggacagagcgagactccgtctcagaaaaaaaaaaaaaaaaaaaaaaaaaaatggaggctggcatacctgccacattggctcaaatgggcatgcatcttctagtaagtccctgcatagacaggatagttccccaactatcagcaggaggagctggagcagaatctgggccctcataagatctgctgtgagacagatactgaaggggtcagtctcagctcagaggggtgtgtgtcacccagcaagttcctgtagagatagaatagttatctgattacagagagagggtctggagctgtgactgggccctcttgggatctgctgtggaatagaagctggagagcccagtcttgtatcagaaggcatgtctttcccaggaggacactgcatcaataggatagttccacgactgcagcaggaggtgctgtacatgcctctctgcgggtcttagcacaaatgggataggtctttgactgtcttcagtctcttttgtctaatattggtagatccactccagctcttatggttactgtttgccttatccacacttacacgtttaaatgattgtttatttctatttgaagtgtatttctcaagcatatagtagagcctcacttttttatccaatctgacgatttttgccttttaataagggtattttagactatttcaatttcatatgattattgatatggtttggttcaaaatattattttctgttttctatttgtcccatctgatctttgttctctctctctcttttttgctttcttttggatttatgaaacatttaaatggttccaatttccatcttctgtgggtttattagctattacttttattgtttaattattgctttagtgtttgtaatatatatgtttaagttaccacagtctaatttaaagtgatattataccacttatataaggaataaaaaccttacaatagtatacttccatttctcccgtctgacttttgtgttattgctatcaaacattttaattttacatatgtcatcattcacacgttacattatgatttttgttttaataataatcttttaaagagatttaaagtaataaaaattacatatttacccatgtggttatcatttccaaagctcttcattcctttgtctatattccttgtgtttttgcttatggtgaattcttttaggatttttaagtcaaaaaatatctttatttcccttttgttttggaatgatacttttgctgggtgtatatttctaacttgacagtttttagtactttaaaaacattgctccactgtcttctcacctgtatttccaatgagaaatctgccgtcatccttatctttgttcctttatatgtaacgtgcttttttctctctggctcttttcaagatttttctttatatcactggttttgggcggtttggttatgatgtgccttgatatagtttcttcctttgtgcttggggctcacttagcttcttggatacatgggtttatgactttcattaaatgtggggaagttttagccattatttttctcaaatattttatttgtaccacactctgtcttctcctttagggactccaattacacatagcaggcacttgaagttgtcctacagctcttttttttctgtgttttatttgttgttttttttccctatatattttattctgaatagttttattgctagatcttcaaatttgctgatttttcattctgcaatatctaatctgccattcatctcatctactatattttttttatctcacacattgtagtttttatctctagaggttcagttttgtgtctttttaaatatatattccatgtttctacttaactttttgaacatctgaaatacagttgaaataactgttttaataaatagctgcttctgtcaattctaacatctatgctagttctaggttggtttcagttatctcttcattatgggtttcattttcccgagtctttactttgtaaatattcttaagctttgttttagaatgcagttgcattacttggaaacagtttgatcatttttttgttttgcttttaatatgtgttaggtgggatcaggtcagtgttcagtctgtggctaagtatgggaaagacttctgggtattcaacccaatgccctgtgaattgtgaagttttccaggctggctgttaggaagtggcactattcctggctttgtgtgagtgctgtgcaccattatctccaatctttttaggtagttaatttctgagccttgaatagttttctcacatgaatgttgtgttagtcccttttgcattgctgtaaaagacacctgaggctgggtgatttataaagaggcttattctgctcacagttctgcaagctatacaagaagcatggcacccagcatctgcttctggtgaggactcaggaagcttacgatgatggtggaaggtgaaaggagagtaggcgtgtcacatggcaagagagagcaggagagagaagggggaaggtgccagcatcttttaaacaactagcttttgcatgaagttaaagagcaagaactcactcattaccatgggaagggcactaagctgttcatgagggatccacccccaagacccaaacacctcccaccaggccccatctccaacactgaagatcacacttcaacacgacgcctgtgattctcagtgttggaacctgctgggaggtgtttgggtcatgggggtggacgacacatctccaacattgaggatcacatttcaacatgagatttggaggacacaaacatccaaactacatcaggtgtgctgatcagtactcagctgaacacttgagggaccttctgcaaatctctagagctctctcctctgcagtactctgtcttgtaaattgttgccaccttggtctccctgtacttcagcagcagaggtattcatgggcaagttgcttaagttttctgaacagttattttctcatcaatacagaaaggataatagtatttagcttatgattctactgtgggaactgaacgaaactgatgtttgtacagcacctggcacttggcagatactcagcaaatatttgggtcttccctgtctctgcacctggtcgttacttcttcctgatttttgtcttgggtttgcaacctgattcctggctgagctttaggttggtttctgtataacgatcaaccaaagcaggtaatcactcatgagccattcaggttttaacttgatgagtttcagaattctgctattcaaatggcatttaggtagaaacgtatcctcctgtaatttgacatttattttctccaaaatctcattcagttcaacctgcaagaattatttgaattcacttatttgtagtgtgaatgtcagtaggctttagaaggtcagtggtgcgtggtggaaagaatttaagaggaccaatgctatttgcaaccccagcgtgatttttctggggtttcctagtaggtcatgaacgtcaaccttttacttccccttctcattttgcctcagatttcccaaggagctacatgaagaacagatgagtgtttgtcagaacttaaccatttctcttttatcttctcccctgtggtagtgtctggaggtcgcagccgcctgcatctcattgatctcggcagctgtgtgaaagctcttagcaaaaatcgagaaggaggctcagggctgtgtctctcgctgtctgctctgggcaatgtcatcctggctctcgtcaatggcagcaaacacattccatacaagtaagtgactcttctactcaaagaatgtggtggggtaagcatggtgtgggacgctttgttcagtgccatctgtggagaggtgtgccacagagggacagcctggaccccattataagttcagtgccagagaccagccttagctaacagttgtgtaatgcatgatctcccaaattcaaaacttttggaaatacttaaatctattccagttctaactttaggctgctcaaattagaggaaataggaaattatctcagttgaggtctccactcgcaaatgaaggtggtgggtcattgtcaccataataaagatgtgcctgtttcatagtgatgagagtgaggggtggaagactggcttatccttaggggtagggccaccagacttaaccaaaaaaatataggatatccaggcaaattcaaatttcagataaccaacaaataaggttgtattataagtatgcaccccaacattgcatgggacgctcctggtgacatgtattttatctggcaacccaatctcgggagttcagaaagctaggggagttagcacctgccttcccatgcaaatgtttagtcacttccaggatccttcctgtctctttactactgctccaattaaattacagccgctcctatgtctggcagagacaaagccactccaccaccatcaccccaactaagcgttctcattggaccgtgtggtggcaggccattgactggctgtccaggcttctgccaaggcctagctgagcctcttactagctgcatgaaccttcattcttcctaaaatgagggttaaagctatacatgttacatcacagaaatataaggctcaaaatgataaaacatgtataaaagtttattgtaggctgggtgcggtggctcatgcctgtaatcctggcactttgggaggccgaggcgggtggatcacaaggtcaggagattgagaccatcctggctaacacggtgaaaccccatctctactaaaaatacaaaaaattagctgggcgtggtggtgggcacctgtagtcccagctactcaggaggctgaggcaggagaatggcatgaaaccaggaggcggagcttgcagtgagccaagatcacgccactgcactccagcctgggcaacagagcgagactccttctcaaaaaaaaaaaaaaaaaaagaaaaaaaagaaaatttattgtagaatttaggacactatggccaataaccaatgatgaaagtctggttacacctatctagtcaagcctatcctcacctatttaaagggaaaaaacaccgaccttacagagttgccatgaggtgaagattaactaaatatatgtggattcatggttttatctgtaaaaaccctacaaaacctacgttgctgttgtgtaggaggaaaaagtcgggcagtgtattctataattactgagattcacaatgagtgctggagtttttcttcccctcagccctatgttgatgccagacccccccaccaaatacattgtgagtttatttcctaccaggagaaccattactggactgactttaggagcttaaatggtgattataatcctgtccatctcatttctagaaatttggaatcctagttggataaacccagaaatggttttcccggctcttgtaacaacccttttctatgggagaatattctgagttgaagaattatagagtttcattcgatgtcatttctgtagttgagtaaattcagcttgtggggagaaagggcaggggagggaaaccgttggagttggagatgaagggaagagtactagcactcactggtttccataaaatgagaatcatgtctgttaatgtcagaacttcatagatcatgatatagataaaattccaaattgcaccttagcaggaggtcattgattacatatcttacttatagcttttacactgtttctgcagggcgacatgcttttatgatttctataaatagttgttgaattgatggcgggaagatagatgcatgtaaacatgaaattatttttaatttaaagtaacttccttttagttagagttgggttttttataaatgagtagggaaacattaaaaattgtttttatggcccagcgtggtggctcacacctatattcctggcactttgggaggctgaggcgggaggattgcttgagaccagcctgggcagcatggcaaaaacctgtctctacaaaaaatacaaaaattaaccgggcatggtgttgcatggttgtagtcccagctacttgggaggctgaggtggaagggtggcttgagtccaggaggcagaggctgcagtgagttgagattgcgctactgcaccagcctgggcaacagagtgagaccctgtctcaaaaaaaaaaaaataaatgaaagtttgtattaatcgttcaagcttcgtgttaattaagcatatttttaacatgctggccctaccaactggctacctgccctcctgggagacatctccactcaccagtccctgcagacagctgcctgccttcattccaggagtccccttccttctattctggcaccaagagagtgatcattaaagtgtttctgtgtctcaagtaagcagactagcttccatgcagtgtcagcacaagacccaatcctggagctgtcccgtggcctggttgagctgttgatggcgtgggtacagactcaccagctgcccttgccctgccctgcctaacacaactcatcgagaccttgctgggttgcctggtgctggaaacacggtggccctggccatccagccagcgctgtccttcccaaaacatccattggccagtgcgtttgttctgtcacccctcagtgtcctaatgcccttcattgtacgtgatcttaaaaagacccttgccgaaatgttttctccgagtctggaccacggcctagattcaatatttggcatctgcaaatgtacatttacaaagtgattcatcaactagaaactgtcctcttttgaggtacaggaagataaggcaaaggtttactcaaatcacccagccagtgggtggcaggatcaaactgcctcgctcctcacagcttcagaggcctcgacagttcccagcctcactgcagacccacgcccacttctcatcaagctcccgaaatgtcggagctgccttcactgcgcacggcaggggagcccagcacagcaggaaagccccgatttctttgatcaattccgtcagtgctctgaagccacattatgcagcattttgttagcatactaaacaccttcagggtgtcaagccttgtctttgcagtgcgttccttagagaagtggaagtttcctgcccttgaggtttcctcttactcctcctgctcacttacggagggtggcggggggaacaaaaatagaaaaccaaattccatattctctttccttcccccaccccccccaaaaaacacagacaccccactacctcttcatttgtctccccagacaactctgtacttggaacctgcattacttgtgcttgctcctgggaaattcgctgcaatgtgcacagaggggctgtagcctgtcttcattcctcttcatcatcttaccaggctatttgtcatgtgagcaagctggaaagtgagtttggattcattacccatcccaggcattcccacaggcaccctccatgtgcgctgaatgcttctgactttgcaaatgatattgcccttgaagatgcaggaggcgtggagcaggtttccaacctcagccattacacagcacaggcacattacatggcacaggcttgccggccagtccaggcgccataaatcagttctcaacggtggcaccattcagaaaagcatgcagggaaggcagggagaccaccaagggctccaacccctcgtcagttctgcactgacaggctgcacaaattactctctaatttttgagagcctccacctccagggaaccctgccctcattcgatcattttgacagtgcatttgcaaattttctttattcggtacattcatttgctgttccttactgctcttgggcaccaaggtgctaggaatcttcccatttaatggataagaaaaaataggcagaagcgttgaaatgacttctcaggccaaaacccagtgttgcacatcccacaggagttggcccccagaagaaccgccacaaggatctgtcagggtgaactgagcttcggctaacgggtgttatgtcccagctcatctgaaggaccacagcttttcgagactcagattctcaccatgacccaattatctcaaaatagaatttctggttctcttagatgttgctttgtagagggcacaggcccttagaaagcacacacctgtcatgcaggcgtccttcaagccctgaagcatttaccttcattgatgactgctgctccatatggagaaagaattcctttaatgggtcatatgacctgtttgcttatttgccaacacagtgtttctaaacactctgtttctaaacaacagctagttgctaatgtcttggctgccctttaacaagagttcatggaaagtccttctgtggccctctcatgtcatgcctgtctgagatgcttctcccagtcatcttgaaaaatggtgctacataaccatcctgtcgtggaaatgatgcccggcacctccctctcacgggtttggtctatggttcagacccagacctaatccttgtttgttgagatcagtcactgagacactttgggtctcagcagctgtgctgagctcgcctcctcctctctctggtagagcctgaggcaatctgtgatccaagctgcaggccacgagcaaacaccgcaggcaacatccacttccagaaggctgtgttccacaaaagcgatgaggacacccatcctcaggggctataatgggaactcttttcctcctaaggccctagtgaggagtcaggaaccaaggtcatctttaagcttgtagcatcgggacacaccagttcattcaaagcagcaggcagcactagaagctcaagttcaaatcagtgacttgaaaggaaatgacacttcataagtagaggcagctttttcaaaatgcaagcaccttctcatccaagagagggtggggttctggcacctgtgggtcacacttgtggcagcaggcccagcattggcaggaacttcaggacgagcctctgaaggatgtggacattcccctccttgcctggagaagtgcttcctcctagagcccatggagatttgggattagcctctcctttctcagaactggaaacccagtactcaaggtctgggaagctggggaaaggggctcaagattgctgttagctagagcggggttccaaacccccaggccacagattggtacaggtccctggcttgttgggaaccagcctgcacagcaggaggtgagcagtgggggagcatgaccacctgagggctgttggctgtctgatcagtggtggcactggattctcataggaacctcatgctattgtgaactgtgtgtgcgagggatctagcctgtgcgctccttatgagaatctaatgcctgatgatctgaggtggagcagtctcatccccaaaccattccctactcccattgggtccatggagaaattgtcttccacgaaacctgtccctggtgccaaaaaggtaaaagggtttgggactgcggagccatggcattgaattcccatctcacacaggagaggaaaggctcttcctcaggacttggatgtatattacttagacgtaccatgaaattaagtagatatttgccaggaaaaatgcaaaggagtatcagttctccagatttgtttaagatagcatgaaacggagaggttcatgtaagaatctgtgtgtgtgtgtgtgtgtgtgtgtgtgtgtgtgtgtgtgtgtgagagagacatatgcatatttaacctcctttaaatgtacattaatgctgtattttctccccctgatttacagggagaatatcaatttagaactatttgcacaaactctagataccagtttagagcgttccctatttagaaataaaataaccaaagtctcaggttgccaggcaactgcagcaatgataattcttagtattgctgctttagaaatactcatttttatacattttagtgatggttaggatgcagagaatgtgagttcagaatgtcgctgggacatcgaagtcccttttctatgagatttttagcattctcacttgcttttatttttcccccttagctctgtttgcttccttggctagcggtatcttcatatttagctatagaaatctcgagagattgttattattttcttaagagttgaggcagaagctgccactacattaattctgccaggctcattatagaaccacgccagtcactcagggagaaatgacaccgtctggggatcggccggggtcacaaacactgggttcaagctttggttgttctgccgctagtttgacacatgaactctacacctcgtccttttcattcttaagaggaccacattctggcccctctcagagcttcactgaattgggaacagaatatcaggccccagctctgtcatcatctcttggcggcaaagccacggctcatgtttttgtctgtccactgcagcagccgttgtggcgtaatggcacatgatggtctcggggctgggtagaaattggaaggcgtcttcctttcccttttggcctttcaagtgtatcttcctttatgtctaatgtctggggttactattaaagtctttctgaattctgaaccaatgatcagatagatacaagagaatgattgggaatgaaaagcctgctaatcctagcagagtaggaaagggtagacagccccttccccaaccccacggcctcagtggaggagagaatggtgtggcctgcaggggagggacaggcagacagcgccagctgtcacccaggctcacgttcaccagcctcagcagtcagaccttcttccttcctcccttggaggaagtgaatagaagggcagaaccgagagcgggaactctatcttgatcttgctaaaggggtagaagttcctaattcgtggacttgctggaccacagggaggaggagaaaatgatttctagtacttatttcctggcatttcagctacatggaaggtagttagcacggtgcataaatgagcccccggtgagagtatttcccatcgtgagcaccacagccgggcgttgttctcactgtgcctcacaagctctgctaaatgccttatggatatttcattctgacaacctgtgacataggtactgtaatcatactagtatcacagatggggaaactgagacacagaaaggttgagtatcttgtccaagttcacacagctaataggcaacagggcctcactgcctcccagtttatcaccccccaccgagtacagtttctggaatattgtgctcggtcaacatttgttgcaataacaagtggggtacaacagaggatcaaacataccagcaaagcttgcatatgtgtagttgattataagtaaaagcacagtctgggcacagtggttcacacctataatctcagcactttggaaggcctaggcaggaggatcacttgagcccaggagtttgagaccagtctgaacaacataaggagacctcgtctccacaaaaaaaaattaaaacactagctgggcatggtggctcatacctgtagtccaagctacttgggaggctgaggtggaaggatcgcttgaacccaggaggttgaggctgcagtaagctatgatcgtatcactgcactccagcctggacaacagagcaagaccctgcctctaagtgagtgaatgaatgaaggcacagacccgaggggcagggctgatggtagccaattcatacattcaggtcggtctcctggtctcacctgtttctgtgattgctaagccaggctgatggctagatacccatggcaatgaagaatgtaaaatacgaaaggtaaaaaagggaaataaatcttcctttcaggacccaagctacttatcagggctaaacaaaaaataccaagtaagaatgtaatgatgaggggtggggagggggcaaaaaataaaattaaaaagaatgtaacaagcaacgagacgctcctgactttgaacctgtgtgcagggctccgggtagattagaaggcatcctaacctcagtaaatggctgtcagtggggcctgacagtctgggtcccgtgttctgggcaccaccaatggagggtatcctctcagaaagcttcaccctatttcatgagcctttaataaaatatagctataatctttctcgtgaaagagcctgacagttcatggagccacttcccacgccgcactgatgggagaaactgcaggactccaccaggctttctctggctccaggacccccacgaaggcctcctgatttatctggggcagctcctgcataagaagggtgaccgtttcccacagtggagaaccagacactgggcacagcccacttgataagacagcttccatctcccgcccctcctgggtatgcaaaggcattcctgagtgaataggttcaggtcagagcaggagaggttatcacccaggctgtgccttgaagctttgctgagtacaagaaaggtaaggaagagataagcaagaggtgagaatgacggcagggctggcaagtgagatcacgagcttttcctcaaacatctggctaagaatagaagctttgggaaattccacaactggcagattaaggtgatcagcctctcagctggaatttgtgaagtttcttcagactgagctcccagagaagtatgtgtggtggaatcgctgtgctttctaaagagatggattgcaacctgcgccgttgagctagtgctgagctgaggcccggtgagatggattctagcacccctgccacggctaacctcacacactcagacgctctccctgagcttttcatttctccatcagcaaaatctcaatcattcttactcctcgtccacctcagaaacatattgtaggttccatggagacgatgtctgtggtagacaaagagacgtgcttcaaaggcagaaaggtcactgttttatcatctttcagaatcgtgtaacccacgtggttctgccaccatcctgtcttctgtgcattccttgactttgaaagtacgcatcttttcttttgaccaagtagataattaccgtctatcgaaatgaaccctcatgcatttattcaatgagagtttgtgtgcctaacacacagcatggctgcctgatacagatacttggtttaagagaattctacaggctctgcacgaaagtgaagtcatgatgtaaggaggcaaaggactctgccctcaaacagtccaatgggcctgagaatgagcctggggtgggggttcgatgctgctgcacccccagttgtatctgtgtatcccagtgactggggcgtgatttgaatatttaaagatactcctttttcatacggcctttaaatgcaagccgagtacttctgctgcacagccggagaggtggtatgtttttaatgctggagtaaaacttgtctgtgttggacttagtgagagaatggttttcgttcagagattgtcaaggccaactttgatataaatttcactttacattttacaccacacgtgattcataacatttaactctgtcatccatagaactcggtgctgttctgatcagcaaggtagattctggcccaaaagaactggtggaggaatttaaggaactggttctaagcctaattgaggtcaccaaacatacagagaaaataatctgagaaatgtatagcagaaatctaagttttccatttattcatttactcaaaaataccctacaataaataccaggaatataacagatgatctgcattcttgggcaacttacagtgtagcaggaatacagacactgagcaccgagtaactgataatatacgcacatcagcgctgaatcggcactaagggaagaaggggtcgggtggggctgaggaatggcacagagcggtgattctcaagctctctcctcctcgagtcccactcattctctactcacgctcatctgtgtcttccaaagtttgccacagtccgtcctctaaatgcctgagtcattcacacctgttctgtcattccctgctttgatatagagatgatccaacacaaatcatgacaaaccactaagccaaatgcaagactctgaatccacagctgagtgtgatctttaatgacgactaaccatcatatcacaagttgtgtcataaccagaaacaaaacagccagagaaggagggctttaggttggtctggggacagtacggagagcccaagacgcccttgggcacccacagggggctgtgattattcaaggatggcttgatttaggcacaattaggcattggacaggatggagcatacaaatgtgttggggattaattcattaaaaatctgtcttgagctttaatagagcttcagtcagagtgtccaaccataaattctcacctgtttcacaactggttcaggcccaattgagcattaacagatttttttttttgttcatgcaaatgaggttttgtgtgtaattcattcattcatttcatttatttcatgtctaattgaacaatttttgaatagttacatttgtggagtagttaagttgtatcaaattgtctaatgtacctagtaattttgtaactaaaacagagctgaatttcattttgatataacaaaaggagaaccacagaagtagaggtggtttgaggaatagtcggcttttaagagactttatgatactctgttctttagggcaatgaccacagttgctgtttctttttatcctcacttttctttcttttcactccctaccgatgagatcaatgaaaatttggggggcatttctagatttggcagcctcccatttataagcatacatttttttagttttgtgccctgacatgcccatttttctgagggtcaaatgtgtctgtctttaaaacaccgcgttggtgtctttcaaaccacttatcaagggttgtttctcccacgagaccttgtcacccctgagcctgaaatcgcgcgctgagaactaattgcagtagctgcatacacacagtgaacaaagttcactgctcccttcattaagggcacctgccatatccactgtttccttccgagaactcttttggtgaagacgggatttttgttttctttacattccacatagctgccagaaggcccctttaaaatgcaaatctgatgtctctcagtctttaaaaccttcagtggcttcctgttggctacaggatagttgaaacccttttgtggcctatggagctcttccgaatttgggccacacctacctttctgaccatagaaactacatagagatgactgaacaccccaccccacccccacagtcacatgctttgccgatgccgattcttctgcttccagcggctgttcattcactcactcattcattcattcaatcaatagttaccaagaacataccctactccagtactgtactggagctcctcctccatttgtgagattcttcttatgtctttgacatgttttgattgtaagatgtgttgcatatgcagatgtagaaacacacctactcagtctatagaatgacaaaaaatctgtgtgcccaccacccaggttaggaaatagaacattccactagctcaggtgcccttgtgtgatcgtctgccttccgtcaccctcctgcctgttccagcggtgaccacagtgctgaattttctggttttgatccccttgcttgtcttataggttttaccacctaagtatgtgtccccccaaaacatactgtttagttttgtctgctgttgaacgttacgtaaatgaaatcatactctattctatgcccttccgtaccttcttttgatcagtatttcatttttgagatccatcttgatgcgcacagctacaggttcttaatcttcattgctgtacgatttttccattgtagatggatattgcaaaatattcttctgtgggtggatttctaacaagtttttaaaaactgattgttgaagttaatcgaacctatttctgctctaatgagatgctcacttggttcctccattaatcatttaatatggtcaattacattgtgagttttcttttctttttgagacagggtgtcactccgtcacccagactggaacgcagtgacaccaacaaggctcgctgcactcccaggctcaagtgatcctcccacctcagcctcccatgtagctgggactacaggtgtgcaccaccatgcctggctaatagtttatattttttgtagagacggggttttaccatgttgcccaggctggctttgaaatcctgagctcaagcaatcctcctgccttggcctcccaaagtgctgggattacaggtgggagccactgtacccagccaatcagttttccattaataatactaaaaattcttggattccttcctacttattctttgaggcttatctcaaatatcatctcccctctcaagccttctctgatctcctttcccccctcctaattctttgctccaggaaagttgtttccatcttccaactcaatggcattaaaatggtattttaatgtaggcacttatattttaaatatttgtttacatatacctctcctatcatatgagctcatctagataatgatagagggcacatgcagtggctcacacttgtaatcccagcacttcaggaagccaaggcaggaggatcacttgggcccaagttcaagaccagcctgggcaacatagtgagactccatctgtacaaaaaaaaaatttaaaagtatagtagccatgcatagtggcgtgtgcctgtagtcccagctactcggcaggctgaggtgggaggattgcgtgagcctgggaggttgaggctgcagtcagctatgatcatgccactacaccccagcctgggcaacagagcaagaccctgtctcaaaaaaataataatgatggaatcttgttcttcagcttccttacgattttgcactaatctgaatgaaaccagcctgatctaaaccttgcatctttagtgacagatatgagtctgacacccaccttcaactttgtggtagcctgcccagcttcccagaggacacctttgtgcccgcaggcttcctgtggccatcggatccccaatctaaactaggataaagtatatgttttgtggtattgtcacctgtttaggatgagaagaggcactgaagctataaccctattttctgagccagataaaatagcaaacatatatttgctctaccgggttattttgacaaatttatcaagcatcttcaaaatatacagtactagtctaagcattagggctaatgcagagagcttttgcaccagtaggacagaggaaaaaatgtgcacaaattagagtacaaggcataaagcagttaaaagtcacattatcaagtacattcaaggaaagaggtaagcagttccagcaagtaggccgggcgcggtggctcacacctgtaatcccagcactttgagagcccaaggagggcggatcatttgaggtgaggagtttaagaccagactgaccaacatggcaaaacccaatatctactaaaaatacaagaaaaaaaaaaaaaagccaggcgtggtggaacatgcctgtaatctcagctactcaggagcctgaggcaggcgaatcgcttgaaccccgggaggtggaggttgcagtgagccgagatcacgccattgcactccagcctgggcaacagggcgagactccatctcagaaaaaaaaagttccagcaagtcagctgtgaatattttttctatggcaataataataaacacaagatgcaggtatagattcctatttatgactacaactctccacatgtctagaatttggtggaagcaaataggtcttagaatttaccccaaagcttgaattactgaaactgcctgttagtaatagtcatttatcacatggatttggcgctggtgtcgtgaggatctaagtacagggaagttctgggcatgttcatttgccatttattaatttctgttctttgctattttttgggggggcgggtaggggagacaaaggtcttgtcacccaggctagaatgcagtgatgtggtcatagctcactgcagccttgatctcccgggctcaacagcgatcctcccacctcagcatcctgagtagctgggactacaggtgtgcaccaccatgcctggttaatttttaaaaatttttttctagagccagggtctcactgtgttgcccaggctggtcttgaattcctgagctcaagtgatcctcccatcttggcctcccaaagtgctgggattacaggcatgagccaccgcacccagccctactttgccattctttatttctcatcttaaggtggctacttagcttggcagtttccccttcttgttctgtaagcacctacgttgctctctaagtactgctttgtctgtatcctcaagttctggtaatgacaggtattttcactatcattcactcaaaatattttccatttctcattgtaattatcattttttgagacggggtctcattctgtcactgaagctggagtgtagtggtgcgatcttggctcactgcagccttgacctgctgggctcaagcaatccacctgcctcaacctcctgtagctgggactacaggcgtgtgccaccatccctggcttttcttttttcttttttttttttttggagacagagtctcactctgttgtccgggctggagtgcagtggcatgatcttggctcactgcaacctctgtcttctgggttcaagtgattctcctgcctcagccccccgagtagccgggattatttgcgcctgccaccatgcccagctaatttttgtatttttagtagagatggggttttgcatgttgccaggctggtctcaaactcctggcctccagtgatccactccctgcctcagcctcccaaagtgctggaattacaggtgtgagccactgcgcctggcccattttaattattttgtgatccgtgggttatttagaaatgtatttactaatcgccacagttacttggaatttgttccttttgagccttttaagccttgcaaaggcaggtgcagcacagcctagggctgctttgatcccactgttagcgcagtaaccttctgaggacgctgaggaatgatttacatacactcacatatatatgtacacccattatatacaccatatatattatatacaatatacacacatacccaatatgtatatacacccaatgttatatatatatatacacacccccaatatatatatacacccaatgatatatatatacacacacacccaatatatatatacacccaatgttatatatagacacacacactcaatatatatatatacacccaatgttatacatatatacacacacaccaccaatatatatacacccagtgttatatatacacacaccctatatgtatacacccaatgatatatatacacatacacacacacaatatatatacacccaatgatatatatattacacacaccatatatatatatacaccctatgatatacatacacacatacccccatatatatacacccaatgatatacatacacacactcaatatatatatacacccaatgatgtatacatacacacaccccatatatatatatactcaatgacataaataatatgcacacccaatatatatacacccaatgatatatatattacacacaccctatgatatacatacacacatacccccatatatatacacccaatgatatacatacacacactcaatatatatatatacccaatgatatatacatacacacaccccatatatatatacccaatgacataatacacacacccaatatatatatacccaatgatatatataatatacacacactatatagatacacccaatgatatatctatacacacacacacccaatatatatacacccaatgatatatatactcacacacaccctatatatatttacacacctaatgatatatacacacacaccctatatatatatacacccagtgatatatacacacacaccatatatatatacacacacatacacccagtgatatatacatacacatacccgatatatatatatatatatatacaccccatgatacatatatacacacacccaatatatatatatgtacacccaatgatatatatacacacacccccaatatatatacacacccaatgatatatatatacacacaccctatatatatatacacccaatgatatatacacagacacccaatatatatacacacccagtgatatatacacacacacacatccaatacatacatatacccaatgatacatatatatacaatatatatataaacccaatgatacatatacacacacacccaatatgcatatatacccaatgatatatatacacacacacacacacatgcatgccctgggtataaacagatctcctcactctgtctgcttgaacacagacttccaatcccttcttggcttcaaggattattccaactctcctttctgtggccttgcttgtttttttgtacacatgtggattagagctcaaccagagggctccagagagctcttgcttgctctcaggtcacctctgtctttttttttttttctctcttattctctttcccctcttctatctctccaattcttgctttgtatctctctccattcttcccttctgctattttgtcctacaaattttagctgccctgatctccccaaagtctggacttttccttgttcagaaggatgtggctgcctggctctgcttgggtcccctgtcgtgtttgggggcctggaacctctctcctggcagtaagctggggcacttacaaggctcagctcatcttttccccttctctcagacatgactttcctctgctgcttgttacccagtatcagaaacccattttttttttcttatagtttgtttggttttctagttgcttaaggttggagggtaaatccagtttctatttttcaaacatggccagaagcagaaattttgtcatttgtgatcatttttttttgtttatttctttaaacagtttaattgtctctaacatgttaatcaactttttgttgtttatttgtgatctaggtttgaacatctcattcttgcatctgtggtttctgctggctctttctcatggtgccgtgtttctttgtttatttgtgtctgggggctactcattttcactggcattttatttgtgagaattctgcaagctctgggataaagatagtttactccagacagcatttgtgtttacttctaccaggtgccagttgaggatagtctaaactacattctcagcttgaaatatttttgaccacccagatatggagaactaagcgtgcaaacctgcatgtaattcagaccagggttcgcaattctcaggacagtttctttcccctctgctcagtgcttatttcaagacagtcatgtcttgaatacctacaagggacaattattgggggttgattttcctgtgaaaattcacatgtggagcaggcctccagctttgactgctgccacataaaactcagcagggtgttacctggctgggcagatgtctttggggtgaaagaaagcttgcctgttctgcttatttatcttgagttcccaacttcacttgcttttttttggcctgaggattctttacctttttgcaggttcaacaatgcatttactaagacttaaaaataatatccacggccgggcatggtggctcacgcctgtaatcccagcattttaggaggccgaggcaggcagatcacctgaggtcgggagttcaagaccagcctgaccaacatggagaaaccctgtctcgagtaaaaatacaacattagccgggcatggtggcgggcgcctgtaatcccagcaactgaggcaggagaatcgcttgaacccgggaggtggaggttgcagtgagccgagatcacgccattgcactccagccttggcaacaagagtgaaactccatctcaaaaaaaaaaaaaatccacaacatttaactgtacttggtaagaaggttttcctaggaacccagcctatcatattgctcctttgcttttttttttctcctgttacacacctctccttcttttaaataagtaaggagatcatataacttattatcgaagccacttttgagagtgaaaagggacacttaattattattatttcatgttttgaaatattttctgacacagccgtctatattggtgaacctataaaacagttctattcaaaaattactttcaaacatgaaatgctttcttaataaaagaaaatacatcaaagtagaaaaaggttaaaactgctttatattgtttatctggacattaaaaaataagcagaataatcacttaatatacttttgtgtattttaatcattgtcttcactatcttctaataccacttcagtagtatttttcttaacactattttttctattgttaatgtcagggcgtttttctccttcacataatccaactgccttacctatatatttacatatatgtttatgtgcattaacacatcaaaccatctgtttttgataactgtggcttctgtttctcttgatagaatatcacagtttgtttaaaaataagtgtgaatttattcatacaaccaccaattacaagtttatttcagtgaaatacatttctcaattcagtgagaatattgtgtgttaaagtttcaaaggatcttcccacaagtcaatttccagagcatacttgtagaatttcacattttaatcttctatacagtttgagctcttgtcatctatatttcagggtcccctgtttgcaaattttgtttttaatcattgcaattcattacaggcttcagaggctgagctttttgtgtttcattggttgaacacttgattatggattacaacttattttgaaccacaagccatcaaaatttagatgacttgtttccaaaactggagtactttttttgtagagcatttggattgactcatgaagtatgttttaaagttaaaagctgcctaatgtcagcaatttcctatcatttcattatttcaagtgtcaaatatttctcaaatccaacttgacaggcagcaaagagagaaccgcacactctactgatgaaatgtttttaatccaatttaaacttcataaaaaatttttgtagttcagttactctcagtttatgtaaattttacacatttcaaaaactatagcttgtgcttctctgggtagaattagaactgtgtttgagctcagttatgaattacataggtacatcaattacaggtacatttcagcataataagtttctcagcttggaacattatatcttttttttattttttattttttttgagactgagtctttctccatcacccaggactgcaacctccgcttcccgagttcaagtgatcctcctgcctcagcctcccaagtagctgggactacaggcacgcaccaccatgcccagctaatttttgtatttttggtagagctggggtttcaccatgttgcccaggctggtctcaaactcctgacctccagtgatccacccgcggtcagcctcccaaagtcctggcattacaggcatgagccactgctcctggctggaacattatgtccttttttttttttttttttttgagacggagtctctctctgtcgcccaggctggagtgcagtggtgcaatctcagctcactgcacctctgcctcctgggtttaagcaattctcctccctcagcctcccaagtggctgggattacaggcaggtgccaccacacttggctaattttttttgtttttagtatagatggggtttcaccatattggccaggctggtcttgaactcctgacattatgtcttaaagtgctaactctgttcactgcacataacctcatatgttcctagatgagaccactgaaatagaaagtgaaagtctatccaattcttccatctcattttaataagtcttagtaataactacttgtattttgaataaagaaatgaaaaatccaggacaaaataaaccagacaggatgcagggtgataggcatacactgagacttctaggcaagtgagcaactggtcagccgaattaaagcccttggaggggttcctgtaccctaggttcttaatacatgcttgttgaatgaacaatcggaggtagcttatttgtttgaataaggctttctgtgtgttactgcaaaggaatgaggatgggacaggtttaggctttgtaacaagacctcccaaaggctaacacataggcggctgcttcctcggcaagcagagatgacgcttgtggccctttttgaaacaccttttttacatgccagaggtatttaacttgtccgtaccaaatggtacggacaagttaaaagggttatccgcccttttaactcaaatatcccgttgggatcaaacatttttgctctggagacctttgtacctgtgcagcatcagtataaggatagcctgggggtggtaacccagacacagctaacagcggggtctgagtggcttggccagagtcttggcctcaaattgagggcacagcagtggttctgactgttcctcttcggggaacgttgtacatcaggaggggcctgatggtaatgttggtgtaaaatgtctctgctgtgatccacccttgaagactgtgagctgtgcagaacgaagcaggtcatggcttgtcctctaggatgtgatgggaggctgaaagcatctctctgctgtgacgtaggagggaccgtgagccttatgctaggcactccttccagcccaaggcagcatcgtctactttggttttctttctttctttttttgaaacactctgcccaggctggagtgcagtggcacgatctcggctcactgcagccttaagctcctgggctcaagctatcctcctgactcagcctcccaagtagctgggacaacaggcgtgtgccaccatgcccggctacttttttaaatatttttaatagagatggggtttcgccatgtgtcccaggctggtctcaaactcctggattcagacaatctgcctgcctcggcctcccaaagtgctgggattacaggcgtgagccaccgtgcctggcctgctttggttttattctgactgtggctcctaggaagaaaaagaaaagatgatgctttggaagctgtagggttgggaagctggagacttcttgtgatggagaggtacacccagtagatacttatttaaatacttatagaaagacgactttatgccggacactgtgttaggtcctggctatacaggaagaagagaagtggcatctgcccatcctacgcagttctccaggaaggaggtggcaggagtgacatttgggccatccaggcaactcaccaagtcccttcgcagcactcctgaaaagctctgagatgttttgaagctaaaacagacaaacaaaagggaccaaagaggtggcatgagtagcatgagtcagatgtgattaattcctaattccttagctgcttctgtttgtttgttttgttttgtgtttttgagatggagtctcactctgtcacccaggctggagtgcagtgcagtggcgcaatctcagctcactgcaacttccacctcccaggttcaagcgattctcctgcctcagcctcccaggtaactgggattacaggcacacgccaccacgcttggctaatttttgtatttttagtagagacggggtttcaccatgttggtcaggctggtcttaaactcctgacctcaagtgatcagcctgcctcggcctcccaaagtgctgggtttacagatgtgagccaccaagcccggccccctatttccttatcttcttatccgcagcaggactttgagaaacggctcagttagggtcttgcagggataacagtgattagagcctgaacacaaactacatttatcccatgtcagaaatgaatagcttatcaaacgtaccaacttaaaagatgcaagaattgtgcaacaatagctaccttcttttcaaacaaaataaacatcactaaaaaactctaatcttaattctttttcaagaaatggataattcctccacatcattctcctttaaaattttgtagattctcccttaagttacttaatgtatgagttgtggcttctgtgtaacgtcttttctcaggcttgtattggtaatggaaagcattcttcagcttaatttccttttaattccttccaattactatgcactgttctttgtgccaagtgccagtccagttatccagttggtgcattttgtgagaactgtaggatcatggagatcatgtttcttttcttttcttttcttttctttttttgagacagcgtcttgctctgtcaccaggctggagtgcagtggcacaatcttggcttaccgcaacctctgcttcctgggttcaagtgattcttctgcctcagcctcccaagtagctgggattacaggcacgcaccaccatgcctggctaattttttgtagttttagtagagatggggtttcgccatgttggccaggctggtcgcgaactcccgacctcaggtgatccgcctgcctcagatcacccaaagtgctgggattacaggcatgagccactgtgcctggccaggatcatgtttctttaaaccacacatgatacccagaaggcatcataatagagttggcttcatcatcttccttatcctaggttatgcttgatttcaaaagaaatttgttcctcgacaatacacagaaaatgcacttaacaatagcccctgaagttttccccagccaatgactggttagcagtctaataaggatcatattggacaagtatctttaacacaaaacagcacagggaatcatgggccactctcatcgttaggctctcttcacaggtatagcctatgttagaaggcttctgaaccacagatgctaaagaaaaattagttaaactgaagactgatgaagtattccctacaaatgaaaaggcaatcttatatgacaaaggacactatcaggaggttgaaaaacaacctatagaatgggagaaaatatttgtaaatcatatgtctatgattaatatccagaatatataaagaactcctgtaagtcaacaaccatcaccacacccagttcacaaatgggcagaggaatcttatggacatttctccagcggagatatatgcacagccaaggagcacgtgaaaagatactcagcatcattagttgctagagaaatgcaaagcaaaccccaagaaggtaccacttcctagccagcaggatgtagctattaaaacaacaacagaaaatcagtgttggcaagggtgtggaggaattgcagtccgtgtgcgttgctggtgggaatgtaaaatggcatagtcattgtggaaaggagtgtggcagttcctccaagagtcgcatatagaattgtcacatggtccagcaattccattcctaggttacccaaaagaatggaaagcaggggagctggaggccattatgctaagtgaagtaactcaggaagggaaagccacattcctatgttctcaggtataagtgggagctaagctgagggtccacaaaggcagagtggaggaatggacattggagactccgaaggggaaaggagatggaggattaaaacgctacattttgggtacaacatatactacttcggtgacaggtgcaccacaatctcagacctcaccactatacagttcatccacgtaaccaaaaaccacttggacccctaaagctattaaataaaataaataaatataaacattcagtaacattatctttagaagaacactttttaataaacctgggcatgaagaaaaaaggctgaataatattccatcgtatgcgtgtgtatatccatatatatatatatatatatatatatatatatatatgcacacacacacacaatgtatatgtctagtgttaccaacttagtttcctttccttcaatattaaacgtctcatatttcccccagactttttgagagatagttgagaaataaagctgtgtaagtttagagtgtagtatgtgatgatttgatatatattgtgaaattattaacacaagttaggtgacacacctgtcacctgtcctagttatcatttttttttgtattgtagtgaaataaatgtctcatttaaaaaaaaaagaattgaaagcaggaaatgaaacagatacttgtataccaatgctcatagtagcattaagcataatagccaagaggtaggaacaacccaattgttcatccacaaatgaggagagaaaatgtggtatgtaaatataatggaatatacgtttcatggaaaagaatgtatctttcaatttttaatttttgtgggtacatagtaggtgaatatatctatgggatccatgagatgttgggatacagacatgcaatgtgaaataagcacgtcatggagaatggggtatccatcccctcaagcatttatcctttgagttacaaacaattcaattacactcttttaggtacttaaaaacgtacaattaagttgttatagtcaccctgttgtactttcaaatactagatcttattctttcaaaaattggttgaacctattaaccatccccacatcccccatactctcccaatacctttcccagcctctggtaaccatccttctactctctatgcccatgagttcaattgctttgatttttaggtctcacaaacaagtgagaacatgtgatgtttgtctttctgttcctggcttatttcacaaaatgatctccatttccatccatgatgttgcaaacaacaggatctcattcttttccatggctgaatagtactccattgtgtatatataccacattttctttatccattcacctgttgatggacatttaggttgcttccaaatctaatggaatatattattcactcataaaaagtgtgaaattctgatacatgctgttaatataacacggatgtaccttgcaagcatgttgagtaacataagccacaccccaaaggacaaatattgtatgattccacttatacaaggtacctggcacaggcaaattcatagagacacaaagtagaatggtggttaccgggggccgggggagtagggagtggggagttgttacttaatgggtagagtttgtttgtttgggaaggttctggagataaaggatgtgatggttgcacaacaatgtgaacgggcgcaatgccactaaactgtgcgcttagttgcaaggttacaataggacattttatgtatatttcaccacaataaaaataggaaaaggcaggtgatttctaaggacacaagtcccttggggttgctagttctgtcagacttttccccttgtttttctgaatgacaaggattagtagtggatgataatgagtggattcatggatttgagcaggacatgaaacaatttccatagacagagatgaaagggcatttctgacttgaaacctgggatgagcaccgatgcaggagaggcacgaaagctcacagcgtgttcagggcgtagtgaatagaggggtgcgtgccccgagcctgcagagcgggcagggatgtgtaggaaggcaccttcatcctcctcactcagcctcccagctccaggtccaaagccgccaaatcatctttcttgtcaccatcacatgataagggggagtccttccagactgccagtcaatgaagtaacacacacagccacggtcatgccagtctgagcccatcgggcgagccctgaggggaataacagtcttggtggcattgggcaagccccgaggactccatctcggggaataacagtcttggtggcatcggcgcttcaccaggcctcctggaaccatattcgggatccccaactgagtgctggaaagaccactggtcaggagcagggagcaggggtggaaggaggtggctcgtcctgaccttgacaatgagaatcctgttttaagcttcacgctgctgactaaacagaaaggccacggcacagggacagacgtgcgcatgaaatcacaggaagaaagacatttcacgaacaaatgcatcctcccaaaccagtctgaatccctccggacagggtgatgttaccacgcaactggcctggcctaatgagctggtttctgtcatccctcctggaaggttaccctgtaacacaaggcgtgcccactgacatgcagcctgatggagcaaggttacacctgtctgccttttgtgtgcacaagatcagaacacagtcaagtgaatacaaatgcaacagctgcttggggctcaaacttgcatagtctattttatttggatagagagcataaaattggctctaccaaagtctggaggctggaagtaatcataattgtaatctagtataattaccaagcctagacctttacctagtcctatttaacctccctttcacctttccaaggaatgtggagggataagagagtcactgaataagttggttggtaatactgtattgtatctctcaaatccattgtttttttttaaagaatgagatcaataaatataaattccaatattttcttccccaaagcaccatcttgtaccgctttggagaacattagagggactcacctgggtttccagagctggaaaacataagccccataatgcacccagtccccacggcgcgctgccatcttaggcccagtccccactgcacgctgtcatcttaggcccagtccccgctgggcgctgccatcttaggcccagtccccgctgcgcgctgccatcttaggcccagtccccgctgcgcgctgccatattaggcccagtccccgctgcgcgctgccatcttaggcccagtccccgctgcgcgctgccatcttgggcccagtccccgaggcccagtccccgctgggcgctgccatcttaggcccagtccccgctgggcgctgccatcttaggcccagtccccgctgcgcgctgccatcttaggcccagtccccgctgcgcgctgccatcttaggcccagtccccgctgcgcgctgccatcttaggcccagtccccgctgcgcgctgccatcttaggcccagtccccgctgcgcgctgccatcttagggttttgcttagggggcagatagaaaatagtaaatgaaaccctttcagatatttcctggccttatttagtaaacacgtctttttgaaagaactctgaatacacctgcagatttttcaaagcccagattctacacacttctaatgtcaaccttgaagggagatcgtagattgaattacagaaaggggtgctgtcaaaatgccacatcaaatataaacttcacatatgtttcttacctgaaacactcactcacactcatggaaaagcacaggaatgttctaaaaatgcaagtttatcacgaaggagacacaggaggttcagagacgatgaagcggcaagccgggaggaaagatctgagagaagccaccaggctggggcaggatttcattatatccagaattccacttgggctctgcagtttctttcttcctgagaattatttaaaagtccctggggaaggacaagagtaagaaaaaatcaagggagagcctctgggttactatgacaacatgactcttgaccccttctctctcacccagcagtgcctaagtcccttttgcattgctgcagagatctctggcactgtgattagcacatactcctaaacctgaggatgatttaaagtggaaggagatcaaagtttctaaatagtacaatgagctcatcttgactcaaaagatgtgtaatggttataatgcaacataactgagatgtttccttatcccccccaccagtaaagctggtcacagaccgttgcaaaggctctgtgaaaaatgacaggtctatggaaatgtctactgcaaagcactgataactcaggataatgattcaggccaaaaaaaaatttaaaaggaagtgaaacttcagacaatgtgaaacatgtcagagtcgtgtttgcattctaaattgcagtaatgatataaacatcattattcctaatctgatcctgcaggtggatcaaatacgcacacatctattaaagaacagtctgcatgctcagtaagtgcacagggtcttattaccgaatctttcagcacatcttcatttcatctttaacttcattagaatatgtaagttttggcagtctattgattcaggagaaatctatggatctattattttctatttgtctataaagtccactaattcaccttctaagttgttgttttgggttttcatcaaagtgatgacattccaactcctgattatgctacattgaataaaaataaatgtaggattttctcctttctgacctagagctaataagttgtacatattggctgagttactgcaaagaaagggcaaaatgaaaacacagctcttatagtcaaggttcttaggatcttattgagatgagctcctcagaatcagccaaacttcaaacatggagagcacggcccccagtctgccaagtcggcccaagactactgacacctactgcaagcaattagggtccaactacaaagttagcagaaagagcccacccaagaccactgtcacgtgtgacaactgcatgtttggagggttcccaaaacgaccctcaggctcgtaattctctagagggactcacagaattcacggaaaatactcatggctacaatttattatgttggaaaggagacagattaaaatcagccaaaggaagagacacatggggcagaatctaggacggtttcaaaagggacgcttccattgtcgtcaggacacattacattaccttcccggcatccgtgtgtgatggtacacgtggagcactgccaacccaggatgctcacctgagccttgtatccagagttgttactgtggtttcattacattggcatgattgattgattgatttcccatgtggtctaactcagtctccaggtggactggtactgtgtgaccccaaagcccctgccctaaatcacatggttgatccttctcttgcaaccagcttggaccatatgactatcaggtatggcccatcctaccctaagatcttatgtggccaaccctcaccataacaaaggcactcccagtgagtatgatgtagtttacctcccagaagctcatggaaaaggccacatctatctttgggaaaggtcaaattttttactacccaagcctgacctgagaagtgctaaattgtgagggtggaaaggggctagtgtgagcttggatgaacgaagtatctgaagagcaatggaaggaacatggaatgttcttaaacaacagaacatttttaggaccatagagtattggagttgaaagaatttgggagattattgcatttcttaataagagcactgccatgcagaagtggccttgtcttggtaacatgatagaagcacatgataactgtctttaaagtgtgaggggcccatgtgagcaacagggattatttttaccccatataatcctagagaacaaagccagtggccatgggttagaagttattaaaaagaagatttaagtttaatagaagaaagagctttctaataattgaggctattcagaatattacacaggctgtactgggatatggtaagttctcccaagttaaaaatattcaagcagaaagcagatcacctgttaccatggcagtgcttttattaggaaatgcaataatctcccaaattctttcaagtctaatactctgtggccctaaaaagagttttcaatcttgacagaattgtattctggaattagtggactatttctttcataagtcattatgtgaattaccttgaaaatttctaatatcgtacctgagtgccatggccttggcatgaatatacacttcctgagcagaacttaagaatgagaatatctggagtaattcaggttctgctaattctgcatggttgtcactgcgatgatgttcattgttctaggtaagaaggataaatgagtaataaaagtttcatgggacacatataagtgaactcatgttttatatccacttcagtcattcattgcaagcgagtcttgttcaatgagatcaaagcagattggttaggattttgacttgaaaccttctgttatttataaattggagttacatcatatatttcttctaaaagattctattgagactgtttgctgtctacagctggtctttctccagaagtaggttgaattgccatgaattttatcttattcagataaatagaatgctggtatctaggatccaatagattcatgtggcccaaatttcatccagacttcatcctcctctgtgtacagtggcaactattaaaatcataacagagacttgttggctccagcccatacttgcaatgtaaaacctccacttggtgcaaactctttccatccagtattttctgatgtccctgagggctctcatgaatgctcatcacacgtctcctcctggaaacaactgctgcttcaccaagaatcgcaggccccacggggaaccatcacttctctcctgcctgtcactgggcacagccaccaacattccagagccatcatggtgccagccccaaatgaccaggatggtgtcgggaagaacgcgtctctcccacgcattatcctgcctcagaggcatctcaaatgatgctgcttgcacctcagggttctacagtgtttcataaaaagagatcgatgagcaaataaatagattaacttcatgtactcttaatagttcaagacctctgccaaccagcggtctcaggataagcaagacatgacctcataataggaggtgtgctggttggatcacaaaggctggtccttcagccagagtgggtggttctctgcagggacctcttctaagctctccttgatgagacaactaatcatcgtgtacactgccgaatgacagtgtttgcagaacctctagcatgcatgctggcctcggctatctctgccaatactttattacacaagccagagtcaccttcatcggaagacttgagaacttggcttctctatcccacgaatgttatgcagtcatcttcccagcatcctgcaggacagacctgcttatgccatttgcagtacaaacaaagtactatctatctgaaattgagcagcaagtactttaacttcacgtacctctccttctgaaaatgccatcaggatagctcagcccataccaagcttctggtacttctctagtaccccaaagcaagtaattcatgccctaaggcattagcatccttgaagggaatgttgccaagacaaggccacttctgcagagcagataccttccccagaggggaggcgtccaaagtcttgcctcaaacgtaggaatgttcaggaagcagtcatggacagcgagatcatcaagtcccttaggaataagtaaactcaaataaaataaaaataaagtgattttcccttttggaggtatgtgtttcagtctggcgcaactcaacactgtcagaaataataaagacacttacttgagacctaggagaccctttggggcagaattgccctcagcagagctggtgatggtttcccttgagaacagcctttcccatgagggataaggaactgcggagatgctgctcaccttggccaggagcattgggccagggatgatggcttgggaccctggtccctggcatctcaggctggtctccaagggtcactggtgacctttcaggggacaaaagaaaaggatcttcacagatagttggctgtaaataggaaggaggcagggtcagtggtgaggaggatatttgaacagtcagcgtgtatttcaaagccgtggttctgtccccctctggtgttgcttccttctcctcttcactctgcagccgcctcttggtggtcagagggtgaatgcagggccctggggtttggggcctagggctgggagatcagagctcttggagctggcttgatacctggcaatcctcatccagcatctccatctctctacgacgcgttctggcacgttgcaggtgaagtgggtagagcgtgggatggttactggaatcgatgtagttccagggtgctgtccttaagagtgcgagtggtaccagtcagtgttctcggcatttaaatattagttgttgttatcttggctatctcatgcgtgtaagaattctgtgtgtgtagtttccatccttaaattcaaccaaggtattactgtaaaaaaaagcaagacaggcctggcacagtggctcacgcctgtaatcccagcactttgggaggccaaggagggaggatcacgaggtcaggagattgagaccatcgtggccaacatggtgaaatcccgtctctactaaaaaatacaaaaaattgctgggcgtggtggtgcatgcctgtagttccagctactcaggaggctgaggcaggggaatcgcttgaacccaggaggcggaggttgccgtgagctgagatcacactactgcactccagcccgggtgacagggcaagacttcgtctcaaaaaagaaaaaaaaaaaagcaagacaaaaactctctcccttttctagaaaagagcatgcctgtgcgtatggctggctgtgtgcctacagttcatgtgcctgtttccgtttttgctgctcaaagccatggattggtgtgtagtcaggacctgcattctctgcttggtggttcagtgtctgggatgatactgtttcccggttactctagagcagaggtcaacaaacttcttatgcaaaggagcaggtagcgagcatttttggctttgtgggcgacacaggctctgttacaaccactcaactcttattgtagcacaaaagtagccacagacactatgtaaacaaatagatgtggctgtgttttaataaaactttatttacaaaagcaggcagtgtgccagcttgggcctgcaggaccctggttggtcagccctgtgcctgagtgataacatgctctttcatgcctttaaaaatgattattaaagtgtgttcattatcctgttctttttgtcctttttcttgtttaataagtgttcactgattttaaaaagacatttttctaaaaatctgggggttttttgtgttttttttgtgtgtgtttttttttttttttttttttttttttttgacacaaggtcttgctctgtcacccaggctggagtgcagtggcgcaatctcggctcactgcaacctctgcctcctgggttcaggtgattctcctgcctcggcctcctgagaagctgggattataggcgcgcgccaccatgcccagataatttttgtatttttagtagagatggggtttcaccatgttggccaggctggtctcaaactcccgatctcaggtgatctgcccgcctcagcctctcaaagtgtggggattacaggcgtgagccacggtgcccagcataaatttattttcaaaggcaagtgtggtcagtgtaggcagggagtgaaacatgtatgcgtaaacacaactacttgaaagagcggtgcggtccttcctcaggcccccgtcagctctgctccatccccagtcccttcctgtgcctgcccaacctgtcctccatagccagggccccccaacccaaacccctccaggcaccacctccctccatccctcccgcctggctctggggagggggtggccagcggccctgcacgcttcttcctcttttctcttcctctctcttcagacttgatgcaaagagtgggctaagtctgtgctgactgttgccctggaaactcttttgaacctttctctttccctccaaagattccgagttcctcctacagtttgcagccttcagtaccctgccccttccctcccctgccctcccttacttggttgtctttattccaagttaaatgatcatcatgaggttgggaaagccgcagctttctatgcaccatgttttactccccaaaggacatcttttagagtccgcagaggcccacatgaagggctcaccagcagctctaccggtttgctttccacaaggagagctaaaatgccggttgctaagcagcatacatgccgctgcttctttccacaatgtagacttaaaaaaatcgccgtaaacattttaccatatgattgagtcaggtgtggggagtcgcagtaaacattttaccatgtgattgagtcatgggtggggagtcgcggaaatacacagggcaggcagttcgctatcacgatgttctctctcaattctgtctttggtctgtcttcctgggtaatgtcacatggagacccaggggatctgccgtcagctgtgtgcagtgggttaacaagacgacggggaacttcagagtgcaggcagtcctcatcttttgcagattctgtatttgcacattcacctactcactgaaatgcatttgtaaccccaaaatcaatacagcggtttcacagtcattctccgacacgggcagaggggtgaagatactgagtcgccagatgcacgcgttccccgccgaggtggagcgtgcaaagctctgccttcacgtttggctctcatatcgtgcacatgtgtcctttttgcagtctccttagcactgtgtttttcatatttttgtgctttctgatggttattttgctgtaaacggcccccaagaatggtgctgatgtcctatttagggtccctaagcacaggaaggctgtgatgtgccttatggagaaaatccatgtgttagacacacttctttcaggtaggagctacagtgctcatgggggtctagtgttaatgaatcaagaatacacacacccagaaaaaggaagaggaagcgcacagggcagccagcttgatgtcaccacgttacatccttttatccggtctttggtaagttttcttttcttttttttttttttgagacagagtctcgctctgtcgcccaggctgaagtgcagtggcgcgatcacggctcactgcaagctccaccccccgggttcacgccattctcctgcctcagcctcctgagtagctgggaatacaggtgcccgccaccacgcccagctaattttttgtatttttggtagagatggggtttcaccgtgttagccaggatgttcttgatctcctgacctcatgatccacccacctcggcctcccaaagtgctgggattacaggcatgagccaccgcgcccggccggtctttggtatgttttcttggggacttacacagggtcacgtggagatacagggggatgcgccttcggcccatctgtatgtggggccactctggaaagtgctaaggtaacagctatagtacatgaggaagccatggaagagatgaaaagtggctgaatgtgtggattcatcagatgatgagaacatttaatgtaatagatagcattggtgtgaggctagacaccaaagaaatgtacaatcatgttacccaagggaaggaaagtattaaacccttcttggctagtgttttattttaaagaaataccaaatataattcattattttgaagaaacgtattaaataaagcatcttattaacaaggttacgtattgaccagttgaagaaacttttgtcatcagaggttcacagaaacctaaaccatacgttaggttggtgcaaaagtaattgaaatgggccagatgcagtggctcacacctgtaatcccagcactttgggaggccgaggcgggcggatcgcctgaggtcaggagtttgagactagactggccaacatgggtgaaaccccgtctctactaaaaatacaaaaaattagctgggtgtggtggcgcgtgcctgtagtcccagctactccggaggctgaggcgggagaatcccctgaacctgggaggcggagattgcagtgagccgagatcgtgccgttgcactccagcctgggcaacagagcaagagtctgtcttaggaaaaaaagaaagaaaaaaaaagtcatcgaaatgacagaaaccgtaattacttttgcaccaaactgtatttcccctaagaacaatggcccagtatttacaaattcagtgttcacaaatattttatagaacacagctaccatgaataacaagagctgactgtatatgatcacaacctaactgagcagaactcaccctccactactcatgtaagacctgactgtatatgatcacaacctaactgagcagaactcaccctccactactcatgtaagacctgactgtatatgatcacaacctaactgagcagaactcaccctccactactcatgtaagacctgactgtatatgatcacaacctaactgagcagaactcaccctccactactcatgtaagacctgactgtatatgatcacaacctaactgagcagaactcaccctccactactcatgtaagacctgactgtatatgatcacaacctaactgagcagaactcaccctccactgcgcatattgaagacagagcccaagacgcatccaggtgcaacgtctctgctaagaatgtgtgccaggaatggggcctggcttcctcgtcgagtgcggctgtccgtgggtttctgctagacagataacgttctgaaggagttaaactttcacagctcctcctcctcctcctcctcctctatatcccttacctcgccacgttcatcactggtcattttgctggaagggaagccctggtatattcttacattgctctggaagtgagctttagcccagcgtcgccaaacttacaccttaattgatcccagatgagaaggaaaagctattgctcttaccccacagtcttccctccctgaggccagaagcaggtcacgtgtaaaatggtctgctctctgctgacagtggcctgagtctcccatagtgtctgctgagctggatagtccctctccagggagctttgcaggggatgggtgatgagacatggacatggggacgaattcctctcatctggaatcgcagacacagcatggagatatgagcacgcggcatgggaaataggcttcctcagcccttcaggatcagggaacgtgccagagatgcaatgacatttggcagcagttgagagtatgagtgctgttgatgaaataaacagaggcctttaaaagcaaggcaggaaaaatgctgggacgagtacaggaacagaaaaccagccatttctccaggtctattcaaagacgtagcaacactccctgcaaaccccagggcctcattatcaccactcagggcagtggccccgcacagcacctgcacagttgccagaggaggcctctctataggaagtgctgctttctgttgtggatagagtgactggctgggcctctctctgtgtttctcccctagtcttcaggaatatgaatgccttttccttcagtgctactaggtgcaaatatgcgagttaagggacaatgccaataaagtagccgcagtttcctggctaaaggaactgtgcaggtattaaaaacccaccgatctttaatccaggttcgtggcagggggactcctttttgttgcaagattgtctgtgtgtggaaaccctggagaaaggccacacgtgcagtcagcaagccgagtcaccaggcacagagccctttctcctgatcccctcctcttgtttctattcccaggcctcattatgtataatgtcacagacacacacgcccaggaacatcccatcacagccaggacagaagcgccaagggaggtgctttgcacagattccatcttggagttagaagcacttgctcggtgcttgccaactacaaatagccccatgctggaaaatgatgctaattagtatgccattaaaaagggtggggggaccaccacccacaacaaaatggccgtgtgcaggcctgaagccctgccctgagggccacagggaagcatggccgctaatgcagcctaattcactttgtttggcagagagagcaagctcgccatgttgctgcgggagtctctggggaacatgaactgccgtaccaccatgatcgcgcacatctcggccgcggtcgggagctacgcggagaccctgtccaccatccagattgcatcgagagtcttgaggatgaagaaaaagaagacgaaggtaaggagctcgcggggtgggggggtggtggatgagggagcctttggagccgtgccctggaacagagtcagaaaaagccaaatcaacgttgccaatcccccagcatcaggagatgtgacttggagctgacaacacgtggctcagggtccactttggggcagggaaaccttggggctgatacaaagtcatgtcacctccccacacctggtgctggccctggtcacccagcctggacccctgaccggaagcacttggtccgctttagagagtacaaatggattgctacctcaagaggaaaaacgttggagggatggaaaatattgtttttctcatgcatggcctcggtcctgcgtaggtggagactgtgtccttcgaaggcttggcaccaaagaggttctcaactccctgctctcagggcccctcccctgctgcatgtccaggagtcactccctggctgctgcttttgtcctggcaattcagtggtttctggatgatactgagtctgctggacatcgctgggctcattttctcaggcagaggccaagccaggatggtggcagggtggcaagtagttgagaaaaccatcatgatcgtggccactcagtggcaggggcagctgctgaggtgggggcctttttcccccttctctgttttgtaccttttttatctttaaatagcgtttcttaaccagagttccacggcacagggtgccaaacattggtgagccagcagcccttagctggtcaggcagggcctggatggtcaccccctttcctgagcagctgtttccccagcgtgccacacggggcttccccttcacaaatgcagtggtgatgtgacaccgggcgcgcgggcatggcaccccgagtggcccacgtgcgggaggccaacgggggtggctgtcagtagcctgtgtcgtcaggggccttcaccacttgccgcgcacagctgggctcccggggaaactgccacggaaaggccaccacattaactgccgtctcactcacagtacacatccagctcgtccggcggggagagctcctgcgaagaaggccgcatgcgcaggcccacccagctgagacccttccacaccagggccacggtggaccctgacttccccatcgctcacctgtccagcgaccccgactactcctccagcagcgagcagtcctgcgacaccgtcatctacatcgggcccaacggcacggccctctctgacaaggagctcaccgacaacgagggccccccagactttgtccctatcgtgccagccctgcagaagacccggggcgacagccggcccgcagaggcaggagaggctgcagccggcaagtcagaaagggactgcctgaagtgcaacacgtttgccgagctgcaggagaggctggactgcatcgacggcagcgaggagcccagcagctttcctttcgaagaactgcctgctcagtttgggccagagcaggcaagcagaggcccccggttaagccaagcagcgggggcaagcccactctctgagtctgataaggaagataatgggtccgaaggtcagctgaccaacagagaaggccctgaactcccagcctccaagatgcagaggagtcactcacctgtgcccgccgcggcacccgcccacagccccagcccggcctcacccaggagcgtcccgggcagcagtagccagcacagcgcctccccactcgtgcagagccccagcctccagagcagccgggagagcctcaactcctgcggcttcgtggaaggcaagcccaggcccatgggctccccccggctgggcatcgccagcctgtccaagacctcggagtacaagccacccagctctccttcccagagatgcaaagtctacacccagaagggggtcctgccgtctcccgccccactgcctccctcgagcaaggattccggcgtggcgtctagggagtccttgctgcagcccgaggtgcgtacgcccccggttggaatgagcccccaggttttgaaaaaatccatgtctgctgggagcgaagggttcccggaaactcctgtcgatgatgagcagcaggcagctactccttcagagtccaagaaggagatcctgagcaccacgatggtgacggtgcagcagccactggagctgaacggtgaggacgagctggtgttcacgctggtggaggagctgaccatcagcggggtcctggacagcggccgccccaccagcatcatcagcttcaacagcgactgctctgcacgggccctggcctcgggctcgcggcccgtcagcatcatcagcagcatcagcgaggacctggagtgctactccagcacggcccccgtctccgaggtcagcatcacacagttcttgcccctcccgaagatgagcctggatgagaaggcccaggacgcagggagcagacgctcttccatcagctcctggctgagcgagatgagcgcgggcagtgagggtgagcagtcgtgccacagtttcatagcccagacgtgttttgggcacggggaggcaatggcagaacctgtggcctcggagtttgtcagcagcctccagaacaccgctgtggtgtgcagagagaagcccaaggccagccccgacaacttgctcatcctgtctgagatgggagatgactctttcaacaaagcagcccccatcaaaggctgcaaaatatccacagtgagcaaggccatggtcaccatctccaacacggccaatctgagcagctgcgaggggtacatccccatgaagaccaatatcacagtttacccctgcattgccatgagcccccggaacatccaagagccggaggcccccaccgccacccccaaagcaggccccacattagcccagtcccgggagagtaaggaaaacagtgcaaagaaagagatgaaatttgaggacccgtggctgaaacgagaagaggaagtgaaaaaagagacggctcatcccaatgaagaagggatgatgaggtgtgagactgccacgggcccctcgaatgctgagaccagagcagagcaggagcaggacggaaagcccagtccgggagacaggctcagcagcagcagcggagaggtgtcggcctccccggtcactgacaacttcaggagggtcgtggatgggtgtgagatggccctgcccggtttggccacccagagccccgtgcatcccaacaaaagcgtcaagtccagcagccttcccagggcctttcagaaggccagccggcaggaggagccggacagcctctcctattactgcgctgctgagaccaacggggtgggtgcagcctcgggcaccccgccctccaaggctaccctggaggggaaggtggcttcccccaagcactgtgttctggctcggcccaaagggactccccctctgccccctgtccgaaagtccagcctggaccagaagaaccgggccagccctcagcacagtgccagcggcagcggcaccagcagccccctgaaccaaccagccgccttcccggcgggcctcccagacgagcctagcggcaagacgaaggacgccagcagcagcagcaagctcttcagtgccaagctggagcagctggccagcagaagcaactcgctgggcagggcgacagtcagccactacgaatgcctctccctggagcgggccgagagcctgtcctccgtgagctcccggctgcacgcgggcaaggacggcaccatgccccgcgcggggaggagcctgggccgcagcgccgggacctcgccccccagctccggggcctcgcccaaggccggccagtccaagatctccgccgtgagcagactcctcctggccagccccagagcgcgcggcccgtccgcctccaccaccaaaaccctcagcttctccaccaagtccctgccgcaggcggtgggccagggctccagctcgccccccggtgggaagcacacgccctggtccacgcagtccctcagcaggaacaggagctcgggcctggcctccaagcttcccctgcgggccgtcagcgggcgcatctcggagctgctgcagggtggcgcgggcgcccggggcttgcagctgcgggccgggcccgaggcggaggcgcgcgggggggccctggccgaggacgagcccgcggccgcgcacctgctcccgtcgccctacagcaagatcacgcccccgcggaggccccaccgctgcagcagcggccacggcagcgacaacagcagcgtgctgagcggggagctcccgccggccatggggaagacggccctgttctaccacagcggcggcagcagcggctacgagagcgtgatgcgggacagcgaggccaccggcagcgcgtcctcggcgcaggactccacgagcgagaacagcagctccgtgggcggcaggtgccggagcctcaagaccccgaagaaacgctccaatccaggtaggcggctgggcgcagggacgcgggtgaggagggcggcaggtgggcgagctgcccaaaccccactgccagggtgtcccgtgccctggggagggggcgtccaggcctggcctctccttgcaggtgggcgaactgcccaaaccccactgccagggtgtcccgtgccctggggagggggcgtccaggcctggcctctcctttcccacggcccggcaccccgcggggctccgccggggacatcaccgcggagggtttctctgtgagaaactgccctactgcgtgccgtcatcaggcttagggccgtgaatcccttggcgctcagcagggtggaaaggcgagggcccggatgcaggtggcagcatgacccgcacctgctcgctctgggggcagcctggctcttcgccgtccattccctcacccctgcccctctgttcaacaaccaaggatcctgtggacggtttacagcctgttgagggatcaggtgagggtacctaccctcatgacctggtggcttcagaagcccctcctgtgaggttggtggcctgcaagaccctggcagcctctctcagggatgtgggataacgcacagattgtcccattgaaagtggaatggcgaggcccttcctccacctccaccccaaacatatttgtggacagtcatgtttgcacacctgccacagggcctgcagtgccccccgccacacacaccatgatgcctgaaatgcgtgattttggagaaagtctttgccatttctttttttcctttttttgagacagtcttactctatcgcccaggctggagtgcaatggcgtgatcttgccaaactgcaacctctgcttcctatgttcaagtgattctcctgcttcagcctcctgagtagctgggattacaagcgtgcaccaccgtgcctggctaatttttctatctttggtagagacaaggttttaccatgttgaccaggctggtctcgaactcctgacctcaagtgatccgcccgtctcagcctcccaaagtgctgggattacaggcgtgagccaccacacccagtcagtctttgtcatttttaagaatctcctatcaaaaggcacgtactccagaataattaatatataaagcccacagacttgttaattggagtcttgggtggcacatgacagtaagttatgatgggcaaggagaagaggacccgggtcagagctggtggccctggaggtcttggggtaggagaaatgaaaggatggtaaggagagaaaaagacagacagaggcaaaagttcccaagaacaactgaagctacttgagaattttgcctggaatcatctctgctcataagtggcttccaaagaaattacccctgctcatcctttaagggcttaaaaaaaaataaatgaaatttacgcagaaccccacgtgcaattctgtggcttggttgaagccagggcggccgggttcctgccctcctggcctgtctctcccctcccgctgcccttctgtgcaacactaggctcttcacatgctctcagaagccaggtccctgcagggatccgtgcccgcagcatatgtggaagtaaaagatggggtgagacacagatgtagggcttcccctttcctactgctccagcaactgccccacaggcttgttctctgtcatggggtggcttcttcctgttctcccaccacaggcgagcacaaactctggaatgttccaaatgtaagggctgtggtcagtgaacattataaaccattcctcttcctagaatcaaagaaatccaccttaagggatggtgtagttatgcagatgtagttttatgatatagacagccccatccgctcccctcatcacagatcacagaacttggccatggggatgttaggctctaagcatggtagggaatcatcgtggctgtcagtaccttgacatctttatttgcctggggggggggtatgcttcagtctttgatacgctttgactctgctttacttcacccctcaatctcggtgacagcacttggagcagaaccccatttaagacaagttgaaaaggaagagccattccgtgtaacgtagcagcttctgtgtcttatggccagggccaagggcattgaaacgtattgatgagagtaaaaataacaagcaggaaagcatctgccggccttcccagtacctggttaatgaactcttgttattctaatccacgcagcctcggtcttcaaagtccagatgactgtgtggcatcggctgcgtggccacgtgtgtttcagtgtcccacagtgctttcatggactcaaatttagtgccttgcgtctaccagtccatttcattatttccgtggctttcacaggtttttgtttttttccccaagacttttattgtttggtttggcggttacagtggagtaaagaggaagaacaatgatggaaaaacaaacgtgtgaagtgactgcttggcgagcaggcagcaggctctgcatacgcccttgctctgggctaagtgctctcgtaaatgctgtcctctaggagcctctggttaggtaaggctattggaggaaaacagtgtaaaattaaaatgccagggcaggtgctagaaatggatttcatgtggaatgtcaagagcagaagacctttgtgatgagctgctgtagatccaggctccatgatggatgtggcagtggagatgtgctggtttcaggttaggtgaccttgtctggcttatttatgattattattaagagaaacggtggctgtcagacatggtcagcataaatcaaaagcaacttctttaagagaagctataaaactcctccaaggaaattcctaactagatggctagagtttacaattatgagaggtgtttggaaccagagaggagacatcttttgtctgagatggcttttgaatttggaatattttaatgcttatttccttagtaaaaatgaactagaattattgggaaaataaccttgacctctctgattccttggtagtacatgtaacagcagaaacgaccaaatatcaccgtggttccttcttgtcttctcattcttggaggtccatgttgctgaggagtgtgcagcattgggcttgttccaccggccatagcagggtgcagtgaattaagttagaaagcaggaggaggcttagaatcttgagctgtgtgacctttggggaataactgtcctctttgagcttcaattttctcatatgcaagtaaaacgagaagattgataggtaatagccatggtctctctgctgcccacatcatatgagactatgcagataatttaaataatgttatggtcatgtgatgtcttttccttagagcaatctgtagtcagtggggtttattttcagttgttcaacattgaccaggtatcttctgtgctcttagagcttggtgatagtttctggtgtgtgggtggaggtggaggcagccggcacaggggacaaggccactgtaagaagtttgtaatctaattggagagaaagggtgaaaagcgtggaatagagaacagtgaactgagtgcattcccagatgctgagtggggtagtgaaggcccaagtggagagagcatttagacaaagcaggatcctgcaaggcaaaggctgcagagaaatgtcgggattgagcttggtccgggagggtgcttacatcgggacaggcagagagggcgcagggcatcgaggctgaggcagggatgggactgcaaactcccagcggcaagagcctggcctgtgggcgacacagcgagattaactcaaggagggaccgtcccagcaagcagagcaagacgctagcaaacgcaagccacagtcacacccggaacaaacacaagccacagtcacacctggaacatctgggagctacaagaacagtacacattattctatattctacatagttctaaaagaatatcagtatattattgtagttggcaatggggagtcattacaggctcttgaccaacaacgtgataaggtgagagaaatgatgttgcttttattgatggattttcattgcttcatccacagctccttgccagcccctctatggtcagcaagatgaaattgtgtatagcccagagccaagaatgagcccaggagggaagggaatgtctgtcctggccagtgcacatatcagcagctgaggatgtcaatctgtgatacacagttgatgccataattacaccagctgagcccctaccctgagcccccagtcctcgcgctcccccgtcccctatcatccattatatgttatgtcaatcctattttcttcctccagtctcttaacatttcaccctcatcctggtgtgttacttccttggattctttcccttgctttccttttcttggactggatggggaagtctgacagttagatgagcaccttggtctgaattaaattcattcccaccacagggaggctcagcaccagaaaagccctggagtgagggagggtctgcctgaagagaagcccctcagggaagcatggaggttctggaatgctccagaccttggcccgcctggacatgagcaaggcctgttctgcgctcgacccagcctgcttggtgcccagcactgggctggtgcaggttactgttggatattattggttgattcattgatgggctggttgcttggttggcggcacagtcctgaaagtttactcatgtttattttctgtgtatttctcatatcttttcctgctggtgctaagtgctttaagtgttgagtctagtctgctactttgtcattctaagcgccagaccctgtgcctttctcttggtgctgagtcaacattactgactgatgggcctgtcttgtgagttgtgacttgcacctgtagtgaattgagctcccaggctaccaggttcagttcccagggcgctgcacaaaaacttgtgactaattgctcctcaccgagggcaccatggtttgctctgccaacctctcctattcgtttggttctcaggcacatcctggttttgttttaataaattcaagcagcacagtgatcactggcttaatgaaaaccagaggaaggcaagccgcttgctgtcagacttcagatttccagaatgtttctaagcgaaccaacctagagccagttgagaataggttcagaatgagagcctttttgaatacacagttgggggaaaaggaggagagtcattgattctctcagacaccaaggaagctccttagaatagaaccccaaagagagtaggtggcgctgatgctgtgagatgacactgtggtcctaggtgcggggttcggaatcgcagagaacacgggaggaagcccaggctcggcatcgaggagagctttgtggccctggagaacctgcctctttctcatccccagcacgggagcacttgccttttcagctaaaacatgacagcaggccacacagccagcatcgttcttcatcatggagctggccccttcctggtcaacaaaatcacatggattgattcacattctctttctctctctgctctgatatctacagttcctttcaacattagtgcctcgtgcttttttgactgtcttcctagtgcctactctttgaatcagaatgcagacagtgggcgatggagcgaaagccatgctggagggctctcaggagcaggagtttgggaatgggcagaagcatattccccagggggagctgagagggctcagcactcagaacacccatgtttcccaacacttaacctcagcagcagcatctgcagactcgtgtggggacttctgtctggactcagggatgttaagagtagaaggcccaatgtcagcttctcacgtgggctgtcagcaccgcagatgataccggaagatggactgtgatgggccagcgacccctctgactgcacgcagctgtcagccaggcctggaacaggaggggcgagggggtgggctcagcctctgttagtgggagaggtcctggttggaagtttcactgaagtatcagtgttgactttctcaggtcaaatctgggccatttcatgcggtaaatccatgtcggcaggtatcagcccaagtgttttgaacatgctgcacttgtacatgcctggaccaaatgccaggctgatgagcagggaggggttgaaaagcagaagggagcccaacccaccggcgtcagcaggaggctggccctggctgtggctccccgatcagacaggcggcgtccaatggggcaccacacgactcccgccagggtggggcttcccctgtacctttcttagagctgatggtcccctgaccccactcgcagcctggaaggaggggatccctggcagagaccgggcttggcagaaaactgggcatctgcttgagaggtggaaatgctggagcatgcagaaaatctaagaacccttatttatatggggccccagaccaggaccctcgggtcagtctttctttgcccagggatggcatagcagtaacatcgcttcctgtgccctttccagtaatgtgagggcaccatctccgcccctgaactcccttcaggccacttcactccatttcctcagcctgaccacattacccctgccccagtacttggcttccctcaccatcacctaagtgaagctcacatgcacctctggagggagacaggcgcggggagagggagcctcagctggaggtgcaggaactgagtatcaatccattcacgggattgaggttctggtacccaaattcagaattttacgaaaatccaagacacttgttcattcgtgtgcaggaaaaaggtattcctagcccccaaaccacacctaacctgacagtgggcactcacttcaccttgagagggatcgatgtggtgaggaagttcaaggttgctagatggcatggaaaggaggcaatgggaaggaagtagatacccgccaggatatttctgtgaagctgttgtagcccagtgaaatgtcactctccaggtgtttttaccttctctactcccagctcacacggtgccctggcacgggtattggcaggactctccaggtgtttttaccttctctactcccagctcacacggtgccctggcacgggtattggcaggactctccaggcgtttttaccttctctactcccagctcacacggtgccctggcacgggtattggcaggactctccaggtgtttttctctactcccatctcacacggtgccctggcacgggtattggcaggagatggagggtggctcttatccaagacattttcccatctgatcatatcccatccgcggtagccaggctccaagatggcccccatggtctctgcctcctggtgttcacacccttgtgtagtcccctcccgtatttaccagagttggtctctgttgagtgaggtaaggcagagtgatggtatgtcactttcaaaagtaggttataaaagacactgcaccttctgtgctgggtgcccctcttgctttcttgggtcattccctctgggggatgccagctgccatgtcataaatagtcctgtgtaggagaggcctgcatggcaatgaactaaagcctcctgccatgatgacatgagtgagcttagaaatggaagcttcaacctcagtcaagccttcagatgagtgcagccctagctgacagcttgcctgcgactccgagaggctctgagccagaaccacctggcaaaaattgctcccagattcccaacccacagggatatgtgagatcaatgtttgttgttttagccgctgggtttggggtttatttgttacacagcagccatttggaagctagagttgaggcacacagaagctaaacagtttgccaacaaacagtcagctagcttgatcagactgatttaaaagaaaaaaacccctctgatctggtcccttcccagggtaggtgtctcacgctaaggagacagacatttgctttattcccgtggtcgatgttacttagtttcgttagttggggcctgcactttgttggaaactaaatgcgattgtgtatgtgtctacacaagatcaaatctgggctctaaaaagtgaggttttggccgggcacagtggctcatgcctgtaatcccaacactttgggaggctgaggcaagtggatcatttgagatcaggcgttcgagaccagtctggccaacatcgtgaaaccctgtctctactaaaaatacaaaaaattagccgtgcgtggtagcgggcgcctgtagtcccagctacttgggaggctggggcaggagaattgattgaacccagcaggcagaggctgcagtgacctgagatcacaccactgcactccagcctgggcgacagagtgagactccctctcaaaaacagtgaggtttaatatgaagcaaaaggagctcggagcccagagttcactccatagagaaaattaacacagcagtgagtgccccttgttgtctcctggaggaggcatgcttcagctggcatctgctcatcaaaacgtcagtcccctgtaccatgcaagagtttagtctccattctgggagccatgtgcttcactaatacccagggtctcttctgctgtgaaagaaagaggatagatactgggagagaactagccgtcctcgtcacaacgtgtgaagtgtgtgaaatagtaccaggcacgtaaccagtgcatgtgagtgctactgctgctgttataagcaaataaacagtgttttctggaactcctgtaatgacatcaaatgctaggaccttttgacctatccatgctgaggatgccccctaggctgcgtgttttacaggtggaaactaggaggcggttctaaagattcctcagggagtttgctgagctaaagcccaagtgttggtttaggggagtagaggtggaggtgggtggtgggaagtgggagtgtttagccctacctcagatcctggggtgcttgtcatgacctcctctgttacatccacaaaatatttaaaagattgaaattcaggcttcagctgaatttcagggtgtagtggctcacacttgtaatcccagcacttcgggagattaaggtgggaggatcacttgaggccaggagtttgagaccagcctgggcaatatagcaagatgtcgtctctcaaaaaaaaacatttaattagctgggtgtggtggtgtgcacctgttatcccaactacttaggaggctgagacaagagaattgcttgagcccaggaattcaaggctgcagtgagctatggatcgcaccactgcactccagcctgggcaacagagcaagaccctgtctcaaaaaaacaacaaaaaaattgaaattcagaaagactaactctctgggcttatccccctcctcaggttctcagagacggaggcttatcccagcactatccctggacacctcttcccctgtgagaaaaccccccaacagcacaggcgtccgctgggtggatggccccttgcggagcagcccgaggggccttggggaaccctttgagattaaagtctatgaaatcgatgacgtggagcgcctgcagcggcgacgagggggtgccagcaaggtgaggcagcctccttcccaccccctgcctacgtggtggcagctccccaccaagcctgagcaggtgctaggcagggccctggggaagaaaactcagacccgggcttcccagcgggcttctggcatgggtggtgggaagggggcttctgtcccagcaaagggcctttggacagaggccttggagagagccccatgtttctcttcctgaaatgttttaagggcttcaaagccaggggtcgggggctggtgatcttgggggcttttctggctccttgaggctcccagtcttaaccaacctttgtccaacttgaacacccaccacctgctttctcaacttaagaatggcctgtcatagtccaaaaatggtctgtcatagtccaagaatggtctgtcatagtcctaccttgtgaggtgtctgaattgaggtctgtcaagggagaatttggtggggatgacccatgtccctcccacacgtctccaagcccagcctgttttccatcaacgatactcacaggtgctcctgtggtgtgggctgggtgtgagcagaagggccctttctcctctctgtctgtgtgctaggaggccatgtgcttcaatgcaaagctgaagattctggaacaccgccagcagaggatcgccgaggtccgcgcgaagtacgagtggctgatgaaggagctggaggcgaccaaacagtatctgatgctggatcccaacaagtggctcagtgaatgtaaggccggggtgccttcccacccttgtgactagtgggttcacctgctcaaccgggctggcgtgtagcccagggtgacagtgacacaggctgtgtcctcgtcctcagtcacaggatgcccatcaaatggaggaagttgcaccgagcgagcagccctactcccctggggatgggcgggaggggccgggacagcagaggggtggtgaatattgctcttgcaagattatttctacgtgtctcagtccaaagcacctgaaaatgagatttttccccctgcgtgtggcagaagatcacccagacatgaaggctgtattacaaatctcctaggccacaaaatcacactgcatatctagcctgaaatagacaagaatttatagagcccttaaaaaggtagagtgtacagtcctcgaaaagccacgcagagaacccagaaagcaaggaaaacatttttgagtggaaaaaaaaaaaaaaagacagccacagtgttatttccatttaatagaaagcccaggatgaccataaccatctaataacaattcaggacaattttgctctctttgaaaggtggattcaattgtcttgtcttattagttcctgaccattccatttagcacaaaataaaacttcagtctggtcccagctattacacggatataggagctaatgctggaagactcagtctgtggggtgaaatacattcctgccattcaagttccctctgcctccccttcccatccagccctcagcctccggcaggcctcctttgtacagcccctcccctgcactgccccaaccctcttccagtcttccccagccagtgtggagggcctacaggtggaggctggaagcttaggtttatgttccaaagcagctggttgaaaagatattggtgtgaaatggtcctgggtgaaggtgcggaagaaagtggcaggacttgtcagcctcccagctgtgccttccacatgtaactgcagtctcgcagcagctgcctctccacagggataaggtgataacaacatttccctaagtactcattggattcttgggacagtctgtggagcattctataatataatattaagttgcagcatttgccgctgtggccacaggcatacagacctgctttggctgctggctttctcacatactagctgtgggacctcaggtaagacacttaactctgagccttgacttccttagctgtaaaatgggaaaaataatggtgactacaccatagggcagttgtgaggtataaatcagttcccgttggtcctcttggtgcttactacactgcttggcccaggatgagagctcaggatctggtagtaattattactattatcccaaagttcaacaacaggagacatttcctggccaggcacggtggctcacgcctgtaatcccagcaccttgggaggccaaggtgggcagatcacttgagcccaggagttcaagaccagccttgacaacatggtgtgaaaccctgtctgtctctaccaaaaatacaaaaattagccgggcgtggtggcgggcacctgtaatctcagctactcaggaggctgaggttgcagtgagccagagattgcgccagaccctgtctcaaaaataaaaataaaaaacaggaggcatttccttcgtgtctgcttgcatgatgcactgaggagttggatcttctgttagaaatttgagcaaagaaagacatgaactagtcctgcgagggcctttcatcgaaggcgctaatggggagggcagacaggggcgagggcgctggttactgtctgcgcgtgacatgcgcacggggcgctgtgcttatccctccccgctgcggatacccttttccttgtttcaggaatccctggccacttcaagatcccaggggcctcctttcagtcagtcagttctctctccttcatttttgctattttcattaacattttattttcaagaactgtttatgcccaaggcagacttgacttgaaaattatcttcatcttacaaagtcagtcatatttttcccaggatgggaacaagctgaaacatcaatacatatgtgtttagatgcttccaggaaacaattgcttccttctagtctttgtacatgtcaaaaatcactgtgtttttgatgctgagaaagaaaatgaacagaaagctacatgaaaggggaaatatatattgtttcttgaagatgaattgaaaacagtaatgaaaaaaaggatcaatgagctgcctgctgactattccctgtgggcatgaggcaggggactggcatggaaagatccatttttagttctattatttcttcattctgatgccacttttaaggttgtccagtaatgtagtctgatgtggtcatagaatgatgtctccttttgcttttttgttttggtttttaaatattaaactggtattcagggccttcggtctccttccagctctagtcctggttaactgtgtcagcctcagtgagtcacgtcactgtccagctctcagggacctcatctgcagaaagaagacactctgcagacagcggccactctaagccccagtgtttccatagcacggcatcgttttcaaatcaagttcgtgttcattattatctcattttattcttcacagcaactcaaggcaggcagggcaggcagcgtaggagttactattctcacatgcctttaaagacactgtcagcagaggtggaggtcccagagctcgtctcttcagagcttgtctcgtgcctggggttccagggccatcccaccaccttggactgctgtccacgcctctcctcctcgtactgggagcctgctggacccctggacctgggccaggcagcccatccctctgcccggccacctctggacaaagcaggggacttgatgccagaggggttgatcccagatacctgctcttcaggcctggaatgatacagactttttactctgtgcaggcctgaacatcaggaaaggcatctgggttataatccagaaacgtcctttcatataaggaagcagaggtataaatgtcactcaactgagacccccaaaagggagggactctccccacctcaacttgaattatttacttgattgattgatagtgaatagtgtggtagcgtctctcaaatcctgggatccatcctggatcctccatggctggaggtagggggagctagaatgtcaccttattggtcagtagaatctcagaaaaaaccttaaggatctaaatactggtaaagagtgttcctttcaacccaaaagaggccgagaatcaggcaggagggaactctgcagtggcctaaggcaagcgaactagacctttagaccaaggggtagatgtgggggtggcagctccaggctgagccgtcgggagttgcttctcaccctgtttgctctgcgtctccatcaggctcttcctctcttgcagttgacttggagcaggtttgggagctggattccctggagtacctggaggcactggagtgtgtgacggagcgcctggagagccgtgtcaacttctgcaaggcccatctcatgatgatcacctgcttcgacatcacctccaggcgccggtagatgagccagacccttgtcctagtggtcccccgctccccaggacttcagagatgttgcacgcccctaggccctctgtgctggggcatcaaagacaatgaatgaggatgaaggttggtggcaagtctggagcgggcgttgagcggaaggcgagttttcttttgttttctgtaggaaaggtgcaaacgtcaaacaccgtggaaggagaaaaggatgggaagcccgaggggtgtccaagccctgtgagactgaaaaagcactttgaggaaccttaaagaccttgtttgtacataagaactgctagcaaaagagacctcactcttctcttgctttcgtgagaaaggaggggcgtggatgtaggattgctgtggaaagcgaacacaaaacaacccagaatgactgattaagtgccttgcaaatctttattattatccaaacatttatgttcatactttcttgtgtacagatggtgctagtcaagatgaaaacaacaaaacaaacaagaaaaacattttggaaatgt

SEQ ID NO: 1686 - DNA, 306505 bp, Homo sapiens
taaaagccaactttgcacagcacactcttctgggccctaaggagtcccacagaatggggaaagtgggagccctggagttcttgggagtcttggagcctaaagagaaaacgaggtgcaaattcatttcacagtgactgacccttgagcttaaacagaatcagcaaatgaaagaatctgacaaataaggaaaggcacaagcctgcccgactactggacaataaactcatgacctaaaaaaaaaaaaaaagaaggaggtggctgtcagtaaatggggctgaagagaaccactaatgaaagccaaggctcacaagggaggccactcacagccaccagaagcttgtcacataaacattgagagagcgagggaacacattctttttaggctgggtgcagtggctcctgcctgtaatcccaagcactttaggaggccgaggtgggtggatcacctgaggtcgggagtttgagaccagcctgaccaacatggtgaaaccctgtctctactaaaaatacaaaaactagccaggtgtggtggcacatgcctgtaatcccaagtacttgtgaggctgaggcatgagaattgcttgaacctgggaggcggagtttgcagtgagccaagatcatgccattgcactccagcctgggcaacagagtaaaataaattctgtctcaaaaaaaaaaaaaaactttttagcgcctagttattctaaatatttacttaaaagaaaaagcaaggtccctatgtgggagggaggtaatgattatcttgcagtctggggtgattcaagagagagactactgcttagatggaccagcaccctgtctctctctctttttttaaatcagaaattaaaactaagagccacgacttcagaagactaaaagtctaaaaacaaaaacaacaaacaaaactacagcacaaaaggaaaaagctgtaggtggctacgaatctgaaaaataagtaaaagaactttaaacttaagtcctgagtaaacaccaggtctaccaaacatgatattagccctatattacttactgatttagaaacaagcccctagatacaggggggaaataaaagctaattaaataaattacatatacatacataatacaataaatagataaatgaagtatatgtgtatattttatataataagttaaaacaaacttccataatttgactcaattagaaatccaaaatttatatactaaatttctatactaaaggacttatataacaaaatgatttaaaaaagacactgattggcttttgtgcctctataacatagactttaacttaactttaacatttgttaaaatgcatcaattggcagaacttcacaagcttaatcaaccctgggactcaaattacaatgatacaccaggattccactaaatttaaacactctgctcctataatcttgagaagatacttaaatatatataaagaaaaatgagtttgcctcactttagcagtggggaaaggattccatattcaaaaaatgttgctggcagaattggctagccatatgcagaagactgaaactggaccctttccttacaccatatacaaaaattaactcaagatggattaaagacttaggtgtaaaactcaaaactgtaaaaaccctggaagaaaacctaggaaataccactcaagaagtaggcatgggcaaagatttcatgatgatgccaaaagcaatttaaacaagacaaaaattgacaaatggaatcaaattatactaaagagctgctgcacagcaacacaaactatcaacagagtaaacaggctgggagaaaaattatgcaaagtatgcatctgacaaaggtctaatatccagcctctacaaggaacttaacaagtttacaagaaacaaataaataaccccatagaaaagtgggcaaaggacatgaacagacacttttgaaaagaagccatagctgcagccaacaatcatatgaaaaagagccccacattactggttgttagagaaatgcaaaccaaaaccacaatgagataccatctcacgccagtcagaacagctattattaaaaagtaaaaacaaacaaacatgctggtgaggttgtggagaaaaacgaatgctcatactctatcggtgggagtgtaaattagttcagccagtgtgaaagacagtgtggcaattcctcaaagatctaaagaaagaaataccattcaacccagcaatcccattactgggtatatacccaaaggaatataaatcattcaattaaaaagacacatgcacgtgtatgttcattgcagcactattcacaatagcaaagacatggaatcaacctaaatgttcactaatggtgggctggataaagaaaatgtggtacatatacaccatggaatactaagcagccataaaaaagaatgagattatgtccttttgagggacatggatggagctggaggccattatccttagcataataacacaggaaaagaaaaccaaatgctgcatgttctcacttataaatgggagctaaatgatggaacacatggatgtgtagaggggaattacacacactggggccttttggaggatggagggccaaaggtggaagagaatcaagaaaaaaaactaatgagtactaggcttaatacctaggtgatgaaataatctgtccgatatagtcccatgatacaagtttatctatgtaacaaaccagcacttgtacccccgaacttaaaagttagaaaaaacctgtatccttgtttaaatttctcatagtcatagaatccactgccttaaaatattccatattcaacataaatactctaacataataaataataaatttagcctttgacataaattggcttgataaaaggggaccccttcaatccccagttaaaatagttaatctgacccaatgtaaattaatacagggcctcaaggattcaaatttattatataaaagctaattaataaaagactgattttctcctctgcttctccatttggcagcccaattttgcctgttcttaaatctgaaaacataaaataaaagatatctcactatggattaacgcaggcttaatgtcatgatcctatccatcaaggctttcatatttaatgtccaatttcattaaactgactgcttctatttaagcaataaccagtaaatatttgctcttattgattgcctttcatgtactgttcagttcctatttcaacatcctctcaggtcaaagtttgccttgacctctaaagggacaccttttccaggatacccatggggtatctccataactttgtcattccatgcaatctttgcagacaagattttgaggatattcacctttctccaggaacacaggtgtgacattactttgagtacatcctcctccaaggagactcatgtgacacactccttaaagacatagaagtctagtatctcttagcactttttgggttctgatggtaacacatcctcatttacaaaatttacttacaaattaaaatcagcaggcacttctgtgagtgaagtcagaaacatcttcactgtaaaggctttgacaacttcttcatacatcttctggagtttctaaaccacttatgatggtcatcaattgcctcacagcttccgatgaaacaaaaaacaaaataaaataaacaaagaactgcccctcttggcctgcatcactcactattaaaacaacaaatgattgactatctgctgggacctcctggaagcagaggctctcacagatcctgaacctgtgcttctccatacccagctccagttatggtttgggaaacagcaccccacaaacttggcaaggctaccgagggctccctaagacagtacgaagccaaacctgggtctctggtacattccacctgtgggagacggtggccttctgtcctcagtgttttgccaggtgctagtgtactggaggaggtcatccattccgctatattagtctatttttcatatgctatgaagaaataccccagactggttaatttataaagaaaaagaggctcaatggactcacagtttcacatggctgggaggcctcacaatcacagcagaaggtgaaggaggagcaaaggcatgtcttacatcacggcaggcaagagagtgtgtgcaggggaactgccctttataaaactatcagatatcatgggacttattcactatcatgaaaacagcatgaaaaaacatgaccccatgattcaattacaccttgctgggtccctgctgtgacacatgggattatgggagctacaattcgagatgagattcgggtgacacagttaaaccatatcacccctagaccctttgactgcctggaaatgttcatgggattaactgagtaaatagtaatgggagtttgtagactgtgtaaatggcactgtaagcatcttgcatcatggaactttgtgcaatgtgactgttttccactcctcagccagggtgtccttaataaagaatgacaccccaaaacaacaaatttggccaaattttaggcagttgtttcagcaccagttgccctggtgaacaaatgatcctattttcacattaattatcaactaatgagccattacctaaaaattatattcttcagaattaaaaaactctctaggaatctcttgcctcatagatactcaaacagcgatcgagctgataatcaaatcaagaacttaaccctttttccaatatctgcaaaactaaaagcaaaacttaggtatacacctaaccaaggaggtaaaagacctgtacaaggaaaattacaaaacactgatgaaagaaatcatagatgacacaaacaaatggaaacacatcccatgctcatgggtgggtagaatcatattgtgaaaatgaccgtactgccaaaagcaatctacaaattcaatatggttcccatcaaaatgccaccaacattcttcacagaactagaaaaaaaatcctaaaattaacatggaaccaaaaaagagcccacatagccaaaggcagactaaggaaaaagaactaatctggaggcatcccattacttgacttcaaactatactatgaggccatagtcaccaaaacagcatggtactggcacatagacaaatggaacagaatagagaacccagaaataggctgggtgcagtggcttatgtctgtaatcccagcactttgggaggctgaggtggatggattacttgtggtcaggagtttgagaccagcctggccaacatggtgaaaccctgtctctattaaaaatacaaaagggcatggtggcacaaacctgtagttccagatacttgggaggctgaggcaggagaattgcttgatcctgggaggtgtaggttgcagtgagctgagatcatgccactgcactacagcctgggcaacagagcaagactctgtctcaaaaaataaactaaaaaaggagaacctagaaataaagccaaatacttacagtcaactgatttttgacaaagcaaataaaaacataaagttgggaaaggacaccctgttcaacaaagggtgctggaataattggcaagcccatcaggctaacagtggatctgtctgcagaaaccctataagccagaagagagtgaatgccaatatgcaacattcttttttaaaaaagaattttcaacccagaattacatatccagccaaactaagcttcataagtaaaggagaaataaaatcctttacagacaagaaaatgctgaggaattttgtcaccactaggcctgccttacaagagctcctgaaggaagcactaaatatggaaaagaaaaactggtaccagcactgccaaaacacagcaaaatataaagaccaatgacactattaagaaactgcatcaactaatgtgcaaactaaacagctagcatcataatgacaggatcacattcacacataacaatattaaccttaaatgtaaaaaggctaaatgttccaattaaaagacacagactggcaaattggataaagagtcaagacccatcagtgttctgtattcaggagacccatctcacatgaacaaacaaaaaaacccaaacaaaatggggttgcaatcccaggctctgataaaacagactttaaaccagcaaagatcaaaaaagacaaagaagagcattacataatggtaaagggatcaatgcaacaagaagagctaactatcctaaatatatattcactcaatacaggagcacccagactcataaagcaagttcttagagacctacaaagagatttagactcccaaacaacattaatggaagaatttaacaccctgctgtcagtattagatcaactagacagaaaattaacaaggatattcatgacttgaactcagctctagaccaagcagacctaatagacatctacagaactctccaccccaaattaacagaatatacattcttctcagcaccacatcacacttattctaaaattgaccacataattggaagtaaaacactcctcagcaaatgcaaaagaacagaaatcataacaaacagtctctcagaccacagtgcaatcaaattagaactcaggattaagaaactcactcaaaacctcacaactacaaggaaactgaacaacctgctcctgaatgactactgggtaaataacaaaattaaggcagaaacaaataagttctctgaaaccaatgaaaacaaaggcacaaagtaccagaatctctgggacacaactaaagcactctttagagggaaatttatagcactaaatgcatacaagagaaaacaggaaagatctaaaattgacaccctaaaatcacaatgaaaagaactagagaagtaagaggaaacaaattcaaaagctaacagaagacaaaaaacaaacaaacaaaaaacccactaatatcacagcagaaatgaaggagagagagacatgaaaaaccctttaaaaaaatcaatgaatccaggagttggttttctgaaaagatcaacaaaatagatagaccattagccagactaatacagaagaaaaaagagaaaaatcaaatagacacaataaaaaatggtaaagggaatatcaccagtgatctcacagaaagacaaccaccatcagagaatactgtaaacacctctacacaaataaactagaaaatctagaggaaatggataaattcctggacacatacactctcccaagactaaactaggaagaagttgaatccctgaatagaccaataacaagttctgaaattgaggcagtaattaatagcctaccaaccaaaaaaagtccaggaccagatggattcacagccaaattctaccagaggtacaaggaagtgctggtaccattccttctgaaactattccaaacgatagaaaaagtgggactcttccctaactaattttgtgaggccagcatcatcccgatatgaaaacctggcagggacacaacaaaaaaagaagacttcaggccaatatccctgatgaacatcgatgctaaaatcctcaatacaatactggaaaactgaattcagcagcacatcaaaaagtttattcaccatgatcaagtcagcttcatccctgggatgcaaggctagttcaacataagcaaatcataacgtaatccattgcataaacaaaaacaatgacaaaaaccacatgattatctcaatagatgcagaaaaggcctttgataaaattcaacactgcttcatgaaaaaaactttcaataaactagatattgatggaacatatctcaaaataataagagctatttttgacaaacccctcaccaatatcatattgaatgggcaaaaactggaagcattcctttgaaaactggcacaaaacaaggatgccctctctcaccactcctattcaacatagtgttggaagttctggtcaggtcaacatgacaagaaaagaaataaaggatatttaaataggaagagaggaagtcaaattgtctctgcttgcagatgacataattgtatatttagaaaaccccatcatctcagccctaaatctccttaagctgataagcaacttcagcaaagtctcaggatacaaaatcaatgtgcaaaaatcacaaggatttttttttattattatactttaagttttagggtacatgtgcacaacgtgcaggttagttacatatgtatacatgttccatgttggtgtgctgcacccattaactcatcacttaacattaggtatttctcctaatgctatccctcccccctccccccatcccacaacagaccccagtgtgatgttccccttcctgtgtccatgtgttctcattgttcaattcccacctatgagtgagaacatgtggtgtttggttttttgtccttgtgatagtttgctgagaatgatggtttccagcttcatctatgtccctacaaaggacatgaacccatcattttttatggctgcatagtattccatggtgtatatgtgccacattttcttaatctggtctatgattcatggacatttgggttggttccaagtctttgctattgtgaatagtgccacaataaacatacgtgtgcatgtgtctttatggcagcatgatttataatcctttgggtacatacccagtaatgagatgggtgggtcaaatggtatttctagttctagatccttcaggaattgccacactgacttccacaatggttgaactagtttaccatcccaccaacagtgtaaaagtgttcctatttctccacatcctctccagcacctgctgtttcctgactttttaatgatcatctttctaacaggcacaagatggtatctcattgtggttttgatttgcatttctctaatgaccagtgatgatgagcttttttcatgtttattggccgcataatgtcttcttttgagaagtgtctgttcatattctttgcccactttctgattttttttttttttttttgagatgaagtttcactctagttgcccaggctggagtgcaatggtgtgatcttggctcactgtaacctctgcctcctgggttcaagtgattctcctgcctcagcctcctgagtagctgggattacaggcatgtgccaccatgcctggctaattttgtatttttagtagagatggggtttcttcatattgatcaggctggtcttgaactcctgacatcaggtgatccacctgccttggcctcccaaagtgctggcattacaggcatgagccaccatgcctggtctgtttgttttttttcttcaaaacctatttaagttctttgtaggttctggatattagctctttgttagatggatagattgcaaaaattttctcccattttgtaggttacctgttcactctgatgatagtttcttttgctatgcagaagctctttagtttaattagattccattagtcaattttggcttttgttgtcattacttttggtgttttagtcatgaagactttgcccattgctatgtcctgaatggtattgcctaggttttcttctaggatttttatagttttatgtcttatgtttaagtctttaatctatcgtgagttaatttttgtattaggtgtaaggaaggggtctagttttgggtttgctacatatggctagccagttttcccagcatgatttattaaataggaaatcctttccccattgcttttttgtcaggtttgtcgaagatcagatggttgtacatgtgtggtgttatttctgaggcctctattctgtctcattagtctgtatatcagttttggtacaagtgccatgctgtttttgttactgtaaccttgtagtgtagtttgaagtcaggtagcatgatgtttccagctttgttctttttgcttaggattgtcttggctatgcgggctcttttttggttccatatgaaattcaaagtagttttttctaattctgtgaaaaaaattaatggtagcttgattgggatagcattgaatctataaattactttgggtagtatggccatttttatgatattgattcctcctatccatgagcatggaatgtttttctgtttgtttctgtcctctcttatttccctgagcagtggtttgcagttctccttgaagagatccttcacatcccttataagttgtattactaggtatttaattcttttttagcaattgtgaatgggagttcattcattatttggctctctgtttgtctattactagtgtataggaatgcttgtgatttttgcacattgattttgtatcctgagactttgctgaagttgcttgtcagcttaaggagattttgggctgagatgatgatgttttctaaatatacaattatgatatctgcaaacagagaaaatttgattccctccctccctcccttctcccttccttcctttctttctttctctttctttttcttttctttttctttctttctttctctctctctctttctctctttctttctttcctttctttctttctttctttctttctttctttctctttctttctttctttctttctttctttctttctttctttctttcttcctttctttgtctccccttcccttcccttcccttcccttcccttcccttcccttcccttcccttcccttcccttcccttcccttcccttcccttcccttcccttcccttcccttcccttccctcccctcccctcccctcccctcccctccccttccttctcttgtctgattgccctggccagaatttccaatactattttgaataggagtgatgagagagggcatccttttcttgtgccagttttcaaaggaatgcttccagtttttgcccattcagtatgatattggctgtgggtttgtcagaaatagctcttattattttgagatatgttccatcaatacatagtttattgagagttttttttttttttttagcatggaatggtgttgaattttattgcaggccttttctgcatctattgagataatcatgcggtttttgtctttggtcctgtttatgtgatggattacgtttattgatttgcacgtgttgaaccagccttgcatcctagagatgaagccaacttgatcatggtggataagctttttgatgtgctgctggattcagttggccagtattttattgaggattttcatctaggtgttcatcagggatattggcctgaaatttctttgttgtttttgttgtgtctctgccagatcttggtatcaggatgatgctgtcctcataaaatgaattagggaggattccctctttttctattgtttggaataatttcagaaggaatgatagcagctcctctttgtaactctagtagaattcagctgtgactccatctggtcctggacattttttgattagtaggctattactgcctcaatttcagaacttgttattggtctattcagggattggacttcttcctggtttagacttggtagggtatatttgttcaggaatttatccatttcttctagattttctagtttatttgtgtagaggtgtttataatattctctgatggtagtttgtatttctgtgggatcactggtgatattccttttatcacttttttattgtgtcttttattcttctctcctttcttcttgattagtcttgctagcagtctatctatttcagtgatcttttctaaaaacctgctccaggatttattgatttttttgaagggtttttcatgtctctatctccttcagttctgctctgatcttagttatttcttgtcttctgctagcttttgaatttgttggctcttgcttctctagttttatcaaccgtgatgttagggtgtcgattttagatttttcctgctttctcttgtgggcatttagtgctataaatttccctctaaagagtgctttagttgtgtcccagagattctggtacattgtgcctttgttctcattggtttcaaagaacttatttgtttctgccttaatttcattatttacccagtagtcattcaggagcagtttttttttttttttcagtttccatgtagttgtgtggttttgagtgagtttcttaatcttgagttctaatttgattgtactgtggtctgagagactgtttgttatgatttctgtttttttgtattttctgaggagtattttacttccaattacgtagtcagttttagaataagtgcgatgtggtgctgagaagaatgtatattctgttgattttggctgaagagttctgtagatgtctattaggtcttcttggtccagagctgagttcaatttctgaatattcttgttaatttcctgtctcattgatccatctaatattgacagtggggtgttcaaatctcccactattatttttgggagtctgagtctctttgtagatctctaagaacttgctttatgaatctgggtgctcctgtactggatgcatatatatatttaggatagttagctgttcttgttgcattgatccctttgccattatgtaatgcccttctttgtctcttttgatctgtgttagtttaaagtctgttttatcagagactaggattgcaacccctgctttttttttctttctttccacttgcttggtaaatattcctccatccctttattttgagcctatgtgtgtctcagtatgtgagatgggtctcctgaatacaggacactgatgggtcttgactcttcatctaatttgccagtctgtcttttaattggggcatttagcccatttacatttaagattaatattattatgtatgaatttgattctgtcattatggtgttagctggttattttgtccattagttgatgcagtttcttcatagatcgatggtctttacaatttagcatgtttttgcagtggctggtactggttgtccctttccatgtttagtgcttccttcaggagctcgtgtaagataggcctggcatagacaaaatctctcagcatttgcttgtctgtaaaggattttatttctccttcacttatgaagcttagtttggctggatatgcaattctgggttgaaaattatttgcttaagaatgttggatattggtccccactgtcttctggcttgcagggtttttgcagagagatccactgttagtctgatgggcttcccttcgtgggtaacccgacctttctctctggctgccattaacattttttccttcatttcaaccttggtgaatctgacaattgtgtgtcttggggttgctcttttcaaggagtatctttgtggtgttctctgtatttcctgaagttgaatgttggcctgccttgctaggttggtaaagttctcctggataatatcctgaagagtgttttccaacttggttccattctccttttctctttcaggtatagcaatcaaatgcatgtttggtcttttcacatagtcccatatttcttggaggctttgttggttccttttcattattttttctctaatcttgtcttcacactttatttcattaagttgatcttcaatctctgatatcccttcttctgtttgattgatttggctattgatacttgtgtatgcttcacgaagttctcgtgctgtgtttttcactccatcagctcacttatattcttctctaaactggttattctagttagcagttccagtaatctttttcaaggttcttagcttccttgcattgggttagaacatgctcctttagcttggaggagtttattattacccacattctgaagtctacttctgtcaatttgtcaaactcattctccacccagttttgtttccttgctggtgaggagttgtgatcctttggggaagaagaggcattctggtttttggaattttcagccttttcgtgctggtttctccccatcttcataggtatatctacctttgatctttggcattggtttctgaatggacatcctttttgttgatgttgatgctatttttttctgtttgttagttctccttctaacagtcaggcccctctgctgcaggtctgctggagtttgctggaggtccactccagacactgtttgactggtatcaccagtggaggctgcagaacagcaaagattgctgcctgttccttcctctggaagcttcatcccagaggggcacataccagatgccaggcggagctctcctgtatgaggtgtctgtagcccctgctgggaggtgtctcccagtcaggagacatgggtgtcagggacccacttgaggaggcagtctgacccttagcagagctagtgcactgtgctgggagatctgctgctctcttcagagcctgcaggcagtggcgtttaagtctgctgaagctgcgccaacagccactccttcccccaggtgctctgtcccagggagatgggaattttatctataagcccctgactggggctgctgcctttttttcagagatgccctgcctggagaggaggaatctagagaggcagtatggctatagtggctttgctgagctgtggaggtctctgcccagttggaacttcgctgtggcttttttacactgtaaggggaaaaccaactactcaagcctcagtaatggcagatgcccctccccgcactaagctcaagcttagttcccaggtcgacttcagactgctgtgctggcagggagaatttcaagccagtggatcttagcttgctgggctctatgggggtgggatccattgagctagaccacttggctccctggcttcagccccctttccaggggagtgaatggctgtcttgctggcattccaggcaccactgggatatgaaaagaaattcctgcagctagcttggtgtctgcccaaacggccacccagttttgtgcttgaaactcagggctctggtggtgtaggcaccctggggaatgtcctggtctgtgggttgggaagaccatgggaaaagcatagtatctgggctgggactgttcctcatggcacagtccctcaaggcctcccttggctagaggagggagttccttgaccccttgcacttctggggtgaggcaatgccccaccctgcttcggctcaccctccatgggctacacccactgtctaaccagtcccaatgagacgagccgggtacctcagttggaaaagcagaaatcacctgccttctatgttgatctcaccgggagctgcagaccggagctgttcctatttggccgtcttgccaggtctgcccggtacaacatttcttaaggtcccagaaaggtcaaagattctgtgtattactgagaaacaaagggcctttaaaaagattaaggacatgcccctcaatcaaacaacagaggctctaggatacttaggtgcactgtttcttcaccatctcagcagaagcccaaggtgaaaagtttatctcaaagatatttgttggggtagattttctctaataagataaaccacaaagagattcacagaacatccacaactttttaaagaaatctttatcagaaaaatgctgccaatttgactgcaaggggcaaagacagtacaaaaataaaaaggctgtgtagtcctcaaaatgctctgggtgggaaggtagctgagaatactattcacttagaggtatgttctgtcttttaaaaaaaatgttggatccaagtggcacgaggctgtggctgagagccaaattgctttcatttttcatgcctccagacctattcaaggaacttctaatatttgcctaagtgcacttcataattgctctgaactccttgtgtctcacgtctcctccattttgaacgggaatgtctacagtagtaattggatgcttgtattattattgtgtgttgagtgttttggagacaagtgtcttgtctcttcagtttcacagattaacaaatacaaagataaaagccagagaactccatgtaagtagtctcacttacacttgaacctcatttaaatggtaagattctggactttgagtgtgtgctataatgaaataatacttttctggacatttcacacatgataatgtagtacatcagagggatggaatcatttgggaccagagggtctggccacaatctgccacagctgctgttccatgctgcggagaattcctgctggtccaaactgcccagtcttcctggcaccagcaggggagaacagcagactggagccacagtgatggttgtcttcttaggcagtctctgtcctgctgccactggctgcaacctgggcagccaccaagagcttgcacagctctgtgcttgggtcccaaggccctggtggtgtgggctcacgagggatctcttgatccatgggttgcacagatccgtggaaagagcgtggtttctcaggcagggtaccacaatcactcactccctcccttggctgggagtgggggctccccttactccatgcaactcctgggtgggccctcgttccatcttgctttttcttactctcagtggatcatgccaaccgcctagtcagtcccaatgagagaacctggatacctcagttgaaggcacaggatccactcaccatttttgctcttcttggtgggcgccaccaactgcagctgcttctaataggccatcttggccccctctgcccatctttttactgttaatggatattaacttggacctatgacctgagaaaccttatttattcactttttaaattcgaatgtttaattaattcattaattctgctatttgaattaatggcacagaggcctaagtctgaacacaaggggaaaatgaactctctaacccagaaatatatacaggtaatatgtaagtgagatagactcaaaggtcacaagttttaactgagactattagatggcattgagcatctaaactcctctcagtgtccttgtgggtgacatgcttcagtgacagccatggttgactgcctcctccagaaggagctctgccaggacacagaaagccctaaatatctcatccttaagccaagtcatcctgggttcttactttgcaaaaattacctattaaagctattccacaggatcagcatccaggttagaggtgcaatgtcttccaatcctgcgagtgccacagtgcttgcacaaccctcagattttataatgactatccactgcacataagcacttacactgcaggtaggaaaatatggccagtctaaaagtgtctgtaatgatttatctcacaggatctaggtggctaagaatattttcaaggccaataacactgtttcacaaatttgtgctttcaaacaggaaggcaccttctgcctcaaaccgctttcctctccctgtattgagctaacttctatatgtaaatgtaaaatcctgtaaactactctaaaaatcccttcttgaaacttctttgaatcctatttagatgtctttttctgtccttgttgatgcagtacaatgaacagatcatatccaactataatttctaattcaaacaccaagtattcttaatcagctgtagcttcctgaagtcagaaagagagatcagcacatagcacagtgcaaagtatacagttagtgcttactaaatatttataaaataaagaaatgaatatatcacctgaaaaatagccccaaagaaagttaaatgacactcacctgtctgaaagatggccatatattagacctcccagcagtgacccagccctaagtagggattgaatcattaatttttttttttttttttgagactgggtctcactctgtcacccagactggagtgcagtggtgcgatctcagctcactgcaacttccacctcccaggctcaagcaattctcctgcctcagcctcccaagtagctgggattacaggagtgtgccactaccacccgattaattttagtcactgagattcacataccaggtaccactagaagagaaggaaatcagcatagcagagcttgagaagagtttcagctcttttatggaaactgactccaaacactgacatatgtacacaatcctcagctatgcgggtcctgcctccctctctagattcatctatagacactacgctctagtagcccaaattctaaaactaaacttatttcaggctttcaaatgcagctgcctctccctctcaattcccagccttccaacagtctgtattcgtgtgtctacatgtctttattcattttcccctcagaccaccttttattgtgttgttatacacattctttgggtattataattaaaaacatataaggacacaatttttttaaaaaacttcagttacctaaatttaaaaaatatattagaaacccataattttacaggaaggctttttttcatcatgtaggccacatgagggccttgccattgacttcacttagcagtttataattcaactactacaataactatctttttttttggccacacattgaatcgcttgaagtgcttcaaaaatactgatccctggattctgtactcagaggttacttgctgtggatatcagttttgcaatgagtattgagaacactaacctagcataatgtttgccaaacagtatttcaattactttaaacactgtaggtctttctcactaaattagacgatataataggaggttcatgttgagtttgtttggctcattcactcaatactaatgcgcttgactgtattgtagagttggtgagcaattgctgctacctgctgaaggaatgaagaaagagctgataacagtaaccatctgaggactaagggtataaagcaagtctgttctttgtgttaactccaaacatcttgatcatataaacagaagatctaaacatgtccctttacatcagtcacaatggtgaagaggaaggagctttggtggtatacccagccaccaacacagggctccgtgtttggctcactcatgtttgagaaggtcacattcaagtgaaggagatgccactggggatggatgaagcaacgacacttctctggcctcaggtttgagtccagtgggatggaaatcctcaggagggcaacctggctgagagtcccagtgtcattgtcagagacggtgtcattgtccaggatgtggacccagtagtgatgaccagggatgaatgcaatgaaattctccaatagaagatgaggataatgtataatgatggagattgtaaggaaaatcagatgaaagatttggaatctccccaggccacccacttgatccaggagcatatcaaaacccatcgagacagaacaggtgatccccaagaggaagcacaatgactttgtagagataagttcagaagaagaaagtgttccctttcacaaagtcacagtagtgccatgtggatccttacaccattttcttctcagtgggccctgtcacaccactgcagaagagcaatggaaggactttcctcaagtcctttgagtttaggcagctagatagtttcagcgaagtcacagatataattatttggcaaaggtacatctatcttttgacaactgaatattcttaaaggactactctgtgaaagatcctgatctctgagctttctgagaagtcaacagtggactttcaggtggatataatttccacacaacctaaaatacacctaaaattatacctgatcaatggtatgccattcttttcagaaaagggatattggatacttaaaagtgtactgctttattatgctttgtgcaaagagaatggctttttcttgctgaggactgacttttgactaaaagttagtgaacactaatgaacacaagagtcttgctcttgtctaattaaagcaggtggaatgttaagtataaacattgacttttggtaactgaagttctgcttcagttcaaatcataccagtgacagtgatgttaagatttttgagatagggaaataaagataagaggtagacaggaagggaatagtgtctttatgtgatagtttatttcaccaaatttgttgattttttcaaatagcattttgaactttctgctgctattgctgtaaagcaatggtatttatttatatacttaatctgtttatatgtttataagtaaaatgtttatatgtttataagtaaaatatgacatcaatgttataaagtttcatattccagttaataagtgataggtacataaataattatactgtaatgtcataactataaagaaaatagacagtgtcctatggaagaattaaagagaaactgttcaatgattcctgggtaggtgccatgggacaaaggagtcatcactgtagaaattaacttttacctattcttaggggaagattcttgagataatgaaatagtgaatgaaaaaaagccaatttctaaatgagggaataataagtgtacaattataacaaaatggtgtggtataactgtgcacctataggatattgaaaagctggaagctgcaaaacatgaagggtattaatgagagaaggtaggttgattgaatgaagagccaaaccaaacaagcaaagcctgtagaatttattctgcagactaactagaggttcttatccttgaatttcaaaatgatcatccatgaaacatgttaaaatgcaaatttctgcccagcctgcaaggattctttttcaggaaacgattctgatggattcattctaaagattaaatctaaggaatcgtgagatgctgttgtaaattgttagaaatgtcttagtttgcttgggctgcataacagaataccacagactgggtgacttaaacaacaaaaatttattttctcacagttctggtggctggaagtctaagagcaaggtatcaacagatttgatttcttctgagcctctctctctggtttgtggatagctgccttctttctgtgtcctcatatgttctttcctttatgcatgtgcatacctggtgtctctttttcttcttcttctccttctccttcttcttttttcttcttcttctgggtttctgtttttttttttttttttttttttttgagatggagtctcactcttgtagccaaggctggagtacaatggcacaatcttggctcactgcaacttccgcctcctgggttcgagggattctcttgcctcagcctcctgagtcactggaactacaggcatgcaccaccacgcctggctaatttttttaatttttagtagagatgggatttcaccatgttgggcaggctggtcttaaattcctgacctcaggtgatccgcctgccttagcttcccaaagtgctgggattacaggtgtgagccaccgcacctagctctcttcctcttcttataagaagagcagttgtattgattagggccccaccatatgggcctccttttaacttatcaccaaatatggttatattcgaaggtattaggggtcgggattccaacataggaattttgaaggggcacaaatcaggtttctattttactaaaattactgaccactaaaaatagtgagaagtcaatgttccagcaaagcaaaccattcagagccacatgagtaaaatgataaaaaaaaaaatgatgattacagttgtgaattcactgagtattcaattctgttgtaagcacttttaacgtattctttccttcagttatcactaaattatctaaattttaccccttggaaaacagaggcctaggaacactaaataatttgtcaaaggatatatggagtgtaagtggtagagccaaaatatggacccagggtagtctaactccaaggaaaagcctcttactcactttaataaatacttattttcatctcattaattaaatgattgtttttatgctgagaaacaacgatggcctatctagagtcaagatggctggaagagaagaagctgaagccattgtgccccatcccccaaatctcccatgaaacacagaaaatccaaagaagaggaaattagtaagtaccatgatgaccaagtatagatacaaaaaggaaagagaatgagtgctctatagatcaaaatagtgatgtatccctagagtaataaggatgtaaagaagcatgcagagaaaaaagcattagtaaggataataatgatcactagtaatatattgacatttcccatgtgtcacacactggggtgggtgatttctgtgcatgtgttattcctcacaacaacccggtgagatgggtattaccctccttggtttacagggaaatgtaacatggagaaatcttgtaatatgccccattaagttgactgggatagtaagatgtgaacactgtataaagcctaacaaaatctggcatggagtccagtgttgggtacacagtggaggatcagactggtggcaattaggaaactatgagtaatgatacaaacactcacctgtaaaattctcattccaccctcatggcacccaggcttcttctgtttcacagattctagaattaattggacaaaagaagcccaggtactgtaatgagagtttttacactttcattctttcaatggaagaaagaggaaagctgctcactttcttgttgaagtcaaattcccattgggcaccaccactgctatccctgttttttgtgcctatgggctctgattttcatctattattttctttccttccaacattactagttgttttgctaacttgatttaagttctgtaagatgtttgaattgatttgttactgtgctcagttctttcctttgatctcattgatacctttcaatattgcaagggggcaaaactagtattcacatctctatttgcttaatggaagcaaactgtatactgaatcactggagaaattttggtagggcaatactgctgtaaaaactgaggcctcttcaacaagtctgcatagaaagatgccctaggaagatgctgccctcaaatctgaatatacctctcagtaaataagttgaatcagaaccttctttaccttctagggaggcaagataacccaggacacagacaaaagaattctgtattgtaagataagcttcatccaaggatcaccaaactcttgacatacagacagacagagatgtctcccaacttgtggaaataaaagtgacttcatcttggatgctaatctaccatgttgactgctgattaaccccaatcctgggtatgtctcttgatttctactttatttaccatctctcatgtaagaacatgtactcatcatgtatcctgcccttagatcaaagcaatttttttttagatggaatcttgctgtgttgcccaggctggagtgcagtggcatgatctcagcttactgcaacctatgcctcccaggttcaagtgattctcctgcctcagcctcccgagtaactgggactacaagcgtgtcccaccatgccaggctaattttttgtatttttagtagagatggggttcactgtgttagccaggatgatctcgatctcctgacctcatgatccacccgccttgacctcccaaagtgctaggattacaggcatgagccactgcacccggccagatcaaagcaattttaatgtcatcacacgaatgataggccatgacagacatagcattcttgtctgttctggagcatcacctttaattgtctgtatagagcacatacagtatttccctattgtctataagccctgggaataacagtgtggcgatctgtctgtcttgctgccactgaagaccatatgtctgtccataagtttcccgataaatcatcttctgcccacaaactggatttgtctcccttgttctttggttttatgactccttccccatttggggggtcattttgcatatatgttcctttcacaaaataattggaaatccatgcaggaggagactaggaaccaaagtttgggcaagagtaaggacacatcagtagaagaaattccagagtggtcctcttcatctatatggaatgatgttttctgtttactagatgcctgtagaccactgtgtgagtagggtaacacctcaaaagtgccaacgggtctagaatggttgctagtagaaagctgtctgaccactggggtaatgaaggttgctaggtggtgtcaacagtaggttggccactgttacagatttgcaagtggccacagaagtgtagttagcagctgagatgaaggtacaaaagctagagaaagtattacaattagaaaaaaaatgagaaatttcacatccatgttagcatctaatctgatggataagctcgaaactcaaagtcacaattggaaatcctagcctactgctgtgttttccagggaggaaggaagctgcactggccaaatgtgtgagtggtccttgctaaactggactggaatttttttgtttttttttttaattttattattattatactttaagttttagggtacatgtgcacaacgtgcaggtttgttacctatgtatacatgtgccatgttggtgtgctgcacccattaactcatcatttaacattaggtatatctcctaatgctatccctcccccctccccacaccccacaacagtccctggtgtgtgatgtttcccttcctgtgtccatgtgttctcattgttcaattcccacctatgagtaagaatatgcggtgtttggtttttcgtccttgcaatagtttgctgaaaatgatggtttccagtttcatccatgtccctacaaaggacatgaactcatcattttttatggctgcacagtattccatggtgtatatgtgccacattttcttaatccagtctatcatttttggacatttaggttggttccaagtctttgctattgtgaatagtgctgcaataaacatacgtgtgcatgtgtctttatagcagcatgatttataatcctttgggtatatacccagtaatgggatggctgggtcaaatggtatttctagttctagatccctgaggaatcaccacaccgacttccacaatggttgaactagtttacagtcccaccaacagtgtaaaagtgttcctatttctccacatcctctccagcacctgttatttcctgactttttaatgatcgccattctaactggtgtgagatggtatctcattgtgattttgatttgcatttctctgatggccagtaatgatgagcattttctcatgtgttttttggctgcataaatgttttcttttgagaagtgtctgttggtatccttcgcccactttttgatggggttgtttgtttttttcttgtaaatttgtttgagttcattgtagattctggatattagccctttgtcagatgagtaggttgcaaaaattttctccgattttgtaggttgcctgttcactctgatggtagtttcttttgctgtgcagaagctctttagtttaattagatcccatttgtcaattttggcttttgttgtcattgcttttggtgttttagacatgaagtctttgcccatgcgtatgtcctgaatagtattgcctaggttttcttctagggttttttatggttttaggtctatggactggaatgttaagacctgaaatttgtggggacccattggtgagtcagatgaagacacataggttctttcagggagggagaggataaccaacctccctttttgagagcaagaccgctcatacagcagaaagcaaatgcctaacacatgcagctgggcaatatcagacagccttttcagaaaacttaactgtctgagagtacatcttggcagaattattgtacataggaaaaatgtttgcgtagttgctgagagaaggcatagccacatggatggtgcagtatgggatactggtgtggatggcatttccctagcagggagtgaagctgaaaaaattagtaatataacctctcatcctcctttgaggaaacatttgcataatgctagaattcttgagggcaatcatagtcttacggactggattatcttggctatgatggaggcttggccaaatgacttcctgggtcagatttcagcatgaaaatatctggagaaagcacagggcgatttatgggagtttggcaagcatcaggtcatatatgcctaacaactttaggaccagataaagttgtgtttgccatgggcataaaaatcagtcattgcaaggtgccctttatgattggcatggttctttcatatccttcttgagctcccttgtgagacaagatgtatataatatggaggaagctatagctgatcctggagaaactgaaaagtgaagagataaggtccaactggttactaaagaaaaaggaaaaaatggagaagccaaacctgccagcctgaaaaaaggaggtctaaaaggcccagataggattaccaggaaacaagtgtggtatgatctgatctcacctgtgctagacaaagaaaaacatagaccagcaacccaatgccatattagtgggcctttggaaagacctcctcctgatcattagtttagactccttcttagtgccccaccaaaagaaaagaaactttacataaaattacttcaattaccatgttccagaggtggaagcctccccagcctggagactaggggtagggctaaggttgcttccatttgtgagcaacagggggcaactagaggtgccatgtgaagctcaaaatctagtggacttcaaaaaaaacaaagaaccttaacgttaatagacacagatgtagactgtatcttaattcatggaaatccagagatataccctggtaattgggcagctatagattattacaggggtgaacaatctgagtaaaacaaactcctctcctccttggtgttgagtggagtccccccggttagtatactgttttaatctcacctattccagaaaatatctttggtatggacatccttttaggatgaactttgatacaaaactaggcccattctgccagttgcatggaaagccaatcactgattagtgagttttgcaatacagaaaagatttattcacagggccacccagtcaggagatgacataatagctctcaaatctgcctttctgtagatagggcttggaatatttatgggataaaaaagcagaatggtctaaggtgtgggaaaaggtgattagcaatggaggtaaatgaggtaattggtgatctgcgcaaacatattcggagttcatagatcttcataggacacatattcagaaaatggcagtattagcaggatctgagggagaagtttttggccctatgacattaaaaggtcgcttgggcatttgaacagactcagttgaagggttggtggtctcaaccagttcaagctggacaaaggctgcccctaagttcctgaaaaagcaaacaattgttaccatggtgacatatacatcagaggtgttatctataaggaagctagtgaagaccaagttatagcatttggcagtatggctttcagctgtgtgggttaaaaaactctataagaagcaagtgactaaaaagattagactttggtttcaactttacaaatatctttgggagaattccacacaagtttgggcagtaaaagctattttgagaagggaatcaaaatgggaacctatatacatccctcccctagggtgcattatcagtatgatacactaccatcttcctggtgggatggaagagattacagccacggtacagaagcttgttgaagttaatattatatggccagctgagttctttcagtcttatgtgacaggtaaggaaacttgatggcacctggcacatgagagtaggcttccagaaattaaataaggtgattcctgagatacatgctggtattcctaatatagctcaagtgatagaacaactaatacaaactctaggcacttgccatgctatattagacttggccaatgctttcttcattattgctttataccctgacacatgggatcaattcccttttacttggaatggtcaataatggagagtccatgtgttgtcccagggttttctacatagccccactatttgtcatggaattacttctagatatttaactttatgcccactgccacctaccgttaaatggtttcattacattgatgatttgtgctaacctctgaagacttgtcagtgctatagcaacaccttgactcattgtacacccttctccaatccagaggatgagccattaattcccaaaagatacaaggcccaggatttcttgtaaagttcctcagtgtcacttggttggtaagacatgccttatcccaggtgtagccattaatgaaatacaacaatttcccacacttaaaaaatcagttacaaagtttcttaggtcttttgggatatttgtaggctttttgtccatatttagctctttgtgtcccctatacagactagtgaaaaattgaactagttggtactgcataaggagcaagatgaggcattacagaaggctgaaatactaggggctcaggcacaagccttaggctaccccctttggggtagaagttccttatagatcctggagatcagacttggtcagatgtatagtttgtgaatatttttctcccattctgcaggttgtctgtttactcttttgatagtttctttggggataccaaagtctttggatgtaactataagccctaagggaaccagttgggacctctggaaagtccagcatgggaaagcagttcccctaggattttggtcacaactagggaagggtgctgaaatctgctattctctgattgaataataggtcctggggatatctatggacttgcagccagttggacccataatttctggaaagatcaagtggtgtttgtttttagttctgtttatgtggtgaatacatttattgatttctgtatcttaaaccaactttgcattccagggataaagcctacttgatcatggtacattagctttttgatgtactgctggatttggttggtgcaggtttatttctggattctctatcctattccattggtctgtgtctatttttgtacctgtaacctcacagtgtagtttgaagttgggtagtgtaatgccttcaactttgttcttttttgtttagaattgcttttgctattcaggctctattttggttctatatgaattttagaatagtttttttttctaattctgggaaaagtgaccttggtagtttgatgggagtagggttgagtctgtagattgctttgggacttgtggccattttaatgatattgactcttttgatccatgagcatgggattttttcatttgtttgtaccgtctatgattttgtttcaggactgttttgtaattctcattgtagagatctttcacctccttggttagatgtattccaagctagtttttttcccaactactttaaacggaattgcattcttgatgttactctcaacttaaatgttattggtgtatagaaatgctggtaaattgtgtacattgaatttgtattctgaaactttactgaagtcatttatcagctctaatagccttttggtggcagctttagggtcttctaagtatagaatcatatcatcagtgaagagagataaattttcttctttttctatttggatgccttttatttatttctcttgcctgattgctctggttaggacttgcgtactacgctgaataggagtggtgagagtgagtatagttgtcttattccagctctcaatgggaaatcttctagttttcgactattctctatgatgtttactgtgggcttgtcacagatggctcttattattttgaggtatattcctttgatgcctagtctgtggagggctcttatcatgaaagaataagggattttatcaaaagctatttgtgtgtttatttagatgataattgagattttttttaaaaaattgtttatgtgatggattacatttattgatttgtgcatgtggagccaatcttgcatcctaggaataaagcctgcttgatcatggtggattagctttttcatgtactgctagattcagttttcaagtgtttagttgaggatttttgtatctgttatcatcagggatattggcctgatgtttcctatttttgttgtctttaactgatttttgtatcagactgatgctggcttcatagaatttgttttggaggagtcccttctggaaatcaaaaagtttctgagacaggtttcaatcaatttaggaagttgaaactctttcttccacttgttttattatattgataaagatttcaattatattttgaaatgtttaagtgagcttttcagttttattagctctgattgctttctctttaagatgtctacatttttattttctggattgcactacagatttctttgtgttaattttcaaccttatcttggatctcattgagtctccctgcaatccatgctttgaattctccatctgtcatctctctgcccccattttagctagagaccattgctgcagagctagagcaatatttgatggagtcaaaacatccaaattattcatgttggcagaattctgtttttttcttatctggacagggtagagtcttttggctctggttctctattcctgtgcatttctatcagtaggtttcgtattggtctttgaagtttgacccacaggccagtagatggtgtttgcaggtaagagccagctgctgcacaagcagatgggtatgagtctgttttttgtttactgtgaggtgctctctgttatttcaagggaagaactgaacagtggtgtgcctggtgtcctgagcttcctgttccatggggttgaggggacacagttgggcagagctggggttcctggcttgtgcacaaatatcctaatgtcaagtaaagacacctgtcctgatgagggtggttgggaagagctcctggtaaagtgccttgaagtctctggggggaagtttgactggactgcacctgctctgtcttagataggcaggaatatgatctgtttccctatcacacccctgtttcagggctcatgactcctagtcagaaaaatactgtagtctgtctcttggctgcaatgtggttgagagtcatgggaaatgcctgttttgtgactctctgtgggagtgattctggtgcacattctcatcactttatctgaaacagatagcatttagacccacctgttctctgatgcagcagcactgctgcttcttgtaaaattggggcttcacctttgggcgcttgtgagtgagtgaatgttggttatggtggtgtcagctgggttggcctgacccgaggccttgagggaaggtgttaagtgcaagcagagttggaatgggttaggtagttcttcagttcccaggcccctagataaccttctggacagcatgtatgagtcctgaaggcgctggactatggtcaggctagcccagagtttaggtgttggctgtgttgggtggtgggtgggttcctgggtcaccagccaaactctcagggaggggaaggcagaatgcttaggtggtgggagtctgaagaaatatcacaggcctgttggggttgggtttttagaagggctgtgggcttcagatgagatgttcaggttagggcagagtggctttgctgtgggccattcactggagatggctggaacctccacctggggcaaaggagactggtggctgtgaggtatatggcatgattgcacttccctcccacccaaatgatgctgaacttcactgtcggaggcacacaaaagtgccaagcattgtctgtttcctctgggagttttgcagagctgcagagctgcaacccactgcaatgttcaggcaggggtggggttactgcactggaagcccaagccaagccttgcgtggctcagagcagtggggcatgagtcacatggtctgccatccaggcggttcatggaagaatgctggtaagagttggaattggttggataattctccagttctacctccagttgcccacccgtagaattcaagcaagggctgggctgctgtgctggcagcccaagtcagctagttttgtttggctcagagcagtgtgggcaggggttacacattttaccatatgggctgtttctggggtaatgctgagctgtgcccatccacagaattcagacaaggatggagtggctgtagtggaagactgagtcaagccttgcctagcaaggagtggggtagcctgactgcttctccacactgtgagtttggcctctactggggatacggcagctgattctgggctgctcagggatctaggacccgtagatctccatgtggacttgagtggtgtctttgcaaaaactccaggaggctctcagtgttaggctagaagcctgatgggtggggtctgagggattcaagcatgttcagggttatgaagacttgtgtgggaagtgtggacccccttgtgactctcattcactcaccctttccccatgttagggagcttcttctagcttcataccagtcctaggtgggcagctgcccagttttgctccttttttttcctctgtgggtcccctcacttcctcagtgaaatccagtatggtgtcctagatgattctcttgaagatctgctatttacttgccactttgtctcctctctgtgagagcagcacatgatatctgcttctagtcagccattgtaaagtatgcctagttctttgaatgttaaaatttgtcagtaaaaccatctagtcctaaattttgctttattgggagaatttttattactgattccaaatttttcctctttattgatatgttcaggtttttatttcttcctgatttaatcttggtagattgttggcatctaggtatttattcatttcctctaggttttccagtttcttagtgtacagttgctcataatagtctcaaacaatcttttgtattcctgtgatcgctattgtaatgtctcctttttcatttctaattttatttatttggattttgtgtcttttcttttcttggttgtgtagctagcagtttgtccattttgtttgtcttttcaaaacaccaatctttcatttcattaggctttgtgctttttaaaaagtctctatattgtttggttcttttccaatctttattatttctttcttgctattaattttggggcttgatttattcctccttttcaggttccttgaggtacactgtgatattgtttatttgaaaccttatttgaaataagcatttattgctataaacttcactttagcaaaacttttgctgtatctcttagtctttaatgtgttgtgttttaattttcatttatttcaagacattctgaatttcactttttaatttctttcttgacccactgattattccagagtatgtcatttaatttccgtgtgtttgtatagtttccaaagttcctcttgtttttgatttctggttttattctactgtggtctgagaagatattggatatgattttaactttttaaaatttattgagacttgttttgttggctaacatatggtctaccctgaagagtattccatgtactgataagaagaatgtgtgttctgtaactgttgaatgaaatgttctgtaaatgtctatttggttcatttggtctaaagaacagtttaaatccattttttgattaattgtctatctagatattctgtctaatgctgtggttggggtgctgaagttcccaagtattactatattgaaatctacctgtctttttagatctagtaatattcaatttatatacctgggttccccagggtggggcatattctatttagaattgttataccctcttgctgaattgatccctttatcattagataatgactttctttgtctctttgtactgtttttgagttaaagtctgttgtatgcaatagaggtatagtcaccctgctcacttttggtttccatttacatggaataccattttctatccccttactttcattatacatgttgtctttacagagaagataattttcctacaggcagaatatagttggtaatttttaaaaatccatttagcctgtctatatcttgtcagtgtaaagtttaatctgtttacaatcaaggttgttattgatatatgagggcttattactaccatttattacttgatttctggtaattctgtatgctctttgttccttactttctctcttattgtttatcagtgtggtttgttggcttttgacagtggtaactgtctgtttgctctaccagtgagttttatactttcatgtgtattcagggtagtattaatagataacattctttcacttccaggtttagaaatcccttaagcatgacttgtaggatttgtctagcatttatcaattacctcagcttttgattgtctgggaaagactatttctcttttatttatgaagtataactttgctaagcattgtatccttggatgaaagatttttctttctttcgacacttggaatatatcatcttattctctcctggtctgtgaagtttctgctaagaaatccattggtagcctgatgggggttcccttataaggaatgaaatgcttctcttttgctgaatttagaactccctgtttgtctttgacttttgacagtttgacaagaatgtgtcatggagaagatattgagttgtatttatttgggaatgtgtgcacttcctatatctggatgtctaaatatcttggtagacatgggaaatattcacctactattttgtcaaattggcttcatatttttttcatttgctcttcatcttttgggacattaaaatttcaaatgtttgatcactttgtggtgtctcatatgtcacaaagcctttattcataccttatttttctctgttatttttgtctgagtgtgtgatttcaaaagacctgtttcacattatgaaattttttcttctacctgatctcgtctacatttgaagcctttgggcatatattttaatttcatttaatgaattcttcagttcctggatttcgatttggttctttttttaatcatatctatctctctggcaattttctgattcatatcccgaatcgtatttgtgatttctttatattctttgtgtgttctctcgtatcttattgaacttctttaatgttaatatttttaatctttttcctggcattttataaatttcttttttatttgaatctgttgctggagaattattgtgatttttagaaagtatcccatttccttgctttttcatatttattgtatccttatattaataatattgatatctgtggatgtggtataaccatcatttcctttttttaatctgctttcataggggagaactcttttcttttatttttcattattatactttaagttttagggtacatatgcacaaagtgcaggtttgttacatatgcatacatgtgccatgttggtgtgctgcacccattaactcgtcatttaacattaggtatatctcctaatgctatccctctcccctcccacaatcccacaacaggccctggtgtgtgatgttccccttcctgtgtccacatgttctcattgttcaattcccacctatgagggagaacatgcggtgtttggttttttgtccttgcaatagtttgctgagaatgatggtttccagcttcatccatgtccctacaaaggacatgaactcatcttttctgatagtttatctatggttttggtttgtatggtattttggctttgattttgggtgctgtaatagtatagtcttcatatgatttcctacactgtaaagagtgtcagtgggcactgtctcagtggcctcaggagtggctctaagtggaggctgtggtgaaattttgttgaagatggggacaccagttgggccagtgctcaggtcacagttgtggcagctgcaggccaagcatacctgtccttggactccagggcattgcctgctggcagtggtgttagcagttatgggctagttgattcttgggcctccaggcaacttgctcagttgccagtagtagcaacaatgggttatgctagtggacaggttcttaggtcttttgggcagcatgcatgaaatgggtgatggcagtagcagtggtggaagtattctctggctcacaagtggtctgcattggtgttagcagtggcagtgatggactgcactggccagtccccaggaccacaggtgatgcatagagatgggtgctagctgtggttgtagtgacaggctgtgtgggctgcttcttaggctctaggaggagtgctaagtaccaatagtagtggacactgcaaggagattccccagatccttggatggagtgctcaggcactgggagtggtgggcggagccagacctagtggtcctgtccttgggtcctctgctattgtatatgggtggtggctttgttgggcaggcatggagttatcttcagacctttgcagagtgttatgatgggggtgacagtggtggcagtgagtggggagtgagtgccctcaaggcacatacaaatatggtgccaccctactactgtagacagcaaagttgctgccagtttcttgctctttggcccggagaaggcaaattcagggtgacctgctgctactgggagcaaccagtggttcatgcttcagcctggtggcagctgctagcagcagtggtggctgtttcccaaatggtgccataggctgggctcccccaatgatgccatgctgtagccgcttaggtcttgagggggaggttatgtgagatgcagcatgacctccctctctggagcaatgccattgcacagtcttcaggcagttccttatgttagtctgaaaacccacagtgctctaggtgctatcccatggctaggactacaggagtctgtggaggaaatgtgaaccactggggatctctaacttacccttttcctacactgcggaggctctcttagctgacagacaatgctaatcaagcagactgccctgcttccttcttcattcttccctagatgtttcctgtcactccttggcttaattcttgtgtttccttttagatgatctatttgaggtgttattatctacttgttattttggttcttctttgtggagatggcgagttccagatgcctttaatcagccttctagaagccaattctatatttttttcactaggacttaatcatacttgttctagaacatcatgtaaatggaaattataaactttgtatttttgcatacagtttcttttttcaatatagtatatgtgagattaatgcatgcttttgtttttatcagcattctatttctttttattgctgagtaacattacatttggatatggatgttaacaacttatccatattgctggatggatgttgttattggacatatggctttttttcagtttatgttttgtaaatgcagctgctatttacatattcttttatgaaatcttatggacacaaatatttggtaatatttggtgatttttatttactaagtaggcttatttttaactttataagccttttaacagaactttataagacctgagcagcaggtttatttccaaaagtatggagaattacattaaatgtaatttaatggactaaatactgcaattaaagggactaaatataccaattaaaagtcacagttttaaggcagcattgaataggtgtcccatctaaatgctgtctacaagtggtagatttaaatataaggacataggtaggttaaatgtaataggatgtagtaaaaaattgattttataggtttcatgtaattcttatgaaaattccaggaagttattttttagatataaacatcttaattctaaaatgtatgtgggaagaaacaggccatagaatagctaagtcaattagactcccacacaataatagcgggagaatttaacaccccactgtcaatattagacagatcaatgagacaaaattaacaaggatagcaaggacttcaactcagctctagaccaagtagacctaattgacatctacagacctctccaccccaaatcaacagaagatacactcttctcagcaccacattgcatttattctaaaattgaccacacaattggaagtaaaacactcctcagcaaatgtaaaagaatggaaatcttaacaaacagtctctcagaccacagtgcaatcaaattagaactcaggattaagaaactcactcaaaaccgcagaactacatggaaactgaacaatctcctcctgaatgactactgagtgaataatgaaaagaaggcagaaataaagatgttctttgaaaccaatgagaacaaagacaaaatgtaccagaatctctgggacacattttaaatcagtatatagagggaaatttattgcactaaatgcccacaagagaaagtgagaaagatctaaaatcaacaccttaacatcacaattaaaagaactagagaagcaagagcaaacaaactcaaaagctaccagaagacaagagataactaaaatcagggagaattgaaggagatagagacatgaaaaacccttcaaaaaatcaatgaatccaggagctggttttttgaaaagatcagcaaaatagatagaccactaaccagacaaataaagaaaagagagaagaatcaaatagatgcaataaaaaatgataaaggcgatatcaccactaatcccacagaaatacaaactaccatcagagaatactataaacacctctacgcaaataaattagaaaatccagaagaaatggataaattcctggatacatacaccatcccaagactaaaccaggaagaagtcgaatccctgaatagaccaataacaagttctgaaattgaggcagtaattaatagtctacctaccaaaaaaagtccaggaccagatggattcacagccaaattctgccagaggtacaaaaaggagctggtaccattcctactgaaactgttccaaaatatagaaaaagagggagtcctccctaactgattttatgaggctagcatcatcctgataccaatccgggaagagacacaacaacaacaaaaaaagaaaatttcaggccaatatctctgatgaatattgatgtgaaaatcctcaataaaataatggcaaacagaatccagcagcacatcaaaaagcttatccaccactacgaagtcagcttcatccctgggatgcaaggctggttcaatatacacaaatcaataaatctaatccatcacataaacagaaccaatgacaaaaaccacgtgattatctcaagaggtgcagaaaaggccttcgacaaaattcaacaccccttcatgctaaaaactctaaataaacttggcattggttgaacgtatctcaaaataataaaagctacttatgacaaacccacagccaatatcatactgaatgggcaaaagctgaaaacagttcctttgaaaactggcataagacaaggatgccctctctcaccactcctattcaacatagtattggaagttctggccagggaaatcaggccaaagaaagaaagaaagggtattaaatgaggaaaagaggaagtcaaattgtctctgtttgcagatgacatgattgtatatttaggaaacccagtctcaacccaaaatctccttaagctgataagcaacttcaccaagtctcaggatacaaaatcaatgtgcaaaaatcacaagcattcctatacaccaataacagacagccaaatcatgagtgaactcccattcacaattgctacaaacagaataaaatacctaggaatccaacttacaagggatgtgaaggacctcttcaaggagaacagaaagccactgctcaaggaaataagagagtatacaaacaaatggaaaagcattccatgctcatggatatgaagaaacaatattgtgaaaatggccatactgcccaaagtaatttatagattcaatactatctccgtcaagctaccattggctttcttcacagaactgaaaaaaaaatactttaaatttcatatggagccaaaaaacagcccgcatagccaagacaatcctaagccaaaagaacaaagctggaggcatcacactacctgacttcaaactatactacaaggctacagtaaccaaaacagcatggtactggtaccaaaacagatatatagaccaatgaaatagaacagagccctcagaaataatgccacacatctacaactatctgacctttgacaaatctgacaaaaacaagcaatggggaaaggattccctatgtaataaatggtgttgggaaaactggctagccatatgcagaaaactgaaactggaccccttccttacactttatacaaaaattaactcaagatgaattaaagactttaacataaaacctaaaaccataaaaaccctagaagaaaacctaagcaataccattctggacataggcatgggcaaagacttcataactaaaacaccaaaagccatggcaacaaaagcgaaaattgacaaatgggatctaattaaactaaagagcttctgcatagcaaaggaaacaatcatcagagtgaacaggcaacctacggaatgggagaaaatttttgcaatctatccatctgacaaagggctaatatccagaatctacaaagaactttaaaaatttacaagaaaaaaaaaacccccatcaaaaagtgggcaaaggatatgaacagacacttcccaaaagaagacatttatgtagccaacaaatgtatgaaaaaaagctcatcatcactggtcattagagaaatgcaaatcacaaagacaatgagataccatctcatgcctgttagaatggagatcattaaaaagtcaggaaacatcagatgctgaagaggatgtggagaaataggaacgcttttaggtgttggtgggagtgtaaattagttcaaccattgtggaagacagtgtggtgactcctcaaggatctagaactagaaataccatttgacccagcaatcctgttactgggtatatacccaaaggattataaattattctaccataaagacacatgcacacatatgtttattgcagcactgttcacaatagcaaagacttggaactaacccaaatgcccatcaatgatagactggataaagaaaatgtggcacatatacaccatggaatactatgcagccataaaaaagatgagttcatgtctttgtagggacatggatgaagctggaaaccatccttctcagcaaactgacacaagaacagaaaaccaaacacttcacattctcactcataagtgggagttgaacagtgagaacacatggatgcagggaggggaatatcacacactggggcttgtctgggggtgggaggctaggggagggatagcattaggagaaatacctaatgtagatgatgggttgatgggtgtagcaaatcaccatggcacatgtatagctatgtaacaaaactgcacgttctgcacatgtatcccagacttaaagtataataataaaaaaaaactaaaaaaataataaggtcaagtatggtcaagtacatagagatagggaatggaatggtgtttacaagggctggggtgtgaggggtgggaagaagtggggagatgtaagtcaaaggatacaaagtagcctatatgtaggatgaacaagttgaagtatctcatgtacaacaggagaactgtaattaataacagtatcttgtgtttttgataaatgaatagattatatgtgcttttgccaaaggggggaatgggtaacttttcccatttgtgagatgattgataggttaattggttccactatagttagcattttatatatctctatatatctttatctatatatatacatatgtatcttataacatcatgttgcttatcttaaatatgcacaataacattgattttaaaaaaacaaacaattgtatatacattctatggaataatattcagcaataaaaaggaacaaagtattcatatatacagcaacttagatgaatatctgtagagtttctgatttttcaaaagccaacctgagaaggatatataccatattattctcctagaaggagggatatctgtggagatgtaactgttcactatcttgattgtgatgatgggcacactaaattacacacataaaattgtatagtactatatgcatacacggatacagataaaccaacaagggaaatattaataaaatcagtagattgtatcagtatcaagatcctggtattatactacattgtatcatactagcatcttgatgttgatacaatattatactacagttttgtaaaatattaccattagaggaaacagggtgatgagtatatgattactccttgtgttatttcttgcaactgcatgtaaatctataataatctcaaaaaacatttcattaaaaatctaaaacatgggaaagttatctgatgcaaactataagaaacctggcatagccatgttaacgttaaaaaatatataattcaaaatgaggagcatcactagagatagaggcatagtttataacaataaaataaacaatttatctggattcccaaaactaacatggaaaagatcttccaatgtgctatatataaatgaataaataagcccaaggaaataaactcctatatgagctgaacactgcctttctcttctatttatatttcatataatttaaagttatgtgagttcctcatgtgatttaacctgaagcataatatcagttaacaaaagatagtaatggcatcacattccaatttgctttaaaaagcaaaacatggtaattgggatttgcatttattcatcattttaatctaaattcagtactaaaggagaaaaaccctgactttctgctcttttcatggaaaaattataaagcagtttacttttgtgtctctcaaatttcacttcctagaaataacaacactgtttaaccgatttcttttagcttatttagagaacatgtacatgccaaagtccaatgtaaatttcatgagtcacttgaggacaaacatatttggagagagtaaacctttaaacggattttattgtcaacagctagaagtatctctatgaaataatgatctctatgactacaaaataacatctacctcctgatagcaaaagaactgaggaagctctttccactacggctgtattgcactggtgagtccgggcccatggatgagaaattgatgcgaggatcaatacaagcttaatttgaattaataaaaggaaatattttctccctttgaacttatctccgtaaagccattgtgcctcctcttgggggtcacgtgttcacaatcaatggcctttgaggagctcttgagtcaagttggaggccttgggagatttcagatgcttcatctggtttttattcttccctctctcatgttattaatccctcatatactgctagagaactttgctgcagccattcctggtcatcgttgctgggtccacatgctggacaataatactggatctggtaatgaaactggaatcctcagtgaagatgccctcttgagaatctctatcccactagactcaaatctgaggccagagaagtgtcgtcgctttgtccatccccagtggcagcttcttcacctgaatgggactatccacagcacaagtgaggcagacacagaaccctgtgtggatggctgggtatatgatcaaagctacttcccttcgaccattgtgactaaggtaaagggtcctgttaacctgttctggatacacaatccaggtgtttagaagaaaataaacatgctttaagcctctagttattgtgtagatagtgtagtcagcactcagacactcttttggcaaatagtgattgctcttttttttttttttttttttttttttgagatggagcttgactcttgttgcccaggctggagtgcaatagtgagatctcagctcactgcaacctccacctctgaggttcaaacaattctcctgcctcagcctctgaagtagctgggattacagacatgcatcatgacactcagctaattttttttctttgtatttttagtggagacaaggtttcaccatgttggccagacagatctcaaactcctgacctcaggtgatccacccgaaagtcctgggattgcagatgtgagccaccgcacctggctacttattttttaattgtcaggcacttacattgaatttgaggcaatgaactcaaccaactagatataaatacagctatcacaaaactagcttgaagagaagactaatgattagaaaaatattcttcctggtcacttgttctcagcctaagttgcaaattggaaacatctgtgttatttttaaaatctgcctgctttggctacatgttacagaagcaaatcagagtggatttcatactagcatcaatggtttaaaaagtctccttaatgtgtttaatgtgtaacaaaaattgagaaccactgaggtatgcagtgctgaatgaatataaagacagacattaacataacctggaaggttttgtgtgaggatttccagagaaatccatgcttaagccaagacttgaatggtataggtaagaaaatgtagtaaaaagaggctagagagtgtgtccactgaaagctattgcagcaagtgaacaatgagaagtcaaaagctgctgtgaagctatgctgtattggcttccttctcttccagtgggacctggtatgtgattatcagtcactgaaatcagtggttcaattcctacttctgactggaatgctggtgggaggcatcataggtggccatgtctcagacaggtgagtgtctccagatcagggttatcattactctgcagtgtttttatcagcttacaattaatttttttcacaaagaagtgttattgagttacaatatgcaatttacactgttggtgctgctctgttccccagagagttagatacagaaatgaattacagtgagtttagtgagtgccattttgttgccacagagatctctgaacagcatctctgtataggatactgaatacaaaaatatcaaaatagagaattcatcctccttgaagatacaaatatatgaaatggtgtgtagaccttggctagggatattgtgttaagtccctcctggactctgtgagctaaatgcttgtgggctccccagcctggttgtcattatcataattaccccactgtaattagtaggagtattagtctattctcatgctgctaataaagacatacctgggactcggtaatttataaaagaaagaggtttaatcaactcacagttccacatggcttgggaggcctcacaattttggtggaaggtgaatgaggagcaaattcatgtcttgaatggtggcaggcaagaaagcatgtgcagggaactcccctttataaaaccatcagatctcatgagacttactcactaccaggagagcatcatgggaaaaaccagcccccatgattcaattacctcccactggctccctcccatgacacatggggattattacaattcaacgtgagatttggttggggacacagagccaaaccataacaatatgaattttaaaataatagtttttagctctgtgaagaatctcaatggtagtttaataggaatagtattaaatctataaattgctttgggcatgtattagtccactctcaccctgctgtgaagaactgcctgaggctaggtaatttataaagaaaagaggattaattgactcacagttcagcatgactggggagaccccaggaaacttacaatcatggtggaaggggaagtaaacacattcttcttcacatggtagcaggaaagagaagtggagggtgaagggggtaaaagccccttataaaactatcagatctcatgagaactcactcactatagtgaaaccagcatggagataatgccttcatgattcaattacctctcaccaggtccctctcataacacatggggattatgggaactacaattcaagatgagatttgggtggggacacagccaaatcatatcagggcagtatagccatttttataacatggactctttctacctataagcatggaatgcttttccatttttgtgtgtgtcatctttgattttttttttttttgagtagtgttttgtaattctccttgtagagatctttcacctccctagttagctgtattcctaggtattttattcttttgtggcaattgcgaatggcattgctttccttatttggctctcagcttgactgttattggtgtataagaatgttagcgatttttgcacgttgatattctatcctgagacttgctgaagttgtttatcagcttaaaaagcttttgggctgagactatggggttttatagatacagtatcatatcatctgcaaacagggatagtttgacttcctctcttcctatttggatgctctttatttcttactcctgcttgattgccctagttaggacttccaatactgtgctgaattggagtggtgtcttgtgccagttttcaagacgaatgctttgagcttttgcttattcaataagatgttggttgtgggtttgtcatacatggatcttacttttttgaggcatgttccttcaatacctactttattgagagtttttaacatgaaaggttgttgaattttatcaaaagccttttcttcatttatttagataattgtgtggtctttgtctttagttgagtttatgtgatgaatcacatatatttatttacaaatattgaaccaaccttgcatcccagggataaagcatacttgatcatggtggataatttttctgatatgctgctggatttggtttgccagtattttgttgaggatttttgcattgatattcaccaaagatattggcctgaagtttttgtgtttttttttttgttgttgttgttgtttttgtaatctctgccaggttttggtatcaggatgaagctggcctaatagaatgagttagggaggagaccctcctccctaattttttggaatagtttcagcagggatgttgccagatcttctttgtacttctagtagaattcagctgtgattctgtttggtcctgggtgctttttaaaattattacttatttatttatttattattattattattattattattattattattattttggttgataggcttgttgggtgtttttctgaggtgattagatttgattcctctttctgtctttatcatttgtttattggttctcctagtactttatagttttacttgctttcattatggtaactgccatctctctacttcaagatgtaagactccctggagaatgtttttggctgtttctgtggtggtaattcctttagttttcacttgtctgtgaaagattttatagttctttcatttctgaagcatagaagaatttttctgggtataatattcttttctgacaattttttctttcaggactttggatatattatccaattttctcctgccctccaaggtttccactcagaaatttgctgttagtctaataggaattcctttatgtgtgactcaatgctttcttcttgctgcttttagtactttttctttatctttgcttttttgaaaatttgactataatgtgcctgctaggggacctgtttgagttgactctatttggcattctttgagcttcttgtaccaagatatccatgcttatcccaagacttgggaaattttcagctatcatatcataaagtatcataaaatatattttctaaccgtttcacttcccttcttctggaattctcataatgcaaatatttattcacttactggtgtttatacattcggtaggttttcttcattctttgtaattcttttttctttcatctgcctctattatttttagcaaactgtctttaagctcagaaattatttctgcttgttccagtctatggttgaagctgtcagttgcatttttttttacttcattcattgaatattcaactgtaagatttctgtttggttcttttttatatctatgtctttgttaaatttttcatttaaataatgtattgtttttgtaattatattgaattgtctatagtttcttgtatctccctgagtttctttaatattgttattttgaattcattttctggcattttgtatatttgtctataattggggccggttacaggaaaattattgtggtcctttaaatgtgtcaaatttctttcctttgtaatgtttgatttgtctctacattgatttctttggttgagtggaaaggttgcctcttacaattttatgaagagatttcataaggaaaggcttatttgtatgaatgggtcttgtgtcgtcagttttatggggtgtgtcaggctttggttctaggtgggcacagtagtattctttctgtgtagtttcttcagctttaacctaggctagtgacatgtgctagtgtcttagtggcataggctgcaagagttggttatggttgtggtaaggctttgctgggggtcggcttgccaggctgtttctcagatgtggggtgcatgcatgcacgtggtgatttggccaagttaagccaagttagacttatggagctattattctggccaggaacacatacatgaggttgctctgccaggctggtggcaagcctgccagtagtcccccacagggctgttttctcagacccaggacatgggcacacagctactcagccagcctggaggtctgagtgccagcgaagctttcagttgttctgacatcctgattgcaggtgcagggccattgggcataccaagggcttgtctgcagggggtggagcatcatggagctatcctcaggttctagaaagaggagcataggagcaggctttactggctggaaggctgttagttgcatagagttccagggtctttcccccttggggaagggtatgcagcagtttagctggctcaacagtgggttcaccctgggcagaattgccagattgtttttccagatgaaaatgagggtggtgggatttgtttctctgctttgtaggaccagagccaccactgatcctaagcccagactctgcactgctggggttgtggtgttcagtcactgatgtgggcttcatggaatgaagatagagttccagtgctggagaggtgcagtggctactggcccccaggacaggatgcactccagaggtggctctggtctcaagatggtgccatgctgcaacagcttgactcacaagggataggcgtgacctggggaataatactttgtgcccctaatctgggcaatgcagttgggtaaattttcggcagctctcttttggactcaggacttgtgcggactatgaaattctcctatggtaagaactgttgctgtttgtggtggcaatggagactggtgggttcttctgctacagaggctgggtgcctccatgctgccctcctggacttccaatctccacaggtgtgtctccaccccctcgctgcattgcagtgctctcccttccacactctagtgaaatcttacctgtttatttgttgccttggtttttttctcattggtgtgtgggttggggggaatgagtgtcaggagtctctacttagctatcttgctgataccactcctctagatactatttaaatatatctagagttccatttcaaatgtagaacagttcccaacccaaaactttgtttgttaatattactgggcatatacaataagcacaccccatttagtccaagttgtcccctttaagacctgtctttacaaacaccctgtaaaatgccaaatttcctttcccttttcagccttcactttctctctcccttcactctactttctacgtatttttttcctctgagaagtttctgtacttttctctttctgggttgtggctctcttatattttgttctagctggaacacagaggcctataaacccagatcaacaatgggagtccatgtttctttatgagagcctcttaggcaacccaacagaaactttgatgcattgttccactgatgtatcttatacataagtttagccttggcctgcatggtcttagagacccaaatacatatttagctcccttgtatttcatatactatgtagactctctactatgctggatacatatgtcaatatagtagatacttattcatattacaatttccaacattgtagcttcttttctacagtatctgttggtatcagaggccttcttattattaagtgatgaaggtttgattttgatattgttagtgtatattataaacagggagggttacttctgaggatatttctgtgtcaatttagctcttgatatttcaggatttaaagtacacaaaataattagttaaaatattatcaaattttagagtgagctttcattttcttaagtttttaccataaattattattgctgtcataatctaacatgactcgctgtttctcaggtttgggcgaagatttattctcagatggtgtttgctccagcttgccattactgacacctgcgctgccttcgctcccaccttccctgtttactgtgtactacgcttcttggcaggtttttcttccatgatcattatatcaaataattctttgcccagtaagtcaataattgtgatcttctctattttatgaccctttaatttgaccttgaaatttcatctctatttgaccttaaatgctatatgggttttctttcagttactgagtggataaggcccaactctaaagccctggtagtaatattgtcatctggtgcccttagtattggacagataatcctgggaggcttggcttatgtcttccgagactggcaaaccctgcacgtggtggcgtctgtacctttctttgtcttctttcttctttcaaggtaggagctttctctctcactttgccttatggggtcctgggatgaaaatgaatattgaataagaacatattgattttcttattgccacttctggacctagacccatgttctcatttattcactctgtgcagcttgagaaaaaatggtaaatagcaatggctcttctgcctgggagttctgacataaaattggaaaaacttttattgtagacatagaatgattccatcttttttttactaaacatatagattcagatgtttcaaaaagaatatctttgattcatttttgccttgaaataaatcaagttatggtgatatgtgtaatgtttttcacttttataggtgaaattggaagaaaccacaagtgtattcatataactctttgacaatagtgcaggaccatttcaccagtactaaaagttgggcagactgagtgatttatagcatgtgttcagcacttcctcctccattagataattttaacaaacatttatttgtggctaatttcatctctacatttgaaaccaatctatggaagcatcagattcagttagaaattactggaatattgagatattactatatatttcacacagtgagatgaattccgatagacagtagagtataatccatgtcagactcttccattatcttatttcatcttcataacaacccagtaaggaatatggcactgctgtttttgttttattgatgaggaaactgaagtagatgtaaatgagtgactcacttgcatagtaagttaccagcatagctggtagtggcagaagtacttccaacctttgagcagctttaaccttacataagttgaagacttatttttcttaaacaatacatatcatgaacataaatttgctagaactcacgccaaactttggaaagaacttacgcatgtagggaccctaaagcttaagcttcacagacttctttgaaaattttcctgtgatcaaacaaagaagtgatttgtctccaaagtctgttgctaaaccttgaaggtgtattgcaggatcatggtcatattttcctagtatttgtataataaaataggactttgtgttttcaatacaactaagtggtggataataaatggaagacaaaaggcatccatagccaataatcatatgactaataagaaagacagagatgactgcacttgtgtatttttcttgtatcaggtggctggtggaatctgctcggtggttgataatcaccaataaactagatgagggcttaaaggcacttagaaaagttgcacgcacaaatggaataaagaatgctgaagaaaccctgaacatagaggtgagtaggaaagggaaggtggttactgggttgaagggaagacatacgctgacatctgccttctccttattgagacagactaactgcttctaagaagggcagctagctgagaacacaagctcggttcttattttttcaaggccatctcatataaaagaagctttgggaattatgtaactatctctttctttagttcacttcctgatctgaatctacaacctatgcatccttgtggatacactataaccctttggggccttattttcaaatgtctttattgctgcataatttcctggaggctcctttaatgttctccttcatttttcttcacaccgctttcacttctgtaattgcatatcatatatcacactcgagagaaagggaacatatttctcttgtcctactaagtgccagttctcacaacaatgcctgggatgatgttgataaatgataaatgtttattattgaaggttgtaagatccaccatgcaggaggagctggatgcagcacagaccaaaactactgtgtgtgacttgttccgcaaccccagtatgcgtaaaaggatctgtatcctggtatttttgaggtaggcttcgtatagtatatgaggagcattaaaagtttggtgacatgaatcactttcttatttcaaaggttgcaacagtagtgtgtgtgtgtgtgtgtgtgtgtgtgtgtttaggactgatttgtagataaaagatgaagaaaatacacaggtaactgctacatttgaagagaggcagagggttatgtagactcacatcatcctaccagtctcatcattggtgattgatactgaggtaaattgtgttgtttaattttctttatttttttcaattctacttgaaacaaatcttagtaatgtgcacagattatgaatgtatacaactccatgaatatttttatacataaaaagtgtaatcaagtcaggcgtgatggctcatgcctgtaatcccaacactttaggaggctaaggcaggtggatcacctgaggtcaggagttcgagaccagcctggccaacatggtgaaaccccgtctctactaaaaatacaaaaattagccaggagtggtggtgcaaagctgtagtctcagctacttaggaggttgaggcataagaattgcttgaacccgggaggtgaaggttgcagtgagccaagattgtgccactgtactccagcctgggtgaaagagtaagactctgtctcaaaagaaaaaaaaaaaaaagaaagaaaaaagaaaatgtaatcaacacccagatcaagatgtagaaaaaccttggaaggcctccttgtgcatcatctacagcaataaaaactgcccctgccaaaaataacttaagaacagttctggcctccatcaccatgaaggattattgcctgattttgaccttcacaaaatgtaaaagataacatggctccgtttgtcacaggctccttttcctcaactttattccttcaagatttatcagtgctgttgcttgtaatagtaggttgttctccttcccagtgtttcagtattccaatagatgaatacagaacaatttctttacctacttctttgttggtggacttttacatatttccaatttcgggtgttcgcagaagggcttctgtaggcaagcttgtacattgtctcttggggacatgtaagtacttactttggtagtgtcagtaggaaaaattttaaatataattctaaatttttgaaaacttataaaaagtgttacaggagagcgtatgtccacttccaagctgaagacagtactattaaattatacagtttacctcttcctaggcatatcctataggtggctacttcatttaattgcattgtgctttatcacttttcccctatccactacattacagactctggcttctgaatcctagacagtcagagtgggtcaaaaaagtagagatagtggtcagaaaaggacttacttgcttggaattgctatgatctatggtagtttcttctgccataatgtctaaagctagctctttctgggtgtggtagatcattaatgtggactagttctctgtagatgctttctgggtatattgaagatcctcggtaggaacctctgattttatttcctatggtgaagttggtgtaggtttgtttgcctggattctgacactttttcttagctctggggaatgagatatgaacctctttagtgagaaacatcctcctcaggcatcctctgcattgaattgtaccagatttttttgtttgtttgtttcttctcttttctttgcgatcagtgtcaacgtgttatcatttaaaataacttgttataactatataacattttttacaagccttgtggtaactgcaaagcaaaaacctataattgatatgctaaaattaaaacacaaagaaccaaaagatactactagagaaaaccacaaataaaaactgtcaaagtgaaacaaaggggaaaaaaaatctacaaaagaagtagaaaacaagtaacaaaatggcagtgttaaacccttacctatcaataattaccttaagtgttaatggattaaattctgcaattaaagacgtggagtggttgaatggtcatttttttacttaaaatggctcctggtcagctcttacttggaaagagcccacacagatggtctatgagagaaacacatgtatccctgcctctgtgtccatacagtgtgcttattcactcatcacattctctgtctctgctctgacccctcaggagatagccactgtttctcaccttaaatgtcttggaattgtgtcaggcaccagaacactgtgctcccagacagtgctgccaggcacgtagtctttttggagccttactctctagcaaagggaaagttcttcactgtagtagcactggggagaagagagagagcacttacagcatactgacagctctcagaaaatgaattatttccctaattttcaagctttaattcttctgtgttcaatgcttatataccattgagtttgatgactgattcaggttaagtttccctgtcattatcaactatctgcttgggaacttggacaaaagaatgactgacaggagtcctgttcttatgtaatgtcatgcaattattcatgatagctctaagatcaccatctttaaaacaaagaactctacaaattttaccgagcctttattccttaacactgaccaataactgcctgggccaatatgataatcaactgcgggacataggctctaaaccttatgacatgtgtctcttctattttgttcaccacagatttgcaaacacaatacctttttatggtaccatggtcaatcttcagcatgtggggagcaacattttcctgttgcaggtactttatggagctgtcgctctcatagttcgatgtcttgctcttttgacactaaatcatatgggccgtcgaataagccagatattgttcatgttcctggtgggcctttccattttggccaacacgtttgtgcccaaaggtgagagaagactggactttgggggaaagaaaatgtcttctctttgttcttcaggaattgtattggtcacacttgcctaaaaccaggaataaagaggagtgccatttaaaggctacatattccctcaaagcaatatgagcgtgtaaaacgaatttggctaataattgagaaaagagccaggggcagctcagatgtgtatttatcttcatcaactctggaagcagctggatagtggtgacattcattcctgacggtttctctaggagatcaattgatcacttgccctttggttaatcacacttttgataacaagcatggcatgtctaggccttgcgattatatcccatttgaggacacgatatgattgcttcctttgtgtgggctctgtctaggttcttcctcattactatgtcttcagtgaccagtctactcactgctatccgtgtagccacacttggacgtgatgttaagtcaccatgaatgcagcccttgattaggggaaacctttttgactttaacgaagtagaaatcctttgtttacaagcagagaaagaatatatgatagggacaataaactaggcagattaaaagcctatttcactccctgttagactattttataagttaatatgatgattgtatgtaatgattaggggaaccttagtaggcactatgccttccctgcttcccaatacaagaatgtattttaccgcataatagattggggaacttgattcctcttcctgaatattatcaataatgtatatctcctgacttacatcgagcactttctaatcttataaatctataattctctttctttctatattaggcagaaaacattctctgaaacttccttttaatggtttccaaattctgaatttatttttccccaagcagaagttccattgcttggttccttatgcctattattctggatctagcctctctactctgcccacttacaaaggagttttttcattagtctcttgtacaattccaactcgtgacaatactgtgtctgtactagattgactgagttacccagatttacctgggactttcttggttttatcaataaaaatttaacttcactaaaaccccttcatccctgggaaatctaggatggctggtccctttaaattctgcactttaattgtaaagttctcaagtacagtgctgagtctcagactcctcagtaattgtccacatgctggttctaccttctatagaatgggcatagcgaatactggacagaataagtaagaaaaaatttctgctagagtcaccgtttctcctccctctctgaaaaatcttagatatacagagagatttcctgcattaatgcagataatattatgcactttttgccacctatgttgataattctaagctgataatttctcagcttatcaacctctggatgttctctggcactattcagttttctacagtatttttcaaacatgcaaatactcgatagattgtttttaaattaagtttggtggatgttgcttccttcggcccagatatcagagtctcactggtctcttccttttgccagaaatgcagaccctgcgtgtggctttggcatgtctgggaatcggctgttctgctgctactttttccagtgttgctgttcacttcattgaactcatccccactgttctcaggtataagagatacagatgctccacctgagcccaaaataagaatttcccactaaacaatacttactgagggaataaagctgagacctgtttattattttaaaagcaatcatttataatactaataatacactaacaaaaattatggccaatgattattgcaagctgactttgcactatctactgtgctagacagtattttaatgtatcatctcactaatctttcggaccactcatcagcgtaggtgtcatgtgtaactgtctgtttaaaatgatgaaaaggagtcttaactcacactgaacctgattaaaaacagctagaaaatcatagagaaaatctcaaaagcagctgtttgcccatgtacctaatgattgtgttttattgtcttctgcagtcaagtcaaaataatatgtcacaaattacatgtgtagattttttttctgattatcatgtattgttatttatctgtagggcaagagcttcaggaatagatttaacggctagtaggattggagcagcactggctcccctcttgatgaccttaacggtattttttaccactttgccatggatcatttatggaatcttccccatcattggtggccttattgtcttcctcctaccagaaaccaagaatctgcctttgcctgacaccatcaaggatgtggaaaatcagtgagtgaatcttttagccatgtcctgagagaagcagtgtactctatatccgtgataagaaatgaaaaactccatgtggatccttgagattattgtgaaagcttagcctttcctgagctacttccacttgggccattgcctttcattagcagcagggccagctctatccattctgagttccaactctagagtacagagacaccctcattggtagttttagtgataaagagataaaaatgagctatgttgtgatggcacatactacctttcctcatgaaagacacacgctcatgatggtatttaatgattcttggattcatagagcttgggatatggtggggaaggaaacaaaatagtgaaggaagaatgttcagaaatatcacaaagagttaaagatcctccttgaaaagatagtaaaggagataactcttgtttagttgcctgtgaaattcagtcaaccttgctgccatgagtaatagaaggtttgaggatagagaaaataagaaactaggaaaaagtatttttattttttaattttaaagtttcattttatttgtatatttaaagatggggtctcctctgtcatccagtctgaagtgcggtggtgcaatcacagcttactgaagcctcgagttcctgggctcaggtgattctcccacctctgcctcttgagtagctggcacacgcctctacacatggctaaatttttgtatttttagtagagattgggtttcaccatgttgcccaggctggtcttgaactcctgtgttcaagcaatccccctgccttggccttttattttgtttttaattgactcaaaataattgcacatatttatggggaacagtgtgacgttttgatacatagaaatcatggtaattagcatatctataatcttaaacacatcattttttggggtgaggacattcaaatcctttcttatagctcttttgaaatatataatacattattgctaattatggtcaccgtactgtgccatagaacactagaatttttttttttttagacagagtctcactctgttgcccaggatggagtgcactggcacaatctcagctcactgcaacctctgcctcccggattatagtgattctcctgccttagcctcctgagtagcccgccaccacgcccagctaattttttgtatttttagtagagacagggttttgccctgttagccaggatgatctcgatctcctgacctcgtgatccacctgcctcagcctcccaaagtgctgggattacaggtgtgagtaccgtgcctagcctataatttctttctcctaacaaactgtagctttgtacctgttgatgaacctgttcctatctccccctaccttcttccttccctagcctctgacaaccactattctactatcaacttctatgaaatcaacttttgaaagattctacatatgagtgagatcatgcagcatttgtcatgtgcttctcttatttcacttaacatggttaatccatgttgtcattaacacatcataatccatgttaagtggacaggatttcattcttttttatggccaaattgtattccattaagtatattccactgagtatatatatatctctctctcttcaaaatctactttatctgttgatggacacttaggttaattccatatcttgcctatggtgaatagtgctgtaaaacatgggaatgcaaatatttctttgacataccaatttcatttcctttggatatatactcaatagtgggattgctggatattatggtggttaacttttcatttgttgaggaaccttcatactgttttccataatggctgtactaatttgcatttctaccaatcatgtataaattcctctttctctacatctttactatcatttgctattttatgactttttggtaatagccattctaattggaatgagatgacatctcattgtggctttaatttgttttttatcaatgattggtgatgttgagtattttttcatataactattgggcattcatgtgtcttcttttatgaaatgtctattcagatcttttgcccattttcaaatcacactttgttttttactcttgagctcctcttgtgttttagttattagtcccttgttagacgcgtagtttgtgaatattttatttcactctgcaggctgtctcttcacttcattgattgttttctttgcggcataaagcctctttagtttgatataattccatttgtatatttttgctattttagaattccttctttaaatgtttagtagaattcacctgtgaaggcatcaagtcctgggcttttctttaatgggagactttttattattgattcaatttccttatctttttattggcctgttgaggttttctacttctccatgattcagtcttagtaggtttgtatgtgtctagggatttttctgtttgttttttttttctgttttttaattttttggtttgtatttgttcataacagtctctaaggatcctttttgtgatatcagtggtgatgtctcctctgccatctctaattttatttgagtcatctctcttttttcttagtctggctaaggcttgttgatgttgtttgtcttttcaaaaaacaaacaaattttcctaatcttttgtatttttgtcttttttatttatttttgctctgatatttattatttccttctactaattttggttttagtttgtttttgtttttctagttcctttaggtttaatatcaggttgtttatttgagatctttaaatttttttgatgtagatatttaatgctataaacttccctcttagaatggcttttgctgtatcccataggttttggtatgttgtgtttccattttcttttgtctcaggaaatttttaaattttgtttttatttcttcattcacccaatgactgtttaggagcatgttgtttaatttccatgtatttgtaagttttccaaagttctttctttctgttactaatttctagttctattgcattgtgatcagaaaagatatttgaaattattttgattttaaaaaaaattgttgagttttgttttgtggcctaacataggatttaacctgaaaaatgttctgtgtgcttctgagaagaatttgtcttgtgtagctgttggatgaaatgttctgtaaatgttggatctaggatgtgatttaattttaatatttctttgttgattttctatctggatgatctgtccattgctgaaagtctcctattattattttatgcagactatcactccatttaggtctattaatatttgctccatatatttaggtgctctgatgttggggcatatatatttataattgttttatcctattgctgtattgaccccttaagtattatatatggtcttatctctttttgcagtttctggcaaaaaaaaaaaaaaactgcaaaaagaaacaagaccataatgtttattttatctgatataagcatagctactcctagtcttttttagttttcatttgcatgaaatactttttccttttgttcaattcaagtctacgtgtgtccttatagttgaaatgagtctcttataggcagcatataattaagttaaaaaaaatccattcaatcattctacgtctttaattgcagaatttagtccatttacattcaaggtaattattaataggtaagggcttaacactgccattttgttaccgattttctacttgttttgtacatttttttcccctgctttcacttttacagtttttatttgtggttttctctagtagtatattttgattctttgtgttttaattttagcatatctattataggtttttgctttgcagttaccacaaggcttatacaaaattatataattataacaagttattttaaatgatagcaacttgacactgatcacaaagaaaagagaagaaacagaataatctggtacaattcaactctccttccacgttttgatttttgtcatgatttacacttttattttgcccacctcttaacaaattattgtagttattatttttgataggttttttttagttttcatactaaagatataagtaagtggtttacatgccacaattacagtactagagtaacaatcacattaatgcccttttctttaagttcaaaaaactccatttagcatttcttgtaggagatagtgatgaattccctcagcattttttttttttgcctgggaaagtctttttatctcaactcatttctgaaatatagcttttctgggtagagtattcttggacagcagtctttttttttttccttcagcattctgcatatatcatctcaatcctttctggcctgcacattttcagctacaagtctgcttccaggcatattggatctcccttatatattatttgcttctttttttcttggtgctttcaggacgctctatttgtctgctctttgagagtttattataatttttcttgggatattcttgtttgggtttaatttgattggtgacaagaaataatgttaaaataataaaaatagcatattcacttcttatgtctttcataacaagatatcacaaacttaggcacttaagaaaagaaatttattgtctcacagttctggaagctagaagtctgagatcaatttattgaaaaggacttgacctcactgaagtctgtagggaagaatctattccagacacctcttctcacttctggtagatccttgggtatagtttcccaactgtaatcttcacatggcatttttccccacgtgtgtgtctctacattcaaatttcccccaactatttttttttttttagatagagtctcgctctgtcacccaggctggagtgcaacctctgcctcctggattcaaactattctcccatctcagcctcccaagtagctgggattacaggcacccaccatcatgtcaggctagtttttgtatttttgtatagacagggtttcatcatgttaatcagcctggtcttgaactcctgacctcaggtgatccacctgtcttggcctcccaaagtgctgggatgataggcatgagccaccacgtctggcctcaaattcctccttttttataagggcaccagtcatattgagtgaggggtcccactctactccaatatgaccttgccttaactagtaacatgtgcaacaacactgtttctgaataatgtcacattctgaggtatttagagttaagacttcaacatataaattttctttggtggggggacacaatgtaacccataattaatggtgagatttcttaaattttttaattcaccccttaactttcaaagatgccatttaccacaggtctaaaaagaccaagtgagagtagcaattttcaaaactccctttggatctgcacaggcagcaggaccttttacagagtgagtgtgattcgctagaaatactgacttataaatagctgatggtgtaatcccatttttgggtatatactcaaaggaatataattcattctactataaagacacatgcacatgtttgtctattgcagcactattcacaatagcaaagacatggaacaaacctaagtgtccgtcaacagtagactggataaagaaaatgtggtacatatataccatggaataccatgcagccataaaaaaaaacatgtcctttgcagcaacatgggtggagctggaaaacattattctaggcaaactaatgcaggaacagaaaaccaaataccatatgttctcacttataagtgggagctaaactacaaaaacacatggacacaaagaactacagatgctggggcctacttgagggtggtgattgggaggagggaaaggattaaaaaaaacctatggagtactatgcttattacctgggtaactaaataatatgtacacaaaacccctgtgacacactgtttgctatataacaatcctgcacatatacccctaaacctaaaataaagttaaaaaataaataaataaatgctgatggtcagaggttcagcttgcaatggtgcatagaggacatacaaagtaattttgattttttctgaacgtttgtttttgtttgttctttttcaatttattgtttctgttttgttttgtttttccagaaaaaaaaatctcaaggaaaaggcataaaaatgattgctacacaaaagtgaccaaattttaagaagccttcatgagctgattggtggggaaattcagaaaaaaaaatacaggaaaagaacacaccagaagggtttttttccctacaaccagcaagaacatatattagatacatgaatctcaattataattatggcattaatttgcattttatttcaaaattaacttgtggggacatgtaatctcttgagcaatctgatatttttgggaagtcctttaaaaagttacaaatttatcaataaattactagtagataagatgattcagaaacaaaagaaaatcacagaattaggatgtggctggctggtgtatgaagcaccatgtgatgaattcataaagttgcaaaagtcaaaacaatactgtacatgcaaccagaaatcaaaataaatccagaaatagagacctatataaatgcatttaatacatgatacttttgacataataagccattggaaaacggaaagattagatactaaataacattgactatctctttgtaaatacagtcactaaatgatgttagttacttttccatggtggaattttaattactttttctttgtaatttttctctctgtatattttaaacaaatagctggtatagtttacaatattataaagatattgttcaaattgaagggcaaaggccaggttcagcaattttcaaactgtatgtacatttaataaaataactataaattaaaaaattatatttcaaatgatgtgactaataaatgaaagtacatatagtagtaaagtaatttcaggcaaacctatataaccaaaatataaactttcattttaaacagcaaagattttaagtgctaatgattctcagagtgggtgaagatacactgaatgttggggtgatcagacccaacgccaggtcgtcggggcgatgaagtctggcggagtcaaaggaatgagaaaaagacaatttgagagagaaagtgggaccgggggccatcacaagtgtggaggctgcgaaggccccaagctctgggagcccatgctatttattggtgctcaaacaaacaaacaactggtggtgaggtgtcgggggaaattcagccagatgtcgggcaaaattcacccccgatatttcacataggttcttttctactttcccaaagcatcgaccagtttgagaaataaagggacggagtacaaaagagagaaatttcaaagctgggcatctgggggagacgtcacatgtcggtaggttccatgatgtcccctgagccataaaaccagcaaggttttattagggattttcaaaacaggagggagtgttcgaatagggtgtgggtcacagagatcatgtacttcacaaggtaatagaatatcacaaggcaaatggaggcagggcgagatcacaggaccacaagacgggtgaaattaaaattgctaatgaagtttcaggcaccattgtcattgataatatcttctcaggagacagggtttgagagcaactgatctgaccaaaatttactaggcgggaatttcattatcctaataagcctgggagcgctatggaagactggggcttatttcatccctacagtctcaaccatagaagatggtcacacccaagggggccattttagaggcccaccctcaggtgcgcgttctctttctcagggatgttccttgctgagaaaaagaattcagcgatatttctcccatttgctttcaaaagaagagaaatatggctctgttctgcctggctcaacagcagtcaaaatttaaggttatctctcttgttccctgaacattgctgttatcctgttcttttttcaaggtgcccagatttcatatagttcaaacacacgtactctacaacttgtgcagttaatgcaaccatcacagggtcctgaggcaacatacatcctcctcagcttacgtgatcacaggattaagagattaaagagagagcgccaagatggccgaatacgaacagctccggtctacagctcccagcgtgagcgacgcagatgatgggtgatttctgcatttccatctgaggtcccgggttcatctcactagggagtgccagacagtgggcgcaggacagtgggtgcagcaaaccatgagtgagccgaagcagggcgaggcactgcctcacttgggaagcacaaggggtcagggagttccctttcctagtcaaagaaatgggtgacagacagcgcctggaaaattgggtcactcccaccctaatactgcgcttttccgatgggcttaaaaaacagctcaccaggagattatatcccgcacatggctcagagggtcccacgcccacggaatctcactgattgctagcacagcagtctgagatcaaactgcaaggcagcagcgaggctggggatggggtgcccaccattgcccaggcttgcttaggtaaacaaagcagacaggaagctcgaactgggtggagcccaccacggctcaaggaggcctgcctgcctttgtaggctccacctctggggacagggcacagacaaacaaaaagacagcaataacctctgcagactgaaatgtccctgtctgacagttttgaagagagcagtggttctcccagcacgcagctggagatctgagaaccggcagactgcctcctcaagtgggtccctgaaccctgacccccgagcagcctaactgggaggcaccccccagtaggggcagactgacacctcacatggctgggtactcctctgagacaaaacttccagagtaacgatcagacagcagcattcacagttgatgaaaatccactgttctgcagccaccgctgctgatacccaggcaaacagcatctggagtggacctctagcaaactccaacagacctgcagctgagggtcctgtctgttagaaggaaaattaacaaacagaaaggacatccacaccaaaaacccatctgtacatcaccatcatcaaagaccagaagtagataagaccaaaaagatggggaaaaaacagagcagaaaaactggaaactctagaaagcagagcacctctcctcctccaaaggaacgcagttcctcaccagcaacggaacaaagctggatggagtatgactttgatgagttcagagaaggtggcttcagatgaacaaactactctgagctacaggaggaaattcaaaccaaagacaaagaagttaaaaactttgaaaaaaatttagatgaatgtataactagaataaccaatacagagaagtgcttaaaggagctgatggagctgaaagccaaggctcaagaactatgtgaagaatgcagaagcctcagaagctgatgcaatcaactggaagaaagggtatcagtgatggaagatgaaatgaatgaaatgaagtgagaagggaagtttagagaaaaaagaataaaaagaaatgaacaaagcctccaagaaacatgggactatgtgaaaagaccaaatctacgtctgattggtgtgcctgaaagtgacggggagaatggaaccaagttggaaaacactctgcaggatattatccaggagaacttccccaatctagcaaggcaggccaacattcagattcaggaaatacagagaatgccacaaagatacccctcgagaacagcaactccaagacacataattgtcagattcaccaaagttgaaatgaaggaaaaaatgttaagggcagccagagagaaaggtcgggttacccacaaagggaagcccatcagactaacagtggatctgtcgccaaaaacactacaagccagaagagagtgggggccaatattcaacattcttcaagaattttcaacccagtatttcatatccagccaaactaagcttcataagtgaaggagaaataaaatactttacagacaagcaaatgctgagagattttgtcaccaccaggcctgccctaaaagagctcctgaaggaagcactaaacatggaaaggaacaaccgataccaaccactgcaaaatcatgccaaattataaagaccatccaggctaggaagaaactgcaacaactaacaagcaaaataaccagctaacatcataatgacaggaacaaattcacacataacaatattaactttaaatgtaaatggactaaatgctccaattaaaagacacagactggcaaattggataaagagtcaagaaccatcagtgtgctatattcaggaaacccatctcatgggcagagacacacataggctcaaaataaaaggacggaggaagatctaccaagcaaatggaaaacaaaaaaaggcaggggttgcaatcctagtctctgatgaaacagactttaaaccaacaaacatcagaagagacaaagaaggccattacataatggtaaagggatcaattcaacaagaagagctaactaactatactaaatatatatgcacccaacacaggagcaccaagattcataaagcaagtcatgagtgacctagaaagagacttagactcccacacaataataatgggagactttaacgccccactgtcaacattagagagatcaatgagacagaaagttaacaaggatatccaggaattgaactcagctctgcaccaagcagacctaatagacatctacagaactctccaccccaaatcaacagaatatacattcttttgagcaccacaccacacctattccaaaattgaccacatacttggaagtaaagctatcctcagcaaatgtaaaaggacagaaattataacaaattgtctctcagaccacagtgcaatcaaactagaactcaggattaagaaactcactcaaaaccgctcaactacatggaaactgaacaacctgctcctgaatgactactgggtacataatgaaatgaaggcagaaataaagatgttctttgaaagcaacgagaacaaagacacaacataccagaatctgtgggacacattcaaagcagtgtgtagagggaaatttatagcactaaatgcccacaagagaaagcaggaaagatccaaaatagacaacctaacatcacaattaaaataactagaaaagcaagagcaaacacattcaaaagctagcagaaggcaagaaaaaactaaaatcaaagaagaactgaaggaaatagagacacaaaaaacccttcaaaaaattaatgaatctaggagctggttttttgaaaggatcaacaaaattgatagaccgctagcaagactaataaagaaaaaaagagagaagaatcaaatagatgcaataaaaaatgataaaggggatatcaccaccaatcccacagaaatacaaagtaccatcagagaatactacaaacacctctatgcaaataaactagaaaatctagaagaaatggataaattcctcgacacatagagcctcccaagactaaaccaggaagaagttgaatctctgaatagaccaatgacaggctctgaaattgtggcaataatcaatagcttaccaaccaaaaagagtccaggaccagatggattcacagccgaattctaccagaggtagaactggtaccattccttctgaaactattcccatcaatagaaaaagagggaatcctccctaactaattttatgaggccagccatcatcctgataccaaagcgtggtggagacacaaccaaaaaagagaattttagaccaatatccttgatgaacatcgatgcaaaaatcctcaataaaatactggcaaaccgaatccagcagcacatcaaaaagcttatccaccatgatcaagtgggcctcatccctgggatgcaagactggttccatgtatgcaaatcaataaacataagccagcatataagcagaaccaatgacaaaaaccacatgattatctcaatagatgcagaaaaggcctttgacaaaattcaacaatgcttcatgctaaaaactctgaataaattaggtattgatgggaggtatctcaaaataataagagctatctatgacaaacccacagccaatatcatactgaatgggcaaaaactggaagcattccctttgaaaactggcacaagacagggatgccctctctcaccactcctattcaacatagtgttggaagttctggccaggtcaatcagacaggagaaggaaataaagggtattcaattaggaaaagaggaagtcaaattgtccctgtttgcagacagcatgattgtatatctagaaaaccccattgtctcagcccaaaatcttctgaagctgataagcagcttcagcaaagtttcaggatacaaaatcatgtacaaaaatcacaagcattcttatacaccaataacagacaaacagagccaaatcatgagtgaactcccattcacaattgcttcaaagagaataaaatactaggaatccaacttacaagggatgtgagggacctcttcaaggagaactacaaaccactgctcaatgaaataagaggatacaaacaaatggaagaatattccatgctcatgggtacgaagaatcaatatcgtgaaaatggccatactgcccaaggtaatttatggattcaatgccatccccatcaagctaccaatgactttcttcacacaattggaaaaaactactttcaagttcatatggaaccaaaaaagagcctgcattgccaagtcaatcctaagccaaaagaacaaagctggaggtatcatgctacctgacttcaaactctactgcaaggctacagtcaccaaacagcatagtactggtatcaaaacagagatatagaccggtggaacagaacagagccctcagaataatgccacgtatctacaactatctgatctttgacatacctgagaaaaacaagcaatggggaaaggattccctatttaataaatggtgctgggaaaactggctagctgtatgtagaaagctgaaactggatcccttccttacaccttatacaaaaattaattcaagatggattgaagacttaaatgttagacctaaaaccataaaaaccctagaagaaaacctaggcaataccattcaggacataggcatgggtaaggacttcatgtctaaaagagcaaaagcaatggcaacaaaagccaaaattgacaaatgggatctaattaaactaaagagcttccgcacagcaaaagaaactaccattagagtgaacaggcaacctacagaatgggagaaaatgcttgcaacctcctcatctgacaaagggctaatatccagaatctacaatgaactcaaacaaatttacaagaaaaaaacaaacaaccccatcaaaaagtgggtgaaggatatgaacagacacttctcaaaagaagacatttatgcagccaaaaaacacatgaaaaaatgctcatcatcactggccatcagagaaatgcaaatcaaaaccacaatgagataccatctcacaccagttagaaaggcgatcattaaaaagtctggaaacaacaggtgctgcagaggatgtggagaaataggaacacttttacactgttggtgggactgtaaactagttcaaccattttggaagtcagtgtggcgattcctcagggatctagaactagaaataccatttgacccagccatcctattactgggtatatacccaaaggattataaaacatgctgctataaagacacatgcacacgtatgtttattgtggcactattcacagtagcaaagacttggaaccaacctaaatgtccaacaatgatcgactggattaagaaaatatggcacatatacaccatggaatactatgcagccataaaaaatgatgagttcatgtcctttgtagggacatggatgaaattggaaatcatcattctcagtaaactatcacaaggacaaaaaaccaaacaccgcatgttctcactcatagataggaattgaacaatgagaacacatggacacaggaaggggaatgtcacacaccagagactgttgtgggctgtggggagggggaaggatagcattaggggatatacctaatgtaaatgagttaatgggtgcagcacaccaacatggcacatgtatacatatgtaacaaacctgcacattgtgcacatgtaccctaaaacttaaagtataataataataaaattaaaaaaaataaccaggcatgatggtgtgcccctgtagtcccagctactccggagggtgaagtgaaaaaggaggatcacttgaaccagggatgtcgaggccgcagtgaggtgtgaaggcaccattgcactccagcctgggcaacagagcaagatctgtctcgaaaagaaaaagaaaagaaagaaagaaggaaagaaaaagaaagaaagaaagaaagaaagaaagaaagaaagaaagaaagaaagaaagaaagaaagaaagaaggagagggagagagagagagagtgataagaaagaaagaaagaaagaaagaaagagagggagagagagagaaagagtgataagaaagaaagaaagaaagaaagaaagaaagacccaccccacttgtaactgctgctaataggagtgcatattcagggcagcttgaatcagtattgctgggtggccatcctcaagctttgggctcaattaaactctacatttaacataaaaaaaactgggatgatcaatttctacgtttattcaaagaaactataaacatcagttctatgggacaattgggccagtttcagtcccccccccccgaccattttatctatcagctcctcaatcattgggaatctggttattgatctttctggctgcttcatggtaaggaggggcattatagacaacttcacaccaagggtgaccacttagccactcaggaatcaacggttaatctaatactacaattttcttcaggaatacaatatttctctcttcagtttcctacttccaccaaagataaatcacagcagaaccatctcttattaatattacctaaaaatgttttaaaaagagaaaactaaattttactattgtatggtgtattattgttaaaactaattttaataaatccttataaacaactgtatctaattttaattggtttgaccataatatttccataaacttttaatgaccttttacaattgctgttgaagagcagattggggggatggagccaagatggctgactagaagcagtggtgattggaggctcccatcagaaagatccaaaacagcatgcgaatcctgcaccagcaaccaaagtatccaggttttgtcattagggctgactaggtgcctggcatgatccacggaaaggaaggaagagcagtgtggtgcaatggcccacctgagagccacacagggcaggggaacccctacccccagccaagggaggtggtgagtgagcatgttatccagcctggaaaactgcttttttcacaaaactgtgcaacccatggattggaagattccactcatgagcccacaccaccagggccttgagtcccaacaaggagccatgcagaatctcaacagccagtcagctagaatcagcctaagcctgcagagtttatggtggctgaactctgaactctccatatttctcagaggttttgttcattccttttcaatcttttctctctaaccttgtctgcctgcctatgtcagcaagatagtcttcaaactctgatattctctcttccacttgattgattcaggtattaatacatgcgtatgcctcacaaagttcttgtgctcatttttcaactccatctggtcatttatgttcctctctaaactggttattctagttagcagctcctctaactttttatcaacgttcttagcttctttgcattgggttagaacatgctcctttagctcagtcaactttgttattaccatagccactgctgtggctgcctcctgtgtaatccagctgagctccttgggggaggggtggcagtcaacactgtggctttggggcctccctgcaggaactccaactctagccagggactcagggacagaactctaatctcccggggcctgagtccctaaggggaggtatggctgtagtctatgcagaccagcagacttagtctttcctccgttagctctgaggaatcggggcagtctagatgagtaggattcccccaagtgaagaacacctcctccaccagaggacagccaaaagtgcttcattaaatgggtcctgatttccatgccacccaactgggtgagaacccccaacaagtgttgtcagatatctatacaagaatgtttctactgacatcaggtcagtgccccttgagatcagaaatcccaggccccccaaaaggggttgtcagacatcttatacagaaatgttcctactggcaagagatcagtgccccttgaggtcagatatctcaagaaggaggaggcacccatctttgctgttctccagcctcctcaagtgacatctcccggcacaagaacaaaccagatgaatatagtctgaagtgaagccccagcaaaccataggtgtcccacaaaagaggtacctgattactgaaagaaaaacaaacagaaagcaacaacaatatcaataaaaaagtttccacaaaaacctcatccaagaatcagcagcctcaaagatcaaaactagacaaattcatgaagatgagaaagaatcaatgaaaaaatgctgaaaaccgaaaaggactgtgtgcctcttcacttccaaatgattgcaacacctctccagaaagggcgcagacctggacagaggatgaaatggatgaattgacaaaagtaggcttcagaaagtgggtaataaaaaacttgactgaggtaaaggagcatgttctaactcaatgcaaagaagctaagaaccttgataaaaagttagaggagctgctaactagaataaccagtttagagaggaacataatgaccagatggagctgaaaaatgcaacacaagaactttgtgagtcatacacatgtattaatacctgaatcaatcaagtggaagagggaatatgagagtctgaagactatcttgctgaaataggcaggcagacaaggttagacaaaaaagattgaaaaggaatgaacaaaacctctgagaaataaggaactatataaaaagactgaaactatgattgattggcatgcctgaaagagattggaagaatggaaccaagttggaaaacaaacttcagcatattatacaggagaattttcccaacctatcaagagaagcccactaagatactccatgagaagatcaatcccaagacacataataacagattctccaaggtcaaaatgaaggaaaaaatgttaatggcagccagagaaaaaggccaggttacctacaaaggaaagcccatcccgtcagactaatagtagatctctcagcagaaaccttacaagccagaagagagggagggccaatattcaacattcttaaaaaaaagaattttcaacccagaatttcatatattgccaaaccaagatttataagcaaagcagaaatgaaatccttttcagataagcacatgctgagggaatttatcaccactaggcctgtcttgtaagagctcctgaaggaagcaataaatacgaaaaggaaaacctggtaccagccacagcgaaagacaagaaaatataaagaccaatgacattataaagaatgtcatcaactagtgtgcaaaataaccagctagcatcgtgatgacacgatcaaattcacacataacaatattaacctttaatgtaagtaggctaaatgccccaattaaaaggcacagactggctaattggatagagtcaagaaccatcagtgtactgtattcaagagacccatctcatgtgcaaagacacacatagactcaaaataaagagtgcaggaaaaatttaccaagaaaagctaactttcctaaatatatatgcatccaatacaggagcacccagattcataaagcaggttcttagaaacctacaaagagacttagactcccacacaataatagtggaacactttaacaccccactgtcaatatcagaaagatcaatgaaacaggaaattaataataatattcaggactttaactcaactctggatcaggtggacctaatagatatctacagaactctccacccaaaaccaacagaatatacattcttatcagtgccacatggcaattactctaaaatcaaccacataattggaagtaaaacactcctcagcaaatataaaagaactgaaaacgtaaaaaaccttctctcaggttacagtgcaatcaaattagacctcagggttaagaaactcattcaaaaccacacaactcatggaaattgaacaacttgcttctgaatgactcctgggtaaaaaagaaattaaggcataactcaagaagttctttgaaaccaatgagaacaaagagacaatgtaccaaatctctgggatgcagttaagcagtattaagagggaaatttatagcactaaatgcccacaccagaaagctggaaagatctcaaatagacactctaacatcacaatgaaaagaactagagaaacaagagcaaacaaagtcaaaagctaggaggagacaagaaataactaagatcagagcagaaccgaaggagatagagacatgaaaaacccttcaaaaatcaataaatcccagagctggttctttgaaaaaattaacaaaatagatacaacactaggtagactaataaagtagaacagagaagatgtaaataaacacaataaaaatgatgaaggggctatcaccactgaccccattgaaatacaaacaaccatcagagaatactataaacacctctatgaaaataaactagaaattcagaagaaatgggcaaattcctggacacatgcaccctcccaagactaaaccaggaagaaattgaatccctgaattgaccaataatgagttctgatattgaggcagtaataaatagtctagcaacaataacaacaacaaaaaagccaaggaccagacagatttacagccaaattctaccagaggtacaaagaggagctggtaccattctttctgaaactattgtaaacaatagaaaaagaggggatcctccctaactcattttatgaggccagcatcatcctgataccagaccttggcaagacacaacaaaaaaagaaaatttcaggccaatatccatgatgaaccttaatgtggaaatcctcaacaaaacactggcaaaccaaatccagcagaacatcaaaaagcttattcaccatgatcaaactggctttgtccctgggatacaagactggtttaacatacacaaatcaataaatgtaatccatcacataaacagaaccaatggcaaaaaccacatgattatctcaatagaggcagaaaagagcatcaataaaattcaacatcccttcttgttaaaatcattcaatatactaggtatttatggaacacctctcaaaataataacagatatgtatgacaaacccacagccaatatcatactgaatgggcaaaagttggaagcattccctttgaaaaccagcacaagacaaggaggccctttttcaccactcctattcaatgtagtataggaagttctggtcaagacaattgggcaagagaaagaaataaagagtattcaaataggaagagaggaagtcaaattgtctctctttgcagatgacataatcctacatttagaaaaccccattgtctcaccccaaaaacaacttaaactaataaggaatgttagcaaagtctcaggatacaaaatcaatgtgcaaaaatcacaagcatttctatacacaaaaaatagacaagcagagagccaaatcgtaaatgaactcccattcacaattgctacaaagagaataaaatacttaggaatgcagctaacaagggacgtgaaggacattttcaaggagaactacaaaccacttctcaaggaaataagaggggacacaaacaaatgggaaagtattccagcctcatggatagaaagaatcgatattgcgaaaatggccgtacttcccaaaataatttatagaataaatactgctccaaactactattgacattcttcacagcagtagaaaaaactactttaaaaattacatggaaccagaaaaagcccatataagcaagacaattctaagcaaaaagaacaaaactagaggcatcacgctatttgacttcaaactatactacaaggctacaataaccaaaacagcacagtactggtacaaaaacagacatatagaccaatggaacagaatagagacctcagaaataaggccacacatatacaactgtctgatctttgacaaacctgacaaaaacaagcaatggggaaaggattccctacttgataattggtactgggaaaactggctagccatatgcagaaaactgaaactggaccacttccttacaccttatacaaaagttaactcaagatggattaaagactttaatataaaacccagaaccataaaaaccctagaagaaaacctaggtgatatcattcaggacaaaggcatgggcaaagacttcatgattaaaacaccaaaagcaatagaaacaaaagccaaaattgacaaatgggatcaaattaaactaaagagcttctgcacagcaaaagaaactaccatcagagcaaacaggcaacctagagaatgggagaaaatttttgcaactacccacctgacaaaggtctaatatctaggatatacaaggagcttaaacaaacttacaagaaaaaaccaaacaaccctatgaaaaagtgggtaaaggatataaatggatgcttcaaaaaagaagatatttatgtggccaaaaacatatgataaaaagctcaacattaatgatcattagaaaaatgcaaatgaaaaccacaattagatatcatctcatgccagacagaatgatgattattaaaaaggcaagaaacaacagatgctggtgaggctgtggagaactaagaatgcttttacactcttggtgagaatgtaaattagttcacccattgtggaagacagtttggtgatttatcaaggatctagaaccagaaatgccatttgacccagcaatgtcattacttggtatatgcccaaaggaatataaatcactctacaataaagacacatgcacccatttgtttattgtggcactattcacaatagcaaagacatgtaaccaacccaaatgcccatcaatgatagactggataaagaaaatgtgtacatatactgcatagaatactatgcagccataaaaaggaatgagttcatgtcctttgcagggacatggatgaagctgaaagccattatcctcagcaaactaacactggaacagagaaccaaatactgtatattctcactcataagtgggagttgaacaatgagaacacatggacacaaggaggggaacaatgcgaaccagggcctgtcagagagggtcaaggggaggccgaacatcaggacaaatagttaatgcatgcagggattaaaacctagatatcaggttgataggtgcagcaaatcaccatggcacatgtgtacctatgtaacaaacatgcgtgctcggcacatgtatcccagaacttaaagaaaataaataaacaaataaataaaatttgtgcccttaatcaccatgatatcctggctcttggggccacaaccccacctcttccacatcttcatctagcagctcatttggatccatttttctaactaaatcctgtaatttcttcctggttgaagtctaaagcaggagcagatttttcagccaagtgttaaggaaacaaaataactcattatctcataatgaagaaagactgtcaaagtgttatgttttgtttgtacttcctcaagagttccgtctaccctggctgatagtattgccacaagatgacactgtcaagacagaagtgcctgaggaaaggtagagacaacaatttaggaaaagaggccagcctgaaaccatctgatagtttatatctcagcttcatggcttttctcttattgtacctcaccttccccctgccaccaacccacattctggctgcattaaacaattttcagttctctgaccaccacaaattttggtgcctctggggcctttggatgagcttgttctcccttcttcccacatgcttagctcatggcatctccttgatgatgcattttctggcccacccaggtaaaaatgaccactcctcctttggcatctactctatcctgtacattcttctatcaacagactataacactttattgcacatatttataaacttgcatgtttctgacttagcaagctacagactccctaacagtagagaacatttgttcatctctctgtcactaaatgtttgtgtgtgtacaactatgatccttcattcctaaaggaaatgtcatgccacatatatataccattaaaaatgatcaaacaatgtgctaaccatggttttctttgggtggcagaattatatgatattcattctttctgtatttctagagtttctgtgataaacacatataacttcgcaaacaagaagaccaaaaaaaaaactgacattaaagcaaaagatgaataagctttacaataaaaatttaaaaataaaagaacagatcaatgcaccatgaaaaccttgctaaactgatacaggggcccagatgctggccttgcataagtgtgcttttgatgttcctgtttaatttatagaaaaactctgaagtaattttatcactcagtattgacccttataatctcacatgcccacatcttccatgatagtgcctgggcctagagggattgagtagttttaatttctggccctgtgtctcttgagaaccattcatttttttttcttatgttgccaactattattttattataaattagatattctaataatggacactattaacatataaataaaaatgtgactttataaagtaccaatagaaataccaatacatatgagcttgtcaaggggtcttactgaattaagaaactttctgctcaatatatattctatcataaaaataaggagacatcctttgagaatgcactgttcatttttttatactttaaccacatttatttatttatttaatttctttttattatactttaagttttagggtacatgtgcacaacgtgcaggtttcttacatatgtatacatatgccatgttggtgtgctgcacccattaacttgtcatttacattaggcatatctcctaatgctatccttccccttccccacaccccacaacaggccccggtgtgtgatgttcccctcctgtgtccatgtgttctcattgttcagttcccacctataagtgagaacatgcagtgtttggttttttgtccttgcgatagtttgctgagaatgatggtttccagcttcatccatgtccctacaaaggacatgaactcatcatttttatggctgtgtagtattccatggtgtatatgtgccacattttcataacccagtctatcattgttgcacacttgggttggttccaagtctttgctattgtgaatagtgccacaataaacatacgtgtgcatgtgtctttatagcagcatgttttataatcctttgggtatatacccagtaatgggatggctgggtcaaatggtagttccagttctagatgcctgaggaatcgccacactgacttccacaatggttgaactagtttacagtcccaccaacagtgtaaaagtgttcctatttctccatatcctctgcagcacctgttgtttcctgactttttaatgatcgccattctaactggtgtgagatggtatggcattgtgattttgatttgcatttctctgatggccagtgatgatgagcatttttctatgtgtctgttggctgcataaatgtcttcttttgagaagtgtctgttcatatccttcgcccacgtgttgatgggtttgattgtttttttcttgtaaatttgtttgagttctttgtagattctggatattagccctttgtcagatgagtagattgcaaaaattttctcccattctgtaggttgcctgttcactctgatggtagtttcttttgctgtgcagaagctctttagtttaattaaatcccatttgtcaattttggcttttgttgccattgcttttggtgttttagatatgaagtccttgcccatgcgtatgtcctgaatggtattgcctaggttttcttctagggtttttatggttttaggtctaacatttaagtctttaatccatcttgaattaatttttgtataaggtataaggaagagatccagtttcagctttctgcatatggctagccagttttcccagcaccatttattaaatagggaatcctttccccatttcctatttttgtcaggtttgtcaaagatcagatatttgtacatgtgtggcattatttctgagggctctgttctgttccattggtctatatctctgttttggtagcagtaccaaaactgttttggtgactgtagccttgtagtatagtttgaagtcaggtagcgtgattcctccagctttgttcttttggcttaggattgacttggcaatgtgggctcttttttggttccatgcgaactttaaagaagttttttccaattctgtggagaaagtcattggtagcttgatggggatggcattgaatctataaatgaccttgggcaatatggccgttttcacgatattgattcttcctacccatgagcatggaatgttcttccatttgtttgtatcctcttttatttccttgagcagtggtttgtagttctcattgacgaggtccttcacatcccttggaagttggattcctaggtattttactctctttgaagcaattgtgaatgggagttcactcatgatttggctgtttgtctgttattggtgtataagaatacttgtgatttttgcacattgattttgtatcctgagactttgctgaagttgtttatcagcttaaggagatttggggctgagacgatgaggttttctagatatacaatcatgtcatctgcaaagagggacaatttgacttcctctttttctaattgaataccctttatttccttctcctgcctgattgccctggccggaacttccaacactatgttgaataggagtggtgagagaaggcatccctgtcttgtgccagttttcaaagggaatgcttccagtttttgcccattcatacgatattggctgtgggtttgtcatagatagctcttattattttgagatatgtcccatcaatacctaatttattgagtttttagcatgaagggctgttgaattttgtcaaaggccttttctgcatctattgagataatcatgtggtttttgtcattggttctgcttatatgctggattatgtttattgatttgcgtgtgttgaaccagccttgcatcccagggatgaagcccatttgatcatggtggataagttttttgatgtgttgctggattcggtttgccagtattttattgaggatttttgcactgatattcatcagggatattggtcaaaaattctcttttttgttgtgtctctgccagtctttggcatcaggatgatgctggcctcataaaatgagttagggaggattcccactttttctattgactggaatagtttcacaaggaatggtaccagctcttctttgtacctctggtagaattcggctgtgaatccatctggtcctggactttttttggttggtaagctattaattatagcctcaatttcagagcctgttattggtctattcagagactcaacttcttcctggtttagtcttgggagggtatatgtgtccaggaatttatccatttcttctagattttctagtttatttgcatagaggtgtttatagtattctctgatagtactttgtatttctgtgggatcggtggtgttatcccctttatcattttttattgcgtctatttgattcttctctcttttcttctttattagtcttgctagcggtctatcaattttgttgatcttttcaaaaaaccagctcctggattcattgattttttgaagggttttttgtgtctctacatccttcagttctgctctgaacttagttatttcttgccttctgctagcttttgaatgtgttttttcttgcttctctggttcttttaattgtgatgctagggtgtcaattttagatctttcctgctttctcttgtgggcatttagtgctataaatttccctctacacacttctttgaatgtgtcccagagattctggtatgttgtgtctttgttctcattgctttcaaagaacatctttatttctgccttcatttcattatgtacccagtagtcattcaggagcaggttgttcattttccatgtagatgagcagttttgagtgagtttcttaatcctgagttctagtttgattgcactgtggtctgagagactgttataatttctgttcttttacatttgctgaggagtgctttacttccaactatgtggtcaattttggaataagtgcagtgtggtgctgagaagaatgtatattctgttgatttggggtggagagttctgtagatgtctattagatccacttggtgcagagctgagttcaattcctgggtatccttgttgattttctgtctcgttgatctgtctaatgttgacagttgggtgttaaagtctcccattattattgtgtgggagtctaagtctctttctaggtctgtaaggacttgctttatgaatctgggtgctccggtattgggtgcatatatatttagaatagttagctcttcttgttgaattgatccctttaccaatatgtaatggccttctttgtctcttttgatctttgttggtttaaagtctgttttatcagagactaggattgcaacccctgcctttttttgttttccatttgcttggtagatcttcctccatgtctttattttaagcctatatgtgtctctgcatatgagatgggtttcctgaatacagcacacttatgcttcttgactctttatccaatttgccagtctgtgacttttaattggaacatttagcccatttacatttaaggttaatattgttatgtgtgaatttgatcctgtctttatgatgttagctggttattttgctcattagttaatgcagtttcttcctagccttgacggtctttacaatttggcatctttgcagggtctggtaccagtttttcctttccatgctcaatgcttccttcagttcttgtagggcaggcatggtggtaacaaaatctctcagcatttgcttttctgtaaaggattttatttctccttcacttatgaagcttagtttggctggatatgaaattctgggttgaaaattcttttcttgaagaatgttgaatattggcccccactctcttctggcttgtagagtttctgccgagagatctgctgttagtctgatgggcttccctttgtgggtaacccgacctttctctctggctgcccttaacattttttccttcatttcaactttgatgattctgacaattatgtgtcttggagttgctcttctcaaggagtatctttgtggtgttctctgtatttcctgaatctcaatgttgacctgacttgctagattggggaagttctcctggataatatcctgcagagtgttttccaagttggttccattgtccccgtgactttcaggtacaccaatcagacgtagatttggtcttttcacatagtcccatatttctcagagaatttattcatttcttttcattctttttttttaattttattattattatactttaagttttagggtacatgtgcacaacgtgcaggtttgttctcttctcacttcatttcattcttttgatcttccatcactgataccctttcttccagttgattgaatcggctactgaggcttgtgcatttgtcacgtagttgtcgtgccatggttttcagctccatcaggtcctttaaggacttctctgcattgattattctagttagccattcacctaatcttttttcaaggtttttagcttctttgcaatgggatcgaacttcgtcctttagctcagagaagtttgatcatttgaagctttcttctctcaacttgtcaaagtcactctccatccagctttgttctgttgctggcaaggagctgctttcctttggaggggaagaggtgctctgattttcagagtttccagtttttctctctgtcttttccccatctttgtggctttatctacctttggtctttgatgatggtgacatacagatggggttttggtgtggatgtcctttctgtttgttagttttccttctagcagtcagggccctcagctgcaggtctgttggagtttgctggaggtccactccagaacctgattgcctgggtttcagcagcagaggctgcagaacagcggatattggtgaacagcaaatgttgctgcctgatcattcctctgcaagttttgtctcagaggagtacccagccgtgtgaggtgtcagtctgcccctactgggggatgcctcccagttaggctacttggggctcagggacccacttgaggaggcagtctctctgttctcagatctcaggctgcatgctgggagaaccactactctcttccaagctgttagacagggacatttaagtctgcagaggtttctgctgccttctgtttggctatgccctgcccccagaggtggagtctacagaggcaggcaggcctcattgagctgcggtgggctccacagagttcgagcttcccagctgctttggttacctactcaagcctcagcaatggcaggcacccctcccccagtcttgctgccgccttgcagtttgatctgagactgctgtgctaacaataagggaggcttcattggtgtaggaccctctgagccatgtgtgggatacaatctcctggtgtcccatttgctaagaccatcagaaaagcccagtattagggtgggagtgacctgattttccaggtgccatctgtcacccctgtttttggcttggaaagggaattccctgactccctgtgcatcctggttgaggcgatgccttgctctgctttggctcaccctcggtgcactacacccactatcctgcacccaatgtctgataatccccactgagatgcacccagtacctcagttggaaatgcagaaatcactcgtcttctgtgttgctcaggctgggagctgtagactggagctgttcctatttggccatcttggctccaccctccaattcactgatttttgaaggggttttcatgtctctatctctttcagttctgctctgatcttagttatttcttgtattcccctagctcttggctttgtttgctcttgcttctcttgttcttttaattgtgatgttaggatgttgatttcaggtatttctagctttctgatgtgggcatttagtgccataaattttcctcatgacactgctttagctgtgtcccagagattctggtacattgtctctttgttgttgttgttggtttcatagaacttcttgatttctgctttaatttcatttttaacccagcagtcattcaggagcctgttgttcaatttccatgtacttgtgtggttttgagtgagttttttaatcttgagttccaatttgattccactgtgatctgaaagaccgtttgttatgatttcagttattttgcatttgctgaggagtgttttacttcctattatgtggtcgattttagagtaagttccatgtagcactgagaagaatgtatattctgttgtttttgggtggagagttctgtagatatctcttaggtcctcttgctccagagctgagttcaagtcctgaatatccttgttaattttctgtctcagtgatctgtctaatattcataatggggtgttaaaatctcccacttttattgtgtatgagtctaagtctgtaggtctctgagaacttgttttgtaaatctgggtgctcctgtattaggtgcatatatttagtatattaactaactatttaggatagttagttcttcttgctgaattgatccctttgccattatgtaacgttctggttttatcagaaattaggattgcaatccctgcttttttctgctttccatttgcttggtaaattttcctcaatctgtttattttgagcctgtgtgtctttgcatgtaagatgggtcttttgaatacaacacaccgatgagtcttgactccttatccaatttgctagtctgtgtcttttaattggggcatttagtccatttacatttatggttaatattgtaatgtttgaatttgatcttgtcatcatgatgctagttggttattttgcatgctagttgatgtcatttcttcataacgtcattggtctgtatatttttatgtcttttgcagtggctggtaccagtttttccttttcatatttagtgcttccttcaggagctcttgcaaggcaggcctggtggtgatgaattccctcagcatttgcttacctgaaaaggattttatttctcctttgctcatgaagcttagtttgttagcatatgagattctgtgttgaaaattcttttttaaagaatgttgaatattgcccactctgcccccaacacacacactctcttctggcttgtagggtttctgctgagagatccactcttagcctgatgtgctttcctttgtaggtaacctggcctttctctctggctgcctttagtgttttttccttcatttcaacttgggagaatctgatgattatgtgtcttggggttgatcttcttgtggagtatcttagtggggttctctgtgtttcctgaatttgaaagttggtctgtcttgctaggttggggaagttctcctggatgatatcctgaagtgtgttctccaattttgtcccattcttcccgtctctttcaggtactccagtcagttgtaggttccgtcttttcacatagtttcataattcttgcaggttttgttcattctttttggttcttttttctctaatcttgtctgctgccttattttataatgatggtcttcaaactcttatattattccttccacttgattgattcagccattgattcttgtttatacttcatgaagttcttgtgctgtgtttttcagctccatcaggtcatttatgttcctttctaaactagttattctagttagcagatcctgtaacctattatcctggttcttagcttttttgcattgggttagaacatgctactttacctcaggaaagtctgttattagccaccgtctgaagcctacatctgtcagttcatccgaggactttttatcataaaggaatgttgaattttatcatatgcttttctagcagcagtggaaatgatcatatggtttttgcccttcattctcttggtatgatgtatcacattgattgatttgcatatgttaaaccattcttgcgtccctttgataaatcccacttggtcatgatgaaaattcaccctcagccagagtgccctcccaagaatctcagtcaactcaaacctgaggccagagaagtgtcatcacttcatccatcccatggcagctctttcacctgaatgggacatttctcaacataggtgagacagacacggaatcatgtgtaaatggctgggtgtatgacagaagctcctttcccttctccaacatgactgaggtaagaggccttgttttcctttcatgagcactgccctgggtttttataaatagcacacgtaataaccatgcttccagcctttggtcacatgtagatacttattcttcattctttcagcaaatattaagtgctactctattaaatgccagacacatacatattttatgaggctaatgaattcaaaagtagaaatgcaccctgttataatagtgcttttattcttgggcagacaaaagtttaagcaagtaattcatgcctctgttataaatgttatgctaggtcagtaagtctcagcctgtggtcgcaaattaaaaacatctggaaggttgatcaaaacctccatgcctagactgtacccgcagagcagtcataggagaaggagtgcagtgaattcaggattcagtaaacttttacaagatcacaaatgtttacagtccatggccaagtttgagaaccacacttactatggagtaagagtggttattaatattacctacaggtctaggggaagcctcttagggaaagttatgtttaagctgagacctgagtgataaaggtcaggtaatgacaaaaatggaaactagagaggaagttagaagcctgctataatgaaacaaatcaggtcatgttaaggagctttgatcaggttctactgaggggtggtaagctgctgtgaaactctaatattctgtggggggtgcatggcaacatattcaagcttacgtacacggcattttaggtcggggcatggaaaaatgctgaggcaccgtgtgtatgttatttgtgcataagaatgaaaattcttgaccttaaaaacaggacagggagtggaatgtgtagtatgataaggaacgctgaaaacagcctcctgagaatgcagtttgagtgcttttataaggccacaggtgtctcactactcgatgtcaaaaaagccatctagtagatgtttgttgtttaacaagccctttcaataaatacttggcagaggtatgctggggcggactctcttagaaaagctgctagccatatgtagaaagctgaaactggatcccttccttacaccttatacaaaaattaattcaagatggattaaagacttacatattagacctaaaaccataaaaaccctagaagaaaacctaggcattaccattcaggaaataggcatgggcaaggacttcatgtctaaaacaccaaaagcaatggcaacaaaagccaaaattgacaaatgggatctaattaaactaaagagcttctgcacagcaaaagaaactaccagtagagtgaacaggcaacctacaaaatgggagaaaatttttgcaacctactcatctgacaaaggactaatatccagaatctacaaagaactcaaacaaatttacaagaaaaaaacaaacaacaccatcaaaaagtgggtgaaggacatgaacagacacttctcaaaagaagagatttatgcagccaaaagacacatgaaaaaaggttcatcatcactggccatcagagaaatgcaaatcaaaaccacaatgagataccatctcacaccagttagaatggcgatcattaaaaagtcaggaaacaacaggtgctggagaggatgtggagaaataggaacacttttacactgttggtgggactgtaaactagttcaaccattgtggaagtcagtgtggtgattcctcagggatctagaactagaactaccatttgacccagccatcccattactgggtatatacccaaaggactataaaacatgctgctataaagacacatgcacacatatgtttattgcggcactattcacaatagcaaagacttggaaccaacccaaatgtccaacaatgatagactggattaagaaaatgtgccacatatacaccatggaatactaagcagccataaaaaatgatgatttcttgtcctttgtagggacatggatgaaattgtaaatcatcattctcagtaaactatcacaaggacaaaaaaccaaacaccgcatgttctcactcatagatgggaattgaacaatgagaacacatggacacaggaaggggaacatcacactctggggactgttgtggggtgaggggagtggggagggatagcattaggagatatacctaatgctaaatgatgagttaatgggtgcagcacaccagcatggcacatgtatacatatgtaactaacctgcacattgtgcacatgtaccctaaaacttaaagcataaaaataaaataatgataataataataataataataataatctttaagtaaaaaaagctcttaaatagaatctggcataaaggaaaaaaaaaaaaaagctgctcctcgccctttgtcagatgagaagattgtaaaaattttctcccattctgtaggttgcctgttcactctgatggtagtttcttttgctgtacagaagttctttagtttaatcagatcctgtttgtcaattttggcttttcttaccattgcttttggtgttttagacatgaagtccttgcccatgcctatgtcctgaatggtattgcctaggttttcttctagggtttttatggttttaggtctaaggtttaagtctttaatccatcttgaattaatttttgtataaggtgtaaggaagggatccagtttcagctttctacatatggctagccagttttcccagcaccatttattaaatagggaatcctttccccattccttgttttgctcaggtttttcaaagatcagatagttgtagatatgtggcattatttctgagggctctgttctgttccattggtctatatctctgttttggtagcagtatcatgctgttttggtgactgtagccttgtagtagagtttgaagtcaggtagcgtgatgcctccagctttgttcttttggcttagaattgacttggcaatacgggctcttggttggttccatatgaactttaaagtagttttttccaattctgtgaagaaagtcattggtagcttgatggggatggcattgaatctataaatgaccttgggcagtatggccattttcacgatattgattcttcgtacctatgagcatggaaggttcttccatttgtttgtatcctctttgatttcattgagcagtggtttgtagttctccttgaagaggtccttcacatcccttgtaagttggattcctaggtattttattctctttgaagcagttgtgaatgggagttcactcatgattttgctctctgtttgtctgttattggtgtataagaatgcttgtgatttttgcacattgattttgtatcctgaaactttgctgaagttgcttatcaggttaaggagattttgggctgagacaatgggattttctagatatacaatcatgtcatctgcaaacagggacaatttgacttcctctttttctaattgaatacgctttatttccttctcctgcctgattgccctggccagaacttccaacactatgttgaataggagtggtgagagaaggcatccctgtcttgtgccagttttcaaagggaatgcttccagtttttgcccattcagtatgatattggctgtgggtatgtcatacacagctcttattattttgagatacgtctcatcaatacctgatttattgagagtttttagcatgaagggctgttgaattttgtcaaagatcttttctgcatctattgagataatcatgtggtttttttcattggttctgtttatatgctggattatgtttattgatttgcgtgtgttgaaccagccttgcatcccagggatgaagcacacttgatcgtggcggataagctgtttgatgtgttgatggattcagtttgccagtattttcttgaggatttttgcatcaatgctcatcagggatattggtctaaaattctccttttttgttgtgtctctgccaggctttggtatcaggatgatgctggcctcataaaatgaattagggaggattccctctttttctattgatgggaatagtttcagaaggaatggtaccagctcctccttgtacctctggtagaatttggctgtgaatccatctggtcctggactttttttggctggtaagctattaattattgcctcaatttcagagcctgttattgatctattcagacaatgaacacaaacaaatttacaagaaaaaaacaaataaccccatcaaaaagtgggcaaaggatatgaacacacttctcaaaagaagacatttatgcagccaacagacacatgaaaaaatgctcaccaccactggccatcagagaaatgcaaatcaaaaccacaatgagataccatctcacaccagttagaatggagatcattaaaaagtcaggaaacaacaggtgctggagaggatgtggagaaataggaacacttttacactgttggtgggactgtaaactagttcaaccattgtggaagtcagtgtggtgattcctcagggatctagaactagaactaccatttgacccagccatcccattactgggtatatagccaaaggattataaatcatgctgccataaagacacatgcacacgtttgtttattgcggcactattcacaataggaaagacttggaaccaacccaaatgtccaacaatgatagactggattaagaaaatgtggcacatatacaccatggaatactatgcagccataaaaagtgatgagttcgtgtcctttgtagggacatggatgaagctggaaaccatcattctcagcaaattatcgcaagtacaaaaaaccaaacaccacatgttctcactcataggtgggaattgaacaatgagaacacttggacacaggaaggggaacatcacacactggggcctgttgtggggtggggggttggaggagggatagcattaggagatatacctaatattaaatgacgagttaatgggtgcagcacaccaacatggcacatgtatagatatgtaacaaatctgcacgttgtgcacatgtaccctaaaacttaaaatataattaaaaagaaaaaagctgctactcaccccactcagctgaaattgatcattcttggcattcactgcaagctataagctctgcaaatggtgaccttgacatgatagccttaaagtaacacctgaaagaggaaatccccatgctattctagtttctatttcttcttgtggaacctggtatgtggatctcagtcactgaatttagtggctaaattcctattcatggctggaatgactgtgggaggcatcctatatggccatttatcagacaggtgtgcatctctgtttcacatatctctttattagtgcatatttccattagcttatgaatcattcattaatttaaaaatatttattgtaaatcacactgttctaaggatactctggtcctcagggatctagaattacaagtggagaattacaatctgtagggtcagggctattttgtcagcactgaatgctatgtacaagacacagaaatggcatctccattagacctggaagcatttcaggccagggtttggaaatgcactaccacaacatgtggtttagaaagataggaattgttactgtcttagtctattttctacccctataacagaaggtcacagactgggtaatttattaaaataatagaagtttatttggctaatggttctggaggctgaaaggtccaagagcatggcgccagcatctggtgagggactttgtgttgtatcatccctggaagaaggtggaagggcgagcaatggcacaagacagagaaaggatgggggctcaacttcgttctcttgttaggagcccctcccatgattactaacccactttcaggataactctattaatttattcacgaggtcctacctcttaaaggtccttactcttaaaggtcctacctcttaatacaatcacaatagtaactatatttcaacatgagtctggagggtatatccaaaccatagcatttacctataggaactgagaagatgtttcatgacataggattcagcctgtttgaagatgcagatatggaaaacagtgttgtagacctttgccagatgtaccatgtttagtctttccttaaccctgtgaactgaaggcttgtgggtgccagagaatgaccatcacattatagttgcccaagtgtgatgggtagacattactgcaaaaccagtaggatcatagcaatgtgtcatttatgatatgttaaaaattgatgctaatattcttaatttttgtttctgaaagagtaactttttaaagttaagttttataatatgtagggtaatcaatatgaaaactactgtcacagttgtgttagaaatttggagtatcctgtggctagcaatgtctctttggaaataggcagccaacgattaccattatccaagcatataatccccgagcaacatgggagaattaaggtgcttatcatctgctagcctcacattatctgttgcctcagccataaactgtgatctccacaggtgtgacagtaaatgtaatttataagagttcagagtcatagtgttcatttctagcaattcagtaacttagcactctgtgggagcgttataagaaaatgctgataggtcaattttgatggatcataaggtaatagaaatgaaggattagggcaggagatggcagcagagaactaaattaatctgagtggttaagataatctaaggattttgaacttcattggaaaactgaaggtaaacatggaatgagagggccacaatcaaattgatatttttaagtaacatacttaactattcacaatattctaaagctaacagcagtctagaattccattaattatagaatggataaaaaagatacagattattcacataatggatttttatacacaaaaggtaataaataagctctctgtgcattaacatagttgagtataaaaatcatttttttaagcagcataagaacaacaaaaatgattgtatactataccattccacttatggtcaaaaataaggaactacgttatggtgttcggcgttagaaaaggagttctctttaggatttttattaaaattacattaaatgtatacagcagtttaggtaaaattgccattttttaaatgttgaattttctgatctttgaatatgatagagctgttcctaaatttaaattttctttaatttaccatgcaatgttttctatttgttaaaaagaaagtcatgtgttttccattaaatttattcctaataaatctagttgaggctctgaagttggtttttgtaattttaatttttgattagccattgctactacatacaaatagcaattgacttttacatattaatcttacattctgccaccgtgatgaattcacttatcagttctagtacattattgtggattccttaaagtcttcaattacacaattatatcatctgcaagtatggatagttttgcttattattttcctatcttttgcctctgttactttttctaaaagcacctaggacttttagtaaaatgttaattttaagtagtgagatctgatatcctgaccttgttttctgatcttaggttagaagtgaagctttaatgattacatatgatgttaagtatagtattatttttagatgcccttaataatggttgagaagtttccttatatttatagctttctgagagtttttgttgtgaagtaattttgacataaaataaacactaattttttttattattatacttaaagatttagggtacatgtgcacaacgtgcaggttagttacatatgtatacatgtgccatgctggtgcgctgcacccactaactcgtcatctagcattaggtatatctcccaatgctatccctcccccttccccccaccccacaacagtccccagagtgtgatgttccccttcctgtgtccatgtgttctcattgttcaattcccatctgtgagtgagaatatgcggtgtttggttttttgttcttgtgatagtttactgagaatgatgatttccaatttcatccatgtccctacagaggacatgaactcatcattttttatggctgcatagtattccatggtgtatatgtgccacattttctcaatccagtctatcgttgttggacatttgggttggttccaagtctttgctattgtgaataatgccgcaataaacatacgtgtgcgtgtgtctttatagcagcatgatttatagtcctttgggtatatacccagtaatgggatggctgggtcaattggtatttctagttctagatccctgaggaatcaccacactgacttccacaatggttgaactagtttacagtcccaccaacagtgaaaagtgttcctattcctccacatcctctccagcacctgttgtttcctgactttttaatgatcgccattctaactggtgtgagatggtatctcattgtggttttgatttgcatttctctgatggccagtgatgatgagcattttttcatgtgttttttggctgcataaatgtcttcttttgagaagtgtctgttcatgtcctttgcccactttttgatggggttgtttttttcttgtaaatttgtttgagttcattgtagattctggatattagccctttgtcagatgagtagattgcaaacattttctcccattttgtaggttgcctgttcactctgatggtagtttcttttgctgtgcagaggctctttagtttaattagatcccatttgtcaattttggcttttgttgccattgcttttgctcttttagacatgaagtccttgcccatgcctatgtcctgaatggtaatacctaggttttcttctagggtttttatgcttttaggtctaacatttaagtctttaatccatcttgaattgatttttgtataaggtgtaaggaagggatccagtttcagctttctacatatggctagccagttttcccagcaccgtttattaaatagggaatcctttccccattgcttgtttttctcaagtttctcaaagatcagatagttgtagatatgcggcattatttctgagggctctgttctgttccattgatctatatctctgttttggtaccagtaccatgctgttttggtgactgtagccttgtagtagagtttgaagtcaggtagcatgatgcctccagctttgttcttttggttcaggattgacttggcgatgtgggctcttttttggttccaaatgaactttaaagtagtttttccaattctgtgaagaaagtcattggtagctagatggggatggcattgaatctataaatgaccttgggcagtatggccattttcacaatattgattcttcctacccatgagcatggaatgttcttccatttctttgtatcgtcttttatttcattgagcattggtttgtagttctccttgaagaggtccttcacatcccttgtaagttggattcctaggtattttattctctttgaagcaattgtgaatgggagttcactcatgatttggctctctgtttgtctgtataagaatccttgtgatttttgcacattgattttgtatcctgagactttgctgaagttgcttatcagcttaaggagatttggggctgagacaatggggttttctagatatacaatcatgtcatctgcaaacagggacaatttgacttcctcttttcctaattgaataccctttatttccttctcctgcctgattgacctggcctgaacttccaacactatgttcaataggagtggtgagagagggcatccctgcctcgtgccagttttcaaagggaatgcttccagtttttgcccattcagtatgatattggctgtgggtttgtcatagatagctcttattattttgagatacctcccatcaatacctaatttattaagattttttagcatgaagagttgttgaattttctcaaaggtcttttctgcatctattgagataatcatgtggtttttgtcattggttctgcttatatgctggattacgtttattgatttgcatacatggaaccagccttgcatcccagggatgaagcccacttgatcatggtggataagctttttcatgtgctgctggattcggtttgccagtattttcttgaggatttttgcatcaatgttcatcagggatattggtctaaaattctcttttttggttgtgtctctgcctgactttggtatcaggatgatgctggcctcataaaataagttagggatgattccctctttttctattgatgggaatagtttcagaaggaatggtaccatttcctccttgtacctctggtagaattcggctgtgaatccatctggtcctggactctttttcgttggtaagctattgattattgccacaatttcagctcctgttattggtctattcagagattcaacttcttcctggtttagtcttgggagagtgtatgtgtcaaggaatttatccatttcttgtagattttctagtttacttgcatagaggtgtttgtagtattctctgatggtagtttgtatttctgtgggatcggtggtgatatcccctttatccttttttattgcatctatttgattcttctctcttttcttctttattagtcttgctagcggtctatcaattttgttgattctttcaaaaaaccagctcctggattcgttaattttttgaagggttttttgtgtctctatctccttcagttctgttctgattttagttatttcttgccttctgctagcttttgaatgtgtttgctcttgcttttctagttcttttaattgtgatgttagggtgtcaattttggatgtttcctgctttctcttgtgggcatttagtgctataaatttccctctacacactgctttgaatgcgtcccagagattctggtatgttgtgtctttgttctcattggtttcaaagaacatcttcatttctgccttcattttgttatgtacccagtagtcattcaggagcaggttgttcagtttccatgtagttgagcggttttgagtgagtttcttaatcctgaattctactttgattgcactgtggtctgagagatagtttgttataatttctgttcttttacatttgctgaggagagctttacttccaagtatgtggtcaattttggaataggtgtggtgtggtgctgaaaagaatgtatattctgttgatttggggtggagagttctgtagatgtctattaggtccgcttggtgcagagctgagttcaattcctgggtattcttgttgactttctgtcttgttgatctgtctaatgttgacagtggggtgttaaagtctcccattattaatgtgtgggagtctaagtctctctgtaggtcactcaggacttgctttatgaatctgggtgctcctgtatggggtgcatatatatttaggatagttagctcttcttgttgaattgatccctttaccattaagtaatggccttctttgtctcttttgatctttgttggcttaaagtctgttttatcagagactaggattgcaacccctgcctttttttgttttccatttgcttggtagatcttcctccatccttttattttgagcctatgtgtgtctctgcccatgagatggctttcctgaatacagcacactgatgggtcttgaatttttatccaatttgccactctgtgtcttttaattggagcatttagtccatttacatttaaagttaatattgttatgtgtgaatttgatcctgtcattatgatgttagctggttattttgctcattagttgatgcagtttcttcctagtctcgatggtctttacattttggcttgattttgtagtggctggtaccggttgttcctttccatgtttagcgcttccttcaggagctcttttagggcaggcctggtggtgacaaaatctctcagcatttgcttgtctgtaatgtattttatttctccttcacttatgaagcttagtttggctggatatgcaattctgggttgaaaattcttttctttaagaatgttgaatattggctcccactctcttctggcttgtagagtttctgccgagagatctgctgttagtctgatgggcttccctttgtgggtaacccgacctttctctctggctgcccttaacattttttccttcatttcagctttggtgaatctgacaattatgtgtcttggtgttgctcttctcgaggagtatctttgtggcattctctgtatttcctgaatctgaatgttggcctgccttgctagattggggaagttctcctggataatatcctgcagagtgttttccaacttggttccattctccccgtcactttcaggtacaccagtcagacgtagatttggtcttttcacatagtgccatatttcttggagactttgctcatttctttttattcttttttctctaaacttcccttctcacttcatttcattcatttcatcttccatcactgataccctttcttgcagttgatcgcatcagctcctgaggcttctgcattcttcacgtagttctcgagccttggctttcagctccatcagctcctttaagcacttctctgtattggtttttctagttatacattcttctaaatgtttttcaaagttttcaacttctttgcctttggtttgaatgtcctcccgtagctcggagtaatttgatcgtctgaagacttcttctctcagcttgtcaaagtcattctccgtccagctttgttccattgctggtgaggaactgcgttcctttggaggaggagaggcgctctgctttttagagtttccagtttttctgctctgcttttccccatctttgtggttttatctacttttggtctttgatgatggtgatatacagatgggtttttggtgtggatgtcctttctgtttgtcagttttccttctaacagacaggaccctcagctgcaggtctgttggagtacctggccgtgtgaggtgtcagtctgcccctgctggggggtgcctcccagttaggctgctcagggggtcaggggtcagggacccacttgaggaggcagtctgcccattctcagatctccagctgtgtgctgggagaaccactgctctcttcaaagctgtcagacagggacatttaagtctgcagaggttactgctgtctttttgtttgtctgtgccctgcccccagaggtggagcctgcagaggcaggcaggcctccttgagctgtggtgggctccacccagttcgagcttcctggctgctttctttacataagcaagcctgggcaatggcgggcgcccctcccccagccttgctgccaccttgcagtttgatctcagactgctgtgctagcaatctgcgagactccatgggcataggaccctccgagccaggtgtgggatataatctcctggtgtgccattttttaagcccatcggaaaagcgcagtattcgggtgggagtgacccaattttccaggtgccgtctgtcacccctttctttgactaggaaagggaactccctgaccccttgcacttcccgagtgaggcaatgcctcaccctgcttcggctcatgcacggtgtatgcacccactgacctgcacccactgtctggcactccctagtgagatgaacctggtacctcagatggaaatgcagaaatcacccatcttctgcatcactcacgctgggagctgtagaccggagctgttcctatttggccatcttggctcctccctccaacactaatttttataataccatatttttactgtaccttttctgtatttacatatacctagatacacaaatgccattgtgtttcggtagcctatagtattccttacactagcatgctgtatgggttcataacacaggagcaatatgctataccatttagcttaggtgtgtagtaggctatactatctgggtttgtgtaagtatattctattatgttcatacaacaaaaatttacctaacaatgcatttcttagaacatatccctgttaagtgatgcatgatcatatgagactaggacatataggtcttccttacattcagaaaaaaggaaatcaatggtgattatcaaaccagactgcacaacagttaatgattaatgaaacaatagtctttacacttagcggaatacaaatttctcttctttgggacattaagcaagtacaacccaattatcatactccttattgtatgaaagagtgtcctcattaatttggctatgaattccctttatgtatgtatggctctgtttctctttttcttcatgccttaatatgattttctacttcataacataggaatcagtatatagtattaactgcctgtatttctttaaatttatatatattttttacaaaattagtgacactgtttacatatcttttaatttttatgtcatgtaaatgttttatctcattatttttcttttatggacactctattctgtttttaagatacacatacatgcctctgtgtgcttctggttcatttttctaactgctacactttgctccacagtggagatccattatggtcttcctaatatctttctcaggaatggacaaccaggttgccatcaaaggtttgccactccgaaatatcaccacatttaacaaccttacacacacacacgcacacacgcacacatatggccacagatgtgcatatggaattacatctagcatagctcagatacttaatttttcaaatgttgaatatatatctgctttgtggagtcctaaaaatctcccatgattattgtgtgggagtctgaccacataatttttgactgaccaggctttccaataattcctatttcattattttattaattgtaacactttttacatagattctattccattatgaagtacacatttagaaattgagcatatattgtgtaaacatccagaatatatgacttaatagtcatattataatgtaaacatgctgtgagagtagcaaagattgcagagcatctgcccaatcccagtattttcccagtggtatacattattggtcatatagaatcaccacacatcgttttgtctccccaaaatctttgaaacagaaaattcctttttgttcgctttttaaaccctctgattctgattctctgtttcctcagcttatcttatctaatgctttcctcttcaaactatgtataagttcccctgtctgagttgtgactccctggtatcctgttgtagaaaacatacattatgcaaggcctacaatcaaactaggcagagaggcgcttttatgaaatccattagcagcttgatatattcttctatggattgtcctttcaaatcagtttagccttggcctgcatggtcctaggatgccaaatgcagatttagatcctgtattaattagctggggctaccataacaaaaatttgtgtttttgcgtagcttaaacaaaagaaatttactttctcacagttgtggatgctgggaagttcaagatcaaaggactagctaattctcttcctggtctgcagtcagccactttctgctgtctttccatagaggtaagagagaaagagagagagagagcaaaagcatgcacaagcaagttctctcgagtatcttcccattagggaacgtatcccattatgaaggccccaccctcatgacatcatctaaagctaatgacttctgaaaagccccatctccatacagaatctcactggaggttagggatcaacatacaaatttgcagcggacacagttttgtccatagcagagcacctgtattctgcacactaaacagagtctttcttcactctactaaatacacgtgttagtacaagggacatttatgatgcgtaaaactgagtctctttatgctaagtgcatgtgttagtacaagggacatttatgatgtgtaaaattttccaacattgtagcctgtcttacatggtttcaattaatatcaaagatcaatttgtaacagattaaagaagaatctttgatgcactcaatatctagttaaaaacagggaacatgacctctgagtagaattgctattgattatctgttgatgctttaaggttttaaatgcaaagtttcacttgttaaagcatcccttaaatttcaaagtgtgcttttctacccttgacttttattttagatatggggggggtaatgtgcaggtttgttacgtgggtatattggactcaggtagtgagcatatacccaagagatgcttttatgacccatgccccactcccttgaccctatagtagtttgccatggctattgttcccatgtttaagtctatgggtgctcaagtttagctcccagttataagtgagaacatgaggtatttagttttctgtttctgcattaattcacttaggattttggactccagttccatctatattcctgcaaaggacatgatttcaatattttttaaggcttacatagtattccatggtgtacagcaccacattttctttatcccatccaacattgatgggaacctacattgattctatgtctttgttattgtgaatactgtggcaatgaacatatgagtgcatgtattgtcttatataatgatctattttcctttggatatatatccagtaatggaattgctgggtcaaatgctaactctgttttaagttctcaattaatctccaatctgctttccacagtggctgaactaatttacattagtacattttaccctattatatttttctctgaagccttgtcagcatctgttacaattcaccttgtaaacagaattaaaaacaaaaaccatatgatcatctcaatagatgcagacaaagccttcaataaaatccaacatcacttcataatataaaaaaccctcaacaaactagacattaaatgaacatacctccaaattaataagagccacgtatgacaaacccacagccaacatcataggcaaaagccaaaagaatttcccttgaaaaccagagcaagacaaggatgcccattctcaccactcccattcaacttagcactggaagtcctgccagatccatcaggcaagagaaagaaataaaagacatccaaataggaaaagaacaagtcaaactatctcttcactgacaatatgattctatgcctagaaaaccctgaagactctgccaagtggctactagaactgacaaacgattttagtgaggcttcagaataccaaatcactgtacaaaaattagtagcatttatatacaccaataatggccaggctgagattcaaagtatgctttctcctttctgagtttcacaagtggttgttgttgccattatctaacctgtctctgtttctcaggtttgggaggaggttaatgttcagatggtgttagctccagctcaccatttctgacacctgtgcagccttttctcccactttcctcatttactgctccttacgtttcttggctgggatttctaccatgaccatcccagcaaataatgtgtgctgagtaagtcaatgctttggatcttgacttttccaatccctgactttggcattgaaattccaccttcatttgaagtcaaaatcctgtttgcattttttgtcagttgcacagtaaacagcatgccaattcagagtcatgtgaatgacactgacatttggcattgtttcttttaatttttttttaagttcaggggtacacgtgcaggtttttcttttcttttcttttcttttcttttctgagacggagtctcgctctgtccccaggctggagtgcagtggcgcgatctggactcaccgcaagcttcgcctcctgggttcacgccattctcctgcctcagcctcccaagtagctgggactacaggcacccgccaccgcgcccggctaattttttgcatttttggcagagatggggtttcaccgtgttagccaggatggtctcgatctcctgaactcgtgatccgcccgcctcggcctcccaaagtactgggattacaggcgtgagccaccgcgcccggccgacgtgcaggtttgtaatataggcaaacccctgtcatgaaggtttgtcgtacagattatttcatcacccaggtattaaacctagtacattatttttcctgattctctccttcctccaatcctttacccttccagcccgagtctgttgctcctctctatgtgttcatgtgttctcatcatttagctcccacttgtaagtgagaacatgtggtatttggttttctattcttgcagtagtttgcgaagggcaatggcctccaattccgttcatgatccttcaaaggacgtgatctccttcttttttatggctgcataatattccataatgtatatgtatcgcattttcttttttaaaaaaatgtgtttcattttaagttctgggatacatgtgtaggacgtgcaggtttgttacacaggtaaacgtgtgccatggatatgtatcacatcttctgtatccattgatgggcatttaggttgatttcatgtctttgctattgtgaatagtgctacagtgaacatcaacattcacgtgtctttatgatagaatgatttacattcctttggatatatttggatacccaataatgggattgctgggttgaatgataatcctgttttaagttctttaagagattgccacgctgtgttccacaatggctaaagtaatttacattcccacaagcagtgaataagcattcccttttcttaacaatcttactagtatctgttatttttttacttttaaatattaataacagccattctgacaggtgtaagatggtatcttattgtggttttgatttgcttttatctagtgattagtgaggttgagcattttttcatgtgcttgttggccacatgtatgtcttcttttgaaaagttcctatttatgtcctttgcccaatttttaatggggttgttttttgcttgttaattttttaagttccttaaagattctggatgttagacctttactggatgcacagtttgcaaatatttctcccattctgtaggttgtatgtatattctggtgatagtttcttttgcagtgcagaagctctttagtttaattaggttccattagtcaatttttgtttttattacaattgcttttggggacttagccataaattctttgccaaaacctctgtcaataaaggtatttcttaggttttcttctagaatttttatagtttgaggtcttacatttaattctttaatctatcttgagttggttttttcatacagtgaaaagttgtggtccagtttcattcttctgcatatagctagctagtaatcttagctacatttattgaatagggagtgctgtctccattgcttatttttgttgattttgtcaaagatcacataattgtaggtgtttgagtttatttctgggttgtttattttgtttcactgatttatgtgtctgtttttataccggtattatgctgttttgattattgtaaccttatagtgtagtttgaagtcaggcaatgtgatgcctccagctttgctctttttgcatagggttgctttggttattcaagttctttttgttctaaatgaatttcagaatagatttttctaattttgtgaaaaatgatgttggtatttttgatagtgatagtattgaatctgtaaaccgttaagggcagtatggccattttaactacattgattcttccaatctgtgaacagagagtatattccacttatttacatcatctctgatttttttcagcagtgttttgtaactctccttgtaaagattgttcacctccttggctaagtaaatcctagatatttcattttctttgtggctattgtaaatgagactgtgttcttgatttgattgtcagtcagaatgttattagtgtatacaaaggctactcatttttatacctttattttgtatcctgaaactttactgaattcatttatcagctccaggagctttttgttaaaatatttagggatttctaggtatagaatcacatcactggaaaagagagctagtttgacttattttcctacttaggtgtctttatttctttctcttgtctgatggctctggctaggacattcagtactaagttgagtagatgtgctgggtgtgggcatccttgtcttgctccagttgttaaggggaatggtttgagttttgcccacttagagtaagtttggctgtgtgtttatcatagatggctcttattattttgaagtatgttgcttcaatccgtagtatgttggttttaatcatagaaggattggattttatgaaaggatttttctgtgtctattgagatgatcatacgggtttttaattccttttgtgtgaattatataattgatttgcatatattgaaccaaatttgcatcccagaaataaagcctacttgatcgtggtgaattagctttttgatgtgctgctggattcagtttgctagtattttattgaagatttttgcatcaaggttcatcaaggatacaggcttgatgttttcttttaccattgttctctgctggattttagtatcaggatgctgctgcctccatagaatgagttagacagaagcctcttcttaatttttttgaaaagtttcagtaggattggtagcaattcttctttgtacatctggtagaatttggctgagaatccatgaggtcccggacacttttttttggtaggattttttattactgatttaatttccaaacttattgctggtttgttaaggttttccctctcttcatgattcagtcttgagaggttgtgtgtttctagtaatttatccatttcctctagattttctaatatgtgtgtacagaggtattcataatagtctctgatgatcttttgtatttctgagggatcagtaatctttccatttctaattacgcttatttggatcttctctctttcttttctttgttaacctgctaatgccctatgaatcttgtttattcttttgaagaaccaactcttggtttcattagtcttttgtatggacttttggggctcaatttctttcagttcttctctaattttagttatttctttttttctactagctttagtatgggagtattctttttctctagttcctctgattgccatgttaggtcattaatttgagatctttttaatctcttaatgaaggtgtttagtgctataaatcttaacactgctttagctgcatcccaaaggttttggaaaattgtgtctctattttcattaatttcaaagcattttttaaatttctgtcttagctttgttgtttacccaagatttattcagaagcaagttgtttaatttccatttttttaatagttttgagatatctttttggtattgatttatatttttagtgcactatcgtccaagagtgtgttttgtatgatttcaactttttaaaatttatggagacttgctttatggttgagcatgtgggcaatcttaaaatatgttctgtgtgcttataagaagaatgtatattctgtgattattgggtggagttctttgcagatgactattaggtgcaatttggtcaagtgtcaagttttagtccagaatttctttgttagttttctgccttgatgacttgtctaacactgtcggtggggtgttgaagtcccctactattattgtgtggctgcctaaatatttttgtagggcaagaaaaacctgtctcatgaatcttgatgctccttttttggatttttataaatttaggatacttaagtcttctttttgcattgaactctttatcattatgtactgcctgccctcctttgtcctttctaattactgttggtttaaaatctgctttatctgatataagaatagagattcttaatcttttttgttttccatttgcctggatctttctccattcctttactttgagcctgtggttatcattacacatgagatgcatctcttgaggacaaatgacagttgtgtcttgtctttttatcccacttgccactctatgccttttaggtggggcatttaaaccattcatatttaaggctagtattgatatatgggattgtgatcctgttatcacattgctggctgtttgctttgtagacttgattgtgtgattgttttatgtagtctgtacactatgttcttgagtgtatttttgaggtagtaagtttcaatcttttgtttccatggttagcaccaccttaaggacatcttgtaagggtggtctactggtaatgaattccctttatgcttgcttgtctgagagggattttgtttctcctttgcttatgaagcttggcttggtagaatatgatattcttggttagaatttcttttctttaaaaatgctgaaaataatccctcaatctcttctggcttgtaagtttttttctgagaggtctgctgctagcctgatgggtttctctttgtaggtgacctgacctttctgtctagctgcctaaatttaagatttttttcttttgcattgacagtgaatctgatgactatgtttcttggagatggtcatcttatgtcatatctccaaagagttctctgtatttcctgaaactgtatgtcctcttctctagcaagagtgaggaaatttatggactatatcatcactatgttttccaagttgcttactctctatcctctttcaggaatgccaatgagttgtagattcgttgtctttacataatctcatatttcttagagattttattcctttttaaaaaatctttttcttcatttttttggtctcactgagatgattcgatgaaccaatcttctaactctgagattctttcttcaacttaatgtattctgctgttgctccctctgtttttattgtaaaattattgaagtgaattcttcaattacagaagttcagtttggttctttcttaaaatggctatttcatctttcagctcctggattattttactatactccctcgattccttggtttaggtttcaactttctgctcaatcccagtgaacttccttgccatccagattttgaattatatgtctgtcatttcagtcatctcaatctggctaagaaccatccctgggagccttgtgtgtttctttggaggtaagggagcacactggctttttgagttgccagagttcttacattgattctgtctcatgtctgagggttggtgtgcctttaattgtgatgtaagttgagtatagtcagttggcttcatttctaggtgttgtcagaaggccaggactctgtgcagaatctttatttgtgactggatctttgcattagttttgcaggtgctatatactggcacaatattttggtgttgtattttggactgcaatccagttggtggcacttaagagtgttgactagcagataagctcttagtcagacagcttttttgtattttggtgcagttggcagtagtgctctgtggtgtgggggacagggataacgccctcacctgatctactcctgggtcttggaggagccctctacattcactggctgcatgtctgcatttcctttgttagacttcctggtccacagggctccctcaggcagaggccatggttggcagagagaccatacccttctgggttttttaaattattattatactttaggttctagggtacatgtgcacaacgtgcagatttgttacatatgtatgtatgtgccatgttggtttgctgcacccatcaagtcgtcatttacattaggtatttctcctgatgctatccctcccccatccctccactgcatgacaggccctagtgtgtgacgttccccgccctgtgtccaagtgttttcattgttcaattcccacctatgagtgagaacatgcagtgtttggttttctgtccttgtgatagtttgctcagaatggtggtttccagctttatccatgtccctacaaagtacatgaactcatcccttttttatggctgcatagtattccatggtgcatatgtgccacattttcttaatccagtctatcactgatggacatttgggtgggttccaagtctttgctattgtgaatagtgccacaataaacatacgtgtgcaaatgtctttatagtagcatgatttataatcctttgggtatatatccagtaatgggatcgctgggagagaccatacctttctcagtccagccctatggagggagtcacacccttctcctcccaagtggctcacctctctcagtgttctgagagtgagggctcctcactgcttgggtcctgcctaagctgatatgtcctgcttggctagagcagtgggagtgggtgtagttgcccaatccactgtccaggtgcttcccataggaacacagagctgcacctactggcagagttcaggcagaggtgggtcctctgtgttggaatccccaactggtgcatcctgcccaggtaggaggagggggggttggcatggtggcccaatccattgtctgggtgcttccctagggaattcagggctgcacttgccagcagagttcaggcagaagaaggtctgctgtgctagaagccccagcaagcatggcctgtctggctgtgagcaagcagtgaagtcacctaccctgcatccagatatttcctgggggaaaacagggctgcaaccgcccacagagttcaggagaagcaggtctgctgtgctggaagtctgtctagttacaagcaagcagaaggagtgggtggagtagcccactctgccagccagatgtttcccaggggaacatggggctgctcctgcctgcagagttcaggcagaagtgaagccactgtgctggaagatgtgcaggggatgatggggcggtcttactgctcctgggcactgcatctgtggtgcctactggggctatggcagtactctactgtttcagggtccaaggctttatagaggtcgctataaacttgagtttgcctctgcaaaacctgtgaacttgagtgttgcctctgcaaaacctctggatgtttctctctaacagtctagaggccttagggggtaggaggattttcccatttcaaagctttcaaaggtccctgtggaaggtgtgaatcttccaggggttctcactcaccctttccccatggtgggaaacttgtcctggctccacaccaatccaagatgggctgctgcccattttctctcttctctattctctgtgtccccttgctaccatgatggatcctgttgtggattcctagtttatagacttgcagggtcagtattcactacgctcttggtctcctctccatgaaagcagcacacactagccacttttagtctgcctcttttgatcccctccctcaacaaataatttttatatacatatgttcaaaatattccatgggatatagtttactaaagaattatttactatttgtttgaattcaaatttaactagacacactctattgttatttgctaaaaccagtaacctcccctgagccaatatgactcctagtctgcattccctgcagtgaaggtatactgcatggaaagtcatcttcatattgacccagtaatggcacaagaggatgtaaatttatatttccaggtataactgaacaagtgctgggcattagatgagagaggaaaggcatcacagtataaaggttatgtgaaaaatgagtaagtgagagttgactggaccttcgtcctcttctttaatcaggtgactggaagcacctgctcaatgtctgctcatcaacaacaaaccagaggagggcttaaaagaactcagaaaagctgcatgctggaatagaatgaagaatgctggagacaccctaaccatggaggtgagcaggatgggagctggatataggatgtgaggaagacataacttgcattcatactatctagtgtccaaggtgcataaagcatgggaacacaggtctgatatggctcttcttatctcacctcattgtcctggttctcaaggggtgttgcaattgtttggcttagtgttgaaagagaatatgttgttactgaaagaaatggacacagatactttacttagtagagacagagggcacttagtattccttctggcttaatattctttgggcttttttccagggcataagccagcagaaggaagggttagtgaccatgcagaatagaacaccaagaggttcacttatttgtttattcactcacacactcattcattcatgtatattttctgagtgcccatgtgtgtcaggttctggtctatccctggaaataccacaacaatcataaaggtcaaaatccctgttgtatggagtgtaaattctattattacaagatttaagggcatgactaagtggaaatacctcagagaaagatttctcttttttttacatacagatagaaaacacagatattccaacttacaagggacgtgaaggacctcttcaaggagaactacaaaccactgctcaatgaaatcaaagaggatataaacaaatggaagaacattccatgctcatgggtaggaaaaatcaatatcatgaaaatggccatactgcccaaggtaatttatagattcaatgccatccccatcaagctaccaatgactttcttcatacaattggaaaaaactacttcaaagttcacatggcaccaaaaaagggcccgcatcaccaagtcaatcctaaggcaaaagaacaaagctgggggcatcacgctacctgacttcaaactatactacaaggctacagtaaccaaaacagcatggtactggtatcaaaacagagatatagctgaatggaacagaacagagccctcagaaataatgccacatacctacaactatctgatctttgaaaaacctgataaaaacaagcaatggggaaaggattccctatttaataaatggtgctaggaaaactggctagccatatgtagaaagctgaaactggatcccttcctcacaccttatacaaaaattaattcaagatggattaaagacttaaataaactggattaagaaaatgtggcacatatacaccatggaatactatgcagccataaaaaatgatgagttcatgtcctttgtagggacatggatgaaattggaaatcatcattctcagtaaactatcacaagaacagaaaaccaaacaccgcatattctcactcataggtgggaattgaacaatgagaacacatggacacaggaaggggaacatcacactctggggactgttgtggggtggtgggaggggggagggatagcattaggagatatacctaatgctagatgacgagttagtgggtgcagtgcaccagcatggcacatgtatacatatgtaactaacgtgtacattgtgcacatgtaccctaaaacttaaagtataataataataaattaaaataaaaaaagattaagggatttggtgaagtaaatggaaaaaaaaagagaaaacacagatattgctgtggatcataaagtaaaccatttatcatattatgcacatattaaactgtgttgaaaaattatagtaggctaggcatgaagcttgatcatgaataacagtataaatcagggtcccaggttttaaggagcttttatcttaataagagaaagtaaaagtaatagcttctttaaatgttttattctgatctaaatcagttaaaatgacacctgctctcttaacaaatgtttaagtgcacaatacaatattgttaactataagtacaaggttgtacagaaggtctctacaatttttatcctgtatcactgaaactctatacccattgaacagcaatttcccatttccccctacctccagcttctgaaaaccaccattagggatattggtctaaaattctctttttttgttgtgtctctgccaggctttggtatcaggatgatgctggcctcataaaatgagttagggagaattccctctttttctattcattggaatagtttcagaaggaatggtaccagctcctccttgtacctctggtagaattcagctgtgaatccatctggtcctggactttttttggttggtaagctgttaattatagcctcaatttcagagcctgtgtttcgtctattcagagattcaacttcttcctggtttagtctggggagggtgtatgtgtcgaggaatttatccatttcttctagattttctagtttatttgtgtacaggtgtttatagtattctctgatggtagtttgtatttctgtgggattggtggtgatatcccctttatcattctttattgtgtctatttgattcttctcttttttcttctttattagtcttgctagtggtctatcaattttgttgatcttttcaaaaaaccagctcctggattcattgatttttttgaagggttttttgtgtctctatctccttcagttctgctctgatcttagttatttcttgccttctgctagcttttgaatgtgtttgctcttgcttttctagttcttttaattgtgaagttagggtataaattttagatctttcctgctttctcttgtgggcatttagtgctataaatttccctctacacactgctttcaatgtgtcccacagattctggtatgttgtgtctttgttcttgttggtttcaaagaccatctttatttctgccttcattttgttatgtacccagtagttattcaggagcaggttgttccgtttccatgtagttgagtggttttgagtgagtttcttaatcctgagttctagtttgattgaactgtggcctgagagacagtttgttataatttctgttcttttacatttgctgaggagtgctttacttccaactatgtggtcaattttggaataagtgcggtgtgctgctgagaagaatgtatattctgttgatttggggtggagagttctgtagatgtctattaggtccacttggtgcagagctgagttcaattcctggatatccttgttaactttctgtctcattgatgtgtctagtgttgacagtggggtgttaaagtctcccattattattgtgtgggagtctaagtctctttctaggtctgtaaggacttgctttatgaatctgggtcctcctgtattgggtgcatatatatttaggatagttagctcttcttgttgaattgatccctttaccattatgtaatggccttctttgtctcttttgatctttgttggtttaaagtctgttttatcagagactaggattgcaacccctgcctttttttgttttccatttgcttggtagatcttcctccatccctttattttgagcctatgtgtgtctctgcatgtgagatgggtttcctgaatacagcacgctgatgggtcttgactctcttgcaaaaatcctcaataaaatactggcaaaccgaatccagcagcacatcaaaaagcttgtccaccatgatcaagtgggcttcatccctgggatgcaaggctggttcaacatacgcaaatcaataaacataatccagcatataaacagaaccaaagacaaaaaccacatgattatctcaatagatgcagaaaaggcatttgacaaaattcaacagccctacatgctaaaaactctcaataaattacgtgttgatgggacatgtctcaaaataataagagctatctgtgacagacccacagccaatatcatactgaatgggcaaaaactggaagcattctctttgaaaactgacacacgacagggatgccctctctcaccactcctattcaacatagtgttggaagttctggccagggcaatcaggcaggagaaggaaataaagggtattcaattaggaaaagaggaagtcaaattgccctgtttgcagatgacatgattttatatctagaaaaccccatcacctcagcccaaaatcttctgaagctgataagcaacttcagcaaagtctcaggatacaaaatcaatgtgcaaaaatcacaaggattcttatacaccaataacagacaaacagagagccaaatcatgagtgaacccccattcacaattgcttcaaagagaataaaatactaggaatccaacttacaagggatgtggaggacctcttcaaggagaactacaaaccactgctcaatgaaatcaaagaggatacaaagaaatggaagaacattccatgctcatgggtaggaaaaatcaacatcgtgaaaatggccatactgcccaaggtaatttacagattccatgccatccccatcaggctaccaatgcctttcttcacacaattggaaaaaactactttaaagttcatatggaaccaaaaaggagcccgcattgccaagtcaatcctaagccaaaagaacaaagctggaggcaacacgttacctgacttcaaactatactacaaggctacagtaaccaaaacagcatggtactggtaccaaaacagagatatagaccaatggaacagaacagagccctcagaaataatgccacatatctacaactatccgatctttgacaaacctgacaaaaacaagaaatggggaaaggattccctatttaataaacggtgctaggaaaactggctagccatatgtagaaagctgaaactggatcccttccttacaccttatacaaaaatcaattcaagatggattaaagacttacatgtcagacctaaaaccttaaaaaccctagaagaaaacctaggcaataccattcaggacatacgcatgggcaaggacttcatgtctaaaacaccaaaagcaatggcaacaaaagccaaaattgacaaatgggatctaattaaactaaagagcttctgcacagcaaaagaaattaccatcagagtgaacaggcaacctacagaatgggagaaaattttcacaacctactcatctgacaaagggttaatatccagaatctacaatgaactcaaacaaatttacaagaaaaaaacaaataaccccatcaacaagtgggtgaaggatatgaacagacacttctcaaaagaagacatttatgcagccaaaagacacatgaaaaaaatgctcatcatcactggccgtcagagaaatgcaaatcaaaaccacagtgagataccatctcacaccagttagaatggccatcattaagaagtcaggaaacaataggtgctggagaggatgtggagaaataggaacacttttacactgttggtgggactgtaaactagttcaaccactgtggaagtcagtgtggtgattcctcagggatctagaactagaaataccatttgtcccagccatcccattactgaatatatacccaaaggattataaatcatgttgctataaaaacacatgcacatgtatgcttattgcagcactatttacaatagcaaagacttggaaccaacccaaatgtccaacaatgatagactggattaagaaaatgtggcacatatacaccatggaatactatgcagccataaaaaaggatgagttcgtgtcatttgtagggacatggatgaagctggaaaccattattctcagcaaactattgcaaggacaaaaaaccaaacaccgcatgttctcactcataggttggaattgaacaatgagaacacatggacacaggaaggggaacatcacacaccggggccagttgtggggtggggagacaggggagggatagcattaggagatatacctaatgttaaatgacgaattaatgggtgcagcacaccaacatggcacatgtatacatatgtaactaatctgcacgttgtgcacatgtaccctaaaacttaaagtataattttaaaaaaaagaaaatgtggcacatatataccatggaatactatgcagccataaaaaatgatgagttcacatcctttgtagggacatggatgaagctggaaaccatcattctcagcaacctatcgcaaggacaaaaaaccaaacaccacatgttctcactcataggtgggaattgaacaatgagaacacatggacacaggaaggggaacatcacacaccagggactgttgttaggtgggggtaggggggagggatagcattaggagatatacctaatgctaaatgatgagttaatgggtgcagcacaccaatatggcacatgtatacatatgtaacaaacctgcacgttgtgtacatgtaccctaaaacttgaagtataatttaaaaaaaagaaaaagaaacattatgttaaatgaattaagccagatatacaaagtcaagtattttatgattcaatgtataaatcaaatgtccacaataggcaaatccttagaatcagaaagtaaattagcggttgctaagtgggatgtgtgaataaaaatggagagttactgctaatgggtatggtttcctatgtggtgattaaaatgctctgtaacgatatagtagtgatgattgcacaactctttgaatgatcaaaacacattcaattgtatactttaaaagggtaaattgtatggtaaatgaattatacttcaaggaggtttaaattttaatagaaattttagtcctaatcaaggtgacattttctcccatattttgcctccaattcttccacagcacatagtgcatctcacataatatttataatgttggagtgcaattgtttatgtactctctcttacttactcaactataagatccttgaacttgtcacacacgttactttaggaactagcatggaaaaggtcttcacaaatactatctgaaaaatcaataagccagtaaaagtaaacctccatatgagcttactcctctgcttttcatcaccatctattctgtccacatttcaagcaatgtatttccagcatgaatttgtggtgtgatttgacatgaaggagaacatcagtcaccaaaatgaaaggattgtaccacagtacccttattttagtttaacttcgacttttttagattaactcttaatcaaaaattggtacttaacaaggaaaaacttgccttctgttgttttcagagaagtaaaaaaagcacctcacctttgagtcgccaaaattatgcttcctggaatgaccgcataccatgtagcaggtttattttagtttgtttacagaaaagtgtagaccaaagtccagtgctgactttgggagctactaaagacatgaaaaagtagaattttaaacacatttcattgtaaacgactgggagtatctgagcaaattatttcttacgtgactttagagaaaacggctacctatctgaccccaaaacgacttgaggaaactgtttccacggtcctgctgcagaggggaagcacagtcgtcaagaagagagtggggtcaggatcaaaacacatttagtgtgacttagggaaagaaaacattttccctctttgaacctctctggatacagtcattttgcctctacttgaggatcaactgttcaacctcaatggcctttcaggacctcctgggtcacgctggtgacctgtggagattccagatccttcagactgtttttctctcaatctttgctgttgctacataccttcattttatgctggagaacttcactgcattcatacctggccatcgctgctgggtccacatcctggacaatgacactgtctctgacaatgacactggggccctcagccaagatgcactcttgagaatctccatcccactggactcaaacatgaggccagagaagtgtcgtcgctttgttcatcctcagtggcagctccttcacctgaatgggaccttccccaacacaagtgacgcagacatggagccctgtgtggatggctgggtgtatgacagaatctccttctcatccaccatcgtgactgaggtaagaggctctgttctcgtctcatgagtatgtgacctgggtgtttagaataacacaagtaataatcatgcttccagccttcagtcacatgtaggtccttagtcttcattctttcagcaaatactaattgcttctttattaaatgtctgacacctacacattttgagtaatgaattccaaagtagaaggcatcctgctattataatgctttaagtcacagggagaccaaagtttaaacaagcatttatatataatatgttaaaatgttctgctaggtcagtgatgctcagcctgtcattgcaaattagaaatatctgggaaattgagaaaagcctccatgcccagagtataccctaaaacaatcatatgagaaggtctaagagggaaatttaggtttctaaaagtttttaaaggtcttcaagtgattgcaccatgtggtcatgtttgagaaccatttagtatgaaataaaaacctataggtttaggaaagtcttccaagagaaagttatgtttaagttgagacctgaataacaaaggtcaggtaatgctgagaaaggaagccacagaggaagttagagacttaatattaggaaacttgcagatcatgctaagaagttttgatcaagttacactgaggggtaataagcattgatgtgctggcttccttctcttccagtgggatctggtatgtgactctcaatcactgacttcagtggctaaatttgtattcatggctggaatgatggtgggaggcatcctaggcggtcatttatcagacaggtgagtgtgtatggaacacagctctctttaagggcattttttatcaacttatgaaacattatttcatctagaattacttactgcaaattacattctcctgaggctgccctgatccccaaacagaaaaggaaatttttagtccgtgttttgagtgctatttttaaaatttgagctctgtatgcaggacacagaaatgatatctccatgtgaactgggggtgtttcaagacaggttttagagagaaggtaccacaacatgtggtttagaaatatgagaaagagttaactaagggaatagaaaggaagacgtttcatcacataggattcagccttggccaggagtaccaggtccagtcctacctggacactgtgagctgatagcttgtgcccagagaattgtcattacatcatagttccaagtgtgatgaacacgcattcctctaaaacctgtagggtatatttgaaggtatcattggtggtgtgttgaaaaattatgtgtagaaacttgattattgtctttgcaaaaacagctttttagaaccatgtgaggtaagtaatccaaggataatactatctcagtctgtggtgtgagaagtttggggtattcaccttgctgtatgtctcctgacatggcagggaacaattaccttcacccaaccatgtctcccctgatggcgatgagggacttgaagtgccacttgccatccaccaacatcatgtcttctggtgtctcacctgaaaatttgaaccttgaatgtacgacaggaaatggaatgtagaatgagctaagagtcagagggttaatttccaatagttagtcacccagtcctctgtgatactgtcctgggaaaatgcagatagaccaattttaatagatcacagggtggtaaaagaaggggtaggagatgccaggcaggagatgacagtggagaatcagctaaagacgaagggacaagataacctaaggattttggtatttctcacaaacctaagaggaaatattatgtgattatatgcagagtaggctatgatcaaactgattgttttggaataactcactcaactgtttatgatatcttaaaatcggaaataatctataatttcattaataataggttaataaataagcagatattcacataatgaatttttacagcaaagggaatgaataaagtactgtctgcaataaggtgaattaacatcaaaaccatttggttaggtaccacaagaccaacaaaaagattacatactatagtgttccaccaatgtaaaagtcaaaaacaaggaactacattatgatgtgagaaaagggagaaatctaatttcctttagatttctattggaattgcattaaatctaaacagcagtttgggtaagactgacattttttaaatactgaattttctgatctataaatataatattgcttttaattaaggtagacttttgtttaatttccctttgcaatattttatagtttatgataaaagtcatgtactttttattaatttatttctaattcatatgtaaagataatttacatgtaaattatgtacatatatgtaaagataattaactttttcatagtaaacttacatcctgccaacaggataaatttattagttctagtagctatttatggattccttaaaatttcccaacttgatcatatcatctgcaaggtggaatagttcaaatcactaatgttctactttttccttttaatctctttctagcagtagctaaaacctttgatacaatgccaatgacattggtgagagctgaaatcctgcctcaccacaggctatattgttccagttgtctacagagaggactcctttcccagaaaacagtaaaacactaaattccctttttcttttttttcctttttttttttctttttttttttgccctcccctgcaacacttcaacaactttgatgtattgttctatggatgttcctttcacatcagtatacccatagcctgcactgtcctagacttctacatctagatttagatgtcttataggctatgccctgctcaggctctctactatgctaaagtacatgggagacacattgtgttattagtacgctgtgtgttagtacaagggacttctgatactttaaaatgtccaatattccaccctgtcttatgtggtttcaattggtgtcaaaaatatactgctaagagattggaaaataagctttgatctacttggtatttatttagaaacagggaacattgtgtctgagatctgccattgattactgattctttaaggcttcaaatgcaaagtttcacttgttaaacatcttttaagtttcaaagtgtgccttctctttgctaagtttttccacttgttgttattgttcccattatctaacctgtttctgtttctcaggtttgggagaaggttcgtgctcagatggtgttacctccaggttgccattgttggcacctgtgcagccttggctcccaccttcctcatttactgctcactacgcttcttgtctgggattgctgcaatgagcctcataacaaatactattatgttaagtaagccaacactttggatccacattttccaaactgtgactttgaaattgaaactccacctttgaagtcaaagccttatctgttttttcttccagtagccgagtgggcaacacacagattccaggccatgggaattacattgggaatgtgcccttctggtattgcatttatgaccctggcaggcctggcttttgccattcgagactggcatatcctccagctggtggtgtctgtaccatactttgtgatctttctgacctcaaggtatgagtttgtttcttcttttgtcttaatgagatattggaatgagaatgtatgtggaactaggacacctgaatttctttttgttctttgtgtaaacctgagagcacgtcctctcataatctgtgcttgatgtgcaatacaagaagcagaacacatagagtttcctgataaaactgagggcaatcaatgaaatttcaacataaggtaaccaacaaatatttctctaaaattatatctcaaatattgtaagagacataatttactcaagatcatttattgtttatatgaaatttcattcacctgagagttcttttatttaaatgaataaaacataggaagtcccattaaattcaaatttcagataagggatgaataatttttaatataattatgtccaaaatattgcatgagacatgcttatactaaaacattttcctgcttaatagaaattcaaatgcatccatgccactgtgttttcatttgctaaaaccagcaacccatgacatggggaatagcaatgaatcattgcctgagacttcttagtgtccttggatatcctcgccttaacaagtattatggaaacagaattattacaaaaatgttttccccaatacaggaaaacatttgaggagctatcttccatggtagtctatgtttttatatatatccttggaaaaaaatacatgatggagaagtttgggattttttttcttaattattataggtgatattggatgaaaagaaggtgtagcaaatttactttcataactatctaaagaaagagctgcatggtttcttcaattaaaatattaaggcaaaatggataatttacctcatttgtcagtattccatcttccttctatcagctttgcaaatacttatagtcggttaactatactctccccttaaaaaagccagttcagtgaaagacatctatttggactttaccttagagagatgattacagatttaatacagagagaagagttcagatagaaaagtaagcaaactccctgtcaggctcatccattcatttatcttatctccataacagccctacaaggtaatattctctccattacatagatgagaacactgaggaatatttaggtaagtaacttgttaatatgtccagtttattcacagatgatatgaccaggagtgattctagttgtatgaggccttaagcatgcataaattatttgagggactttattttagggaaaagaacacattaagaatagacataagtcatgacctcactaggaccttggcagggatctatctgtacaagtgacggtccttcatgctgcagtgtcaggagctccaaggtaaatttgccaagtaagagaggagccagtatgattccaagtctgcattcccaacagtgaatatgtactggatggaggagtcatctcacatttttctagttatagtcaaagagaatgtgagtttacatttcctggtaaaaccaaacaagtggtggatattagcttggagggagaagacatcttaagaaaaaactaatgtaagaaatgaggaagtgaaagtcgactgcccctctgttctcttccttggtcagttggctgctagagtctgctcggtggctcattatcaacaataaaccagaggaaggcttaaaggaacttagaaaagctgcacacaggagtggaatgaagaatgccagagacaccctaaccctggaggtgagctggatgggagctagatatgggatgtagggaagacataacttgtcatcaatacttagcagtagcagtgtccataaggtaaaaaaaggaaagaaacacaggtatggttatgggctgtatcacctcactatcatttttaatgggcttcaatattgtttgggttaacattgaaggggaatatgctgttgccaaaaggatgagacacagatattttactcaatggaggcagaggcacaaagtattaactattgtaaagattttgcattgaactcattctaactgtgtaataggagtaaccaaaactagttcattccttcccatttattattctgtgggtctctttcagggtagtaaagccagaggaagggttagtgagcaaatagaatacaacataaagagttcacttatttgttcattcaatcatacattcttccatttatgatacatttagtgaggcactacctatgccagattccattcttccctggaaatactgcagtgcccatatcaatccaaatccctatttgtctggagtttcattatacttacttactataagttcctaaagcatgactaagtggaaatgcctgtgagaagtctttctcattttaatccaccccagatcttaaagataaatgttgtcatggatctttaagttaaatattatccatgttatacacatatataaagtattaatcttaaaatgtggtatgcacaaatgatactagatcatgaataacagaataagtcaaggtaactacctgaatgaagcttttgctatgacagagaatatcaatggacagatttaaatccaaatattggaaatgatatgggaaaggaaagaatgctacttggaacaataaaaatacattttctcccattttattgaaaaaggagaggattaagagcaagcctcttaatatccttacatattaatattaaccttaaatgtaaaacatcacacttaaaagacacagagtgacaagttggattaaaaaaaaaaatacacccaattgtatactgacttccagagacactcacatgcagtgacacctataggctcaaagtgaaaggataaagaaaaatctaacaagcaaatggaaaacaaaaaaagagcaagggatgcaattctaatttcagataaaacagatgttaaaccaacagtgatcaaaaaaggcaaaaggagaattacataatgatccagggttcaattcaataagatttaactatcttaaatatatatgcacccaacactggagcacgaagattcatacaacgagttcttagaaatctacaaagagacttagataaatcatacaatgatagttggagaattcaacaccccactggcagtgttagacagattatagacacagaaaactaacaaagatgttcaggaactaaactcaacacttgaccaaatggacctaacagatatctaaggaacactccacccaacaacagcagaatatacgttattctcctctgcacatgacacatgctctcaaattgaccacacatcagccataaaacaatcctcagcaaattcaaaaagaaagaaagaaagaaagtaaaccaaccacactcctggaccacaacacaataaaagagagatcaatatgaagaagatctcccaaaatcataaaattacatggaaattaaacaaccttctcttgaatgacttccggataaataaagaaattaaggcagaaatcaagaaaacctttcaaactagtgaaaacaaagatataacataccagaatctctgggacacagctaaacacatgttaagaaggaaacttatagcactaaatccccacatcacaaagtttgagagatctcaaattaacaacctaacctcaaacctattggaactagaaaaagaagagcaaacaaaacccaaagctagcagaaaagaagaagtaaccaattcaaagctgaactgagtgaaattgagatgtaaaaaagatacatatcaacaaaaccaaagattggtaatttgaaagaacacattagatggatagactttcttaaactaataaagaaaaaaagagagcggattcaaataaatgcaattagaaatgacaaaggtgacattaccaccaacaacacagaaatacaaaaaacactcagagactattacaaacgcctctatgcgcagaaactagaaaacctggaagaaatagataattcttgtaaacattcaaactcccaatattgaatcagaaataaattgaaaccctgtataaaccaataacaagtttccaaactgaatcagtaataaaaagccagtcaactagaaaaatccctgggccacatggattcacagctaaattctaccagacatgtaaagaagagcttgtaccaatcctactgaaattattccagaaaattgaggcagggagactcctaactcattctacaagactagattcattctaataccaaaacctggcagagaaaaaaattttaaaaaaagaaaaaccagactaaaaacaaaaaacacattatcaacccaatagacagagaaaaggcttttaataaaattcaacatcgttcatattacaaaccctcaacaaactaggcatcgaaggagcatacctcaaaataatgagagctatctattgacaaacccaagccaagatcatactgaatacacaaaacctggaagcagtccccttgagaaccaggcaagacaaggatgtccacactcaccaattctattaagcatagtactcaaagtcctagccagagtaattagacaaaagaaagaaaaggccacaaaataggaagagaggaagtcaaaatatctctcttcacatacaatatgatcttatacatacaaatccctgtagttgtagcccaaaagctccttgatctggtaaacaattttagcaaagtttcaggatacaaaatcaatgtacaaaaatcagtagcatttctatacgctgacatcgttaaagctgagagccaaatcaagaatgtaatctcattcgcaataaacacaaaataataaaatacctaagaatatagctagctagggaggcaagagttctacaatgagaactacaaagcaatgatgaaagaaagcagagatgaccacaaacaaatgcaaaaacattccatgctcatggatatgaagaatcaatattgtttaaatggccatacacccaaagcaatttacagactgaatcctgttcctatcaaactaccaaagacattttttatagaattagagaaaactattctaaaattcatatggaacaaaaaaaaagagtttgaataaccaaagcaatccaaagcaaaatgaacaaagctgtaggcatcacactatctgactttgaaccatactacgagaacacagtaaccaaaacagcatggtactggtacaaagacagaaaggtagaccaatagaataggctagagcactgagaaataatgccatacctctacaaccatctgttcatcaatgaagtcgacaaaaacaagcaatggggaaaggattccctattcagtcaatggtgtgataactgactatccatatgcagaagattgaaactgaaccccttcctttcaccatatacaaaactcaagtcaagataaagacttaagtttaagacctaaaactataaaaatcctagaagaaaacatagaagataccattctggacaaaggccctgacaaaggtctcatgacaaagactccaaaagcaattgccacaaaaacaaaagttgacaaatgggaccaaataaactaaagagcttttccacaaaagttttcaacagagtaaataaagaagagtgtaaacagaaaacctatagaatgggagaaaatatttgcaaactgttcatccaacaaaggcctaatattcacaatctataaggcacatgaacaaattaaaaaagaacagacagcccataaaaaatggccaaagcacatgaacaaacagttgtttttgttttgttttgttttgtttttgagatggagtctcactctgtcacccaggctggagtgcagtggcatgatcttggctcactgcagcctccacctccagggttcaagcgattctcctgcctcagccttctgaagagctgggattacaggcttgagacatcatacctgactaatttttgtatttttagtacagatggggtttcaccatgttggccaggctggtctcaaactcctgacctcaagtgatccacctgccttggcctcccaaagtgctgggattacaagcgtaagccatcgtgcccggccaaacaaacacttctcaaaaaaagacatacacacagccaacaagcatatgaaaaaaatgctcaacatcactaatcattagataaatcaaatcaaaaccacgataagataccatctcacacctgtcagaatagcaattatttaaaagtcaaaaaataacagatgctggtgagactgcagaaaaaagggaacacttaaaaacttttgatggaaatgtaaattagttcagacactgtggaaagcagtgtggagatttctcaaataactgaaaataaaattaccattcgacccagcaatctactactgggtgtatacccctcaaaatgcaaatttttctgtcataaaggcacatgcatatgtaggttcatcacagcatttttcataataacaaagacatggaatcaacctaaatgcccatcaacagtggactggataaaggaaatgtaatgcatatacaccatggaatactaagcagccaaaaaaagaggtcatgtcctttgcagcaacatggatagagatggagttcattatcctaagccaattaatgcaggaaaagaaaactaaataccacatgttctcacttatatataggagctaaacattggtccaaatggagatttgtatacatacacacaaacaagagaacaatagacaccagagcctacttgggggtggaagatgtaaggaggtaagaaggtgaggatcaaaaaaactacttattgggtactgtgcttattaacttggtgatgaaatcatctacacaccaaacccccatgaaacacaatttatccatgtaacaaacctgcacatgtgccccgagcctaaaagttggaaagtaaaaaacaaaaaacaaataaaagagcattggaatcaaaaaagaatgatgcattattaaactaaatggcaactgatgatcccatcagtttcccagggaaaaaaagagagcattgcttatgaaatgcaattgaagcttggtatggaaaatggattttatacatgactggatacctaatgttgcctaaatttgaatttattattttataatgattattcataaaggtctggtcttagtcctgttttaacctccatctcacaggtttcctaatgtacctgttctagacaaccctctaacctaaagctgctccacattatgtcaatatcaatccattaattactccagtcttatgggtctgggagtccagtaaataacatacatctcctctgcccagatcacatataacccagagatatttaaagtggttaggaccatgaagataaaaaattttaggtgttttactactgtgaggactggaatagaggatgtgactttcaatacctaccatcaacattatttctaatgcttcattccataactgaacttacctgtcccagtttttttaacaggtacaaaacctaacctggtaaatatagggtgcagcccagaaagcaggcctgaatatgatctctttctaaaagtgttctgggcacttgagaatgcctatggcattctcccacactcaccaatcaagtaactcagttctttatgggtagctgagggtatgtacagaagggccaggattgtctcttttgagagttattcctcatggaagcatgagattagggagaaagcagcccctccttccccaaccttcagtatttctgagccaagaaccaaaatgagttctctcaggaaattttgctcctttctgaggcaagctgtttttcaccaggggcagtgagctgagaaccaatgtccacgtcctttggggaccatgtggtccaaatggagctttggactataatccaatatggccttcatttggactgtaatctttattcggtccccatcatggtctgattctctaacatacatacccttttcaatgctctgtagccacttggatctcttgtctaaaatatccttgaaacataatttcctggaggctgctttaacgtcctaattcacttttcacatcatttttacacatatcattgcattttaaggcttatattttccaccagacagaaagtgcagtcaactcacttctcatctgtgggttgaccagtgcgcctacagtgcctactcttttctgacaactgtacagtttattgtttctgctattgttgaagattttgaaatccaccatgaaaaaagaactggaggcagcacaaaaaaaaaaaccttctctgtgtgaaatgctccacatgcccaacatatgtaaaaggatctccctcctgtcctttacgaggtaagcttcatgcagtgtttgagggtaagttacagtactggagacatgaatcttgtcctcatttcaagtagtacagcatgtttaggaaacagatttgcacataaaagatgagaaagccgtaaagagaattgctgtgtttgaatgtagtaaaagagttgtgaaaagactgacacggaattaatttatgcaatagtttttgtttatcgcaacaccctatcaggctcttcactggacaccaacgcagagaacttcaattacagtatatgctttggcttgaagtttcttaacgtgtttgtttccagttttaatgaggtaaattacaaagagaattttgtacacaaatatatacagctcaatgattatttccatattttgatatgtaatttagatcaaggtacataaaaacctctaaaatactaggacatgatcgcaagcatagaaaaaacataaataggaagtcctacctattaatccccccacagaaacattgatttaacaatgattggatccaaatacctctatgagatttccaaaatagaggtaagatgttgtaaaacaatagatgagcacaaacccaagaacagttgcactgaaatgggtaagaagagtaatttcacctgacccatgacaaccccttcccaaagttgtttcagctcagtgccaagagagaacaccctggcctatgaccgctccctcatagaaaaggaaggagtggagcaatacacatctgggccttttgacacactgtgtgaggaactggtatttgtctcacctcactcagagcacttatggaacttgcatatttggatgtttgggtcactgaatagaaggtgagcacaaagaaaatctgtgactggtacagctcagtgcaataaaaataagatgggcaattttaggtttctccctcaggagggagggaagggagtgcagtatgtgtccaacattctaatttttcagggagatgcccaagaaatgtgtttttgtctttcccacccgggatgccaatgggactccagatactctggatatcttaagaataaaacatgataaaaaaaatctgactgtcatcctgctgcatcagagaactcatagtacagcagacagacaccacgggcagccagattacaagatattttaaaacagaaaccagtagatctctctgatcagaaatatgcacacacaaatacagataagacactttacagagaatgtttgacaagcccctagaatctctatttgggttgattggtgaaggtctttccctataaaagctagtctgggaagataggaagagggagctgtttcttcaaatgtgcatacaccaatgcaaagcttcaaagaacatgaagaaacagagaaacatgactcaaaagggaacaaaaaaatccccagaaactgaccataaagagaggtatatgaataaagtgataacaaattagaaacagctaccataacaatgcacacataagtcaagataaaaatggatgaacaggtcgggcgcagtggctctcacctgtaatcccagcactttgagaggctgaggcaggtagatcacgaggtcaagagatagagatcattctggccaacatagtgaaaccctgtctctactaaaaatacaaaaattagttgggcgtggtggtgcacgcctgtagtcccagctacttgggaggctgaggtaggagaatcacttcaacccgggaggtggagattgcagtgagctgagatcgtgccactgcactccagcctggtgacagagcgagactccatctaagaaaaaaaaaaaaaaagaggaacaaagtgagaaattcaacaaagaaatattgtaaatatttcaaatgaccaaaataaatcagggagtagatgaagacaatgactgtgctggggtgcatgtacaggatgtgcaggtttgttacataggtaaacatgttccatggtgatttgctgcacctatcaactcatcacctaggtattaagcccagtatgcattagctatttttcttaatgttctctcttcctgcacccaacccccaacaggtcccagtgtgtgttgtttctctccctgtgtctatgtgttctcattgttcagctcccacttataagtgagaacatgcagtgtttggttttctgttcctgcattagtttgctgaggataatggcttccagcttcatccatgtccctgcagaggacatgatcgcattttttttatggctgcatagtagttcgtggtgtacatgtaccacattttctttatccagtctatcattgatgggcatttgggttgattccatgtctttgctgttatgaatagtgctgcaatgaatgtacgtgtgcaagtatctttgtaatagaatgatgtatattcctttgcgtatatactcagtaatggaattgctgggtcaaatggtatttccgttctagatctttgagaaatcaccacaccatcttccacagtagtcagactgatttaccttcccaccaacagtgtaaaagcattactgtttctcctcaaccttgccagcatgttatttcttgactttttaatatttgccattctgattggtgtgagacggtatgttattgtggttttgatttgcatttctctagtgatcagtgatgttgagctttttttcatatgtttgttagccacatgaacgtatgcttttgagaagtgtctcttcatgtcctttgcccacttttcaatggagtttttttgttttttccttgtaaatttaagttccttatagactggatattacatctttgtcagatggataggatgcaaaaatttttcccactctgtagcttgcctgttcactctgatgatacagtttttttttttttttttttttgctgtgcagaagctctttagtttaattagatcctatggccaattttttttttgttgcagttgcttttggtgatttcatcatgaaatctttgcccatccctatgtcctgaatactgttgcctagatttaggattgtcccagctatatgagctcttttttcattccatataaattttaaaacagatttttctaattctttgaagaatgtcaatggtagtttaatggaaatagtattgaatctataaattgctttgggcagtatggccattttcacgatattgattcttcctatccatgaagatggaatgtttttccatctgcttgtgtcctttctgatttccttgagcagtggtttgtagttcaccttgaagaggtccttcattttccttgttagctgtattcctaggtattttattctctttgcagcaattgtgaatgggagtttattcatgatttggctatctgcttgtctgttgttggtgtatagaaatgcttgtgatttctgcatattgattttgtatcctgagactttgctgaagttgcttatcagcttaagaagcttttgggatgagtcaatagggctttctagatataagatcatgtcatctgcaaatgaagacaacttgacttcctctcttccgattcaaataccctttatttctttctctttcctgatcgccctggccagaacttccaatgctatgttgaataggaatggtgaaagagggcatctttgtcttgtgccagttttcaaggggaatgcttccagcttttgcccattcagaatgatattgtctgtgggtctgtcataaatggctcttataattttaaggtatgttccttcaagacctagtttattgagagttttaacatgaaggatgttgaattttattgaaggccttttctgtgtctattgagataatcatgtggtttttgtctttagttctgtttatgtgataaattacatttactgatttgcttatgttgaacaagctttgcatctagggatgaagccgacttcatcggggttaataagcttttttgtgtgctgctggattcagtttgccagtattttgttgagtatttttgcaccaatgttcatcaaggatataggcctgaagtattcttttattgttgtattcctgccaggtttttatccctaccaggttagcatgatgctggcctcatacaataaattagggaggagtccttccttttcaattgtttggaatagtttcagaagaaatggtaccagctcccctttgtacctctggtagaattcagctataaatccacgtggacctggacttttttttttttttttttttttttttttttttttggtaagtaggctattaattactgcctcagtttagaacgtattggtctattcagggattcaacttcttcctggttcagtcttaggagggtgtatgtgtccaggaatttatctatttcttctaaattttctagtttatttacatagaggtgtttattgtatcctctgatggtagtttgtatttctatggggccagtggtgatatccactttgccattttttattgtgtctatttgagtcttgtctcttttcttctttattagtctagctagcagtctatatattttattaattttttcaaaaatctagcctctagattcatcagttttttgaagggttttgtgttgttgttgttgatgattttgtttttttgttttgttttgttttttgttttgttttgttttttgttttttgtatcgctgtctccttcagttgcactctgatcttggttatatcttgtcttctgctagctttggggtttgtttgctcttggttctccagttcttttagttgtgatgttagggtgttgatttgagatctttctagctttttgatgtgggcacttagtgctataaatttccctcttaacactgctttagctgcaacccacagattctggtatgttgtctctttgttctccttggtttcaaagaatttgcagaaggatttttttaacttaatataatcccatttgttcacttttgctttggttgcctgtgcgtctggggtattactaaagaaatccttgcccagtccaatatcctggagaattttcccaattttttcttgtagcagtttcatagtttgaggtcttagatttaagaatttaatccattttgattttatttttgtatatggtaagagataaggatctagtttcattcttctgcatatggatattccatttcccaagcaccatgtattgaaaagactgtcctttccccaatgcacattcttgacacctttctcaaaaagaagtagactatagatgtttggatttacctctgggttctctattctgttacactgacctaagcatacactgatctatgtttttatgtctgtaccatgctgttttggctactatagctctgtagtataatttgaagtcacgtaatgtggttcctccagttttgttctttttactccagatagtttcgactattcttggtcttttttggttccacttaaatgttaggattgttttttctatttctgcggaaaatgtcattggtattttgatagggattgtattgaatcggtagattgctttgggtagtatggacatttcaacaatattgatttgtccaatccatgaacatggaatatctttccatttttaatcctcttcaatttcttacattaatgttttaaagttttcatcagagggttttttcactttttattaacttaatttctaggtattttattttatttgtaactattgtaagcatgttgactttcttggtcttttttagatggttccttattggcatatagaaatgctattgattttatttgttgattttgtatcctgcagcttcactgaatttgtatcctgcaactttactgaatttatttcttgtttctaatagctttgtggtggggtctttagatttttccaaatataagattatatcatctgcaaacaagaataatttgacttcgagttttccaatttgaatgtccttgatttctttctcttctctgattactccagctaggacttcaagggctatgttgaataacagagatgacagtgggcatcttttgtgtttcagatcttagatgaaaactttccattttttctccattctgtatgataccagctatgagtctgttgtttatggcttttatcatgttgaggtatgttcttctatgcccagtttttcgagaggttttttttttttatcagaaatggatgttgaagtttatcatatgctttttcagcatcagtggatatgatcacatggtattgtcctttatttggtcaatatgatatatcatgctaaccaatatgcatatgtttgactatccttgcatctgtgggataaattccccttagtaataattaatcattgttttaatgtgttgttgaattcagttttctagtattttgttgaagatttttgcatcaatgttcaacagggatattagcctgtaggtttctttttttaatgtgcctttgtctgattttggtatcagggtaattttagcctcatagaatgagtttggaagtattccctccacctgtattttttttttgaataatatgataaaaatggcattagttcttccttaaattttgataaaattcagcagtgaagctatcaggtccagagcttgtctttgctgaaagaccttttattatagctttgatcccattattttttattactctgttcaggttttaaatttcttcatggttcaaccttggtatgctattcgtgtctagtaattaatctatttcttctaagttttcaaacttattggcatatagttgttaatggtagcctctaatgacattttgaatttctgtggtatcagttacaatgtctcctttttaatctctgatttatttggatcttctctgtttagttaggctaaatgtttgtcagttttgtttatcttttcaaaaactaacttttaattttattgatcatctgtattgtgttatttattttattttaatttatttctgctctaattttttttttattttaagttctgggatacatgtgcagaacatgcaggtttgtttcataggtatacatgtgccacagtggtttgctgcacctatcaacccgtcatctaggttttaagccccacatgcattaggtatttgtcttaatgctatccctcccccttcccccaacccccgacaggccccagtgtgtgatgttcccctccctgtgtccatgtgttctcattgttcaactcccgcttatgagcgagaacatgcagtgtttggttttctgttcctgtgttagtttgctaagaatgatggcttccagcttcatccatgtccctgcaaagaacatgaactcatccatttttatggctgcatggtattccatggtgtatgtgtgccacattttctttatccagtctatcactgatgggcatttgggttggttccaagtctctactactgtaaatagtgctgcgataaacatacgtgtgcatgtgtctttatagtagaatgatttataatcctttgggtacatacccagtaatgggattgctgggtcaaatggtatttctggttccagatccttgaggaattgccacactgtcttccacaatggttgaactaatttacactcccactaacagtataaaagttttcctatttctccccatcctcatcagcatctgttgtttccagactttttaatgatcaccattctaactggcatgagatggtatctcattgtggttttgatttacatttgtctaatgaccagtgatgataagctttttttcatgtttgctggccacataaatgttgtcttttgagaagcgtctgttgatatcctttgcccactttttgatggggttgttttttctggtaaatttgtttaagttccttgtacattctggatattaggcctttgtcagatgggtagcttgcaaaaattttctcccattctgtagattgactgttcactctgatgatagtttcttttgatgtgcagaagctcttgagtttgattagatcccatttgtcaattttggcttttgttgcaattgcttttggtgttttagtcatgaagtccttgcccatgcctatgtcctcaatggtattgcctaggttttcttctagggtttttatggtttttggttttacatttatgtcttttatccatcttgagttaatttttgtataaggtgtaaggaaggggttcagtttctgttttctgcatgtggctagccagtttttccagcaccatttattagattgggaatcctttccccattgcttgtttttgccaggtttgtcaaagatcagatggttgtagatgtgtggtattatttctgaggtctctgttcttttccattggcctatatatctgctttggtaccagtgccatgctgttttggggtctgtaaccttaagttactgtaacttttggttatcgtctgaagccaggtagcatgatgtctccagctttgttctttttgcttaagattgtcctagctatacgggctcttttttggttccatatgaaatttaaagtagttttttctaattctatgaagacagccactggtagcttgatgggaatagcattgaatctatgaattactttgggcagtatggctattttcacaatattgattcttcctatccacacctgctctaatctttattatttattttcttctgctgatttggggtttggtttgctcttgcttttctagttctttaagatgtgtcatgaggttgtttctttcagtttattctatttttttgatgtagacacttatagctaaaaatatacctcttagtacttcttttgctgtatcccgtaggttttgatatgttgtgtttccattatcatttgtttcaagaaacttttaaacttccttcttaatttatttattgatccacttgcactcaggagcatattgtttaatttccatgtgttgatatgattttcaaaattcctcttgttattgatttctagttgtatttcatgtggccagataagacacttaatataatttcaattattttgacttttttcagacttgttttgtggcttaacatatggtctatccttaagaaatacccatgagctgaggagaaaagtgcatattcttcagccattggatgaaatgtttcataagtatctattaggtcgatttgttctacaatgcagattaagtccaatgtttctttgttgattttctgtctggatgatctgtccattgcagaaagtgggaagttgaagtctccagttattaatataattgtattggggtatatctctctctttaactctattaatatttgctttatatacctgggtgtgtatatatttacaattgttatattctcttgctgaattagctcttaatcattatataattaccttctttgtctctttttagacttttgccttaaaatctgttttctctgatgagtgtatctactcctgctctttcttggtttcctttggcatagaatatcatttccatccctttattttcagtctgtatatctttttaaatacagtggatgtcttgtaagcaacagatcattgagtcctgttcttaatccattcaggaactctctgtcttttgattggacagtttagttcatttaccttatatgttattattgattttaaaaaaaagacttacttctgtcattttgttatttgttttctggttgttttgtggtagtatcttccttctctccttccttcctgtattcctttaggtgaagatgactgtcattggtgatatgttttaatctcctacttttcattctttgtgtacctgttgcatgtttttcaatttgaggttaccatgaggcttgcaaataatatctttaacccataattttaaaccaatcacaatgtaacagtaattgcataaacaaacaaataaggaaagagaaaactaataaaatgtctacactgtaactttgtctcctggctttttaaccttttcttgtttttaaatcttactgtattttccatgtctgaaatttattcattattttttattgtttcatcttttaatcttcctactcaaaatacaagtagtctagccaccacaattacagtgttatactattctgtgtttttctgtgtacttacttttgccattgagttttgtacattcagatgatatattcctgctcatcaatgtcattgtctttcagatggaagaaatctctttgacatttcttgtaggacaggtctggtgttgatgaaatccctcagtatttgtttttctaggaaagtctttatttctccttcatgtttgaggctattttttggctggatatactactctgggataaaaggtttttttttcccccttcagctcttaaaatatatcatgcttgtctctcctggtctttaaaatttccactgcaaagtctgttaccagatgtataggagctccactgcatgttacttgttccttttctcttctgcttttagaattttttctttatcattggcttttgggagtctgactattaaaggccttgaggaagtctctttttttgcaacacttactgatatattgtagtttaataaaaacatagcttatacagttcattgaaaaagtattttaatgcaaacaccacttttacacaaaaccaaatgttgatattctcattttttaaaattcttggtttctctaaaacactaagatgatacctcaataagggttgcttcacattttccaatttcttgatctgtgcatgtcacaagtaaagatccagatttgttctttttgcatagtcttgctttggccatgcatgctctcttttggtttcatatgaattatagaattgttttttctaattctgtgaaaaatgatggttttattttcatgggaatcgcattgaatttgtagattgcttttggcagtatggtcattttcacaatactgattctacccatccattaacatgggatgtgtttccatttgtttgtgtcatccatgatttctttcagcagtgttttgtagctttccttgtaggggtcttttgtctccttggttaggtttattcctaagtattttaatttttttgcagctacgataaaaagggttgggttcttgatttgattcttcacttggtctctgttggtgtatagaagagcaactgattagtgtacattaattttgtatctggaaactttgctgaattcttttatcagttctaggaactttctggaggagtctctagtgttttcaaggtaaacaatcatatcatcagcaaacagtgacagtttgactatcagtaatatgctgaagaggagtggtgagagtgggcatccttgtcttgttccagttctcagagggaatgctttcaacttttccccattcagtattatgttggccgtgggtttgtcatagatggcttttattacattgatgtatgtcctttgtatgccagttttgctgagagttttaattataatgagatgctggattttgtcaagtgcttttcctgctgttagtctgatggggttccctttgtgggtaacccgaactttctctctggctgcccttaacattttttccttcatttcaaccttggtgaatatgatgattatgtgtcttggggttactcttcttgaggagtgtctttgtggtgttctctgtagttcctgaatttgaatgttggcctgtcttgttagattggggaagttctcctggataatattctgaagagtgttttccaacttgtttccatcctccccatcactttcaggtacaccaagcaaatgtgggtttggtcttttagtcccatatttcttggggattttgttcattccttttcattcttttttctctaatcttgtcttcatgctttatttcattaagttgatcttcaatctctgatatcctttcttccgtttgatcaattcagctattgatacttgtgtatgcttcacgaagttctcgtgttgtgtttttcagctccatcaggtcatttatgttattctctaaactggttattctagttagcaattcctctaaccttttttcaacgttcttagcttgagatgtgaggtatcattccagtcatcatgctatttgtcacatttataccttggttttttggtttttctttttttttaattctatttttgttttataggtcctgtgagatttaggctttaaagaggttctattttaatgtgtttccaggatttgtttcaagatttagaggtccttttagcaattcttgtaggggtggcttagtaatggtgaattctctcagcatttgtttatctgaaaaagacaatctttccttcatatgggatgtttagtttcactggatacaaaattcttggctgataattgttttgtttgaggaggctgaagataggaccccaatcccttctagcttgtagggtttcttctgagaaatcttctgttaatctgataggttttcccttttaggttacctggtgcttttgtctcacagcgcttaagcttctttcctttgtcttaactttagataacctgacgacaatgtgcctaggcgattatctatttgagatgaatttcacaggagttctttgtgcttcttatattcgcgtgtctagttctctagcaaggctggggaagttttcctcaatttttcccccaaatatgttttccaaacttttagatttctcttcttactcaggaacaccaaatattcttaggtttggtcgtttagcataatcccagactttttggaggctttgttcatattttcttgttcttttttcatttatttatttttttgtctttgttagattgggttaatttgaagatcttgtcttcgagctctgaatttctttcttctgcttgttcaattctattgctgaggctttccagagcattttgcatttctataagtgtatccaatatttcctgaagtttcttttgctttttctttatgctatctatttccttgaatatttctcccttcacttcttgtatcattttttacttccctgccctgagctttgcctttctctggtgcctccctgattagcttaataactaacctcttgaattctttttcaggtaaatcaagaatttcttcttggtttggatccattgctggtgagctagtgtaatgttggggggttgtttaagagccttgttttgtcattttaccagagttggttttctggttccttctcatttgggtaggtctagggctaaaggctgttgttcaggttattttgtcccatggtgttcccttgatggagtactctccctttttctagggatgtggcttcctgagagctgagctgcactgattgttatcttgcttctggatctagccatccaacaagtctaccaggctctgggctggtactggggattgtctgcagagtcctgtgatttgaactgtctattggtctctcggccatggataccagcacctgttctggtggaggtggctagtgggtgaaattgactctatgcaggttcttagctttggtggtttaatgttctatttttgtgctggttggcctcctggctgggggtggcactttccagagaacatcagctgtggagagaaaccagcagtgaatggggccctagaactcccaagaatatatgccttttgtcttcagaagttgggtaggaaaaggctatcaggtgggggcaggactaggcatgtctgagctcagactctccttgggtgggtcttactacagctgctgttgaggataggggtgaggttcccaggtcaaaggagttgtgtatttaggagtattatggctgcctctgctgagtaatgcaggttgtcagggaagtgggggaaagcccacagtcacaggcctcacccagctcccatgcaatccaaagagctggtctcactcccattgtgtcccactaacagcaccgagtctgttttccaggcagtgagtgagcagggctttagaaccttccccaggctacccacctcccagctgcaagagaaaagggctttagttctttctctgcctgtggagtctgcaggccaaattcgcactctctcccaagttctggccaggaggcttcacatccagttcaaattattacaaagttcagctgcagatatccttcttcctgtgacatttttctgcctctctccacagccccccacaaagtgccaggcaggaatggctggcatgggggcctagcaagctcccagggcctttcctgctgcttcctctgcccctgtatttctcttggctctctaaattaactcagctccaggtaaggtcagaaacttcctgcaaagtagaccttcagtttccccagtgggggtgcgtgttcaggggtggaggatctctcttttctacttctgcagtttgggcactcatcgtatttgggatatctcctggctcctgcaggagcagtcggcttcctccaaagggtctgtgggtcctttcaggaatcccgttttgtttctgcagtcattctggagctaaaattcacgatgcaagcctccaaacactgcacttcaattgcattttcaactccaaaatttctgcttcattatttttaattatttcaatttctttgtcaaatttatctgataaaattctgatttttttctctgtgttatctttaatttcatagattttcctcaaaagagccattctgaattctctgtgtgaaaggtcacatatctctgtctctccaggattggtccctagtgccttatttagtttacttggtgaggtaatgtttcctggatggtgctgatgcttgtggatgttcatcagtgtctgggcactgaaaacttaggtatttattgtagtcttcacagtctgagtttgtttgtacacatctttcttgggaaagttttccatgtatgcaaagggactttggtgatttgatctgtttttcatcactgcagacatatgttcattaggagggaccccaaggccagtaatgctgcagttcttgcagacccacagatatactgacatcatggtcatggataacatccagaagaattatctggattaccaggcagatacttttgttctcttcccttactttctctgaaacaaatgggcattttgtctctatactgagctgcctcgagctgggggaggggtaacacaagcacctctgtggccaccaccactggaactgcactgtatcagacctgaagccagtatagcactgggtatcacccaaggcccatagtaatcactgcctggctactgcctaggtttgcccaaggccctagggctctacagtcagcagttgtcaaagctggctaggttcatgttattcccttcacggtcacaagttccctacaaccacagatgggtctatagatgccatccagcaaccagggcttagagtcagaaacctttgaaatctatctggtgttttattctactgtggctgagctggcacccaaggcacaaaagaaagtcttttccattcttcccacccttttccacaagcagaggagtcatctcatggccaccaccaccccacgtttatggtaagtactacctgtttattgccaatgtgcactcaaggtctaagtgttcttcagtcagcttgtgtgaatgctgcttccaggcctgagaattacctttcagggaaatgggcttccctctggcccagagcaggtcccaaactgccatccaagagcccaggcttggatttatggaccccaagaccccacttggtgttctatcctatggtggctgagttggtacctaagctgcaagacgaagcctcctttaatcttggctcttcttttctcaagtagaaggagtgtctccccttaattaccacagctggaaatatgccaggtcccacctgaagccagcacaaggcagagtctcacccaaggccaatcgagtgaactacctggccaccactgatgattattcaggacccaaggttttttagtcagcaggtgatgaatcctgtcaggcctgcgtccttcccttcaaggcagtacgtttccttctgcccctggagatgtctggagatgtcatctgggagctacatcctagaatgcaggccccaggaccctattctactgtggctgaaatagtatccatgttgcaagacaaagtcctcttcattcttccctctcctctcctcaagtcaaagggagaattctctcctggagctgcaagctgctggggtctcactagatcacaggtcccccgagttcactgatcccaggcccagcacagcaccagggtttgcctaggaatagcagtccttgtagccaagactgtcttttaagtttatttaagaccccatagacctttagtccatgatggtgaggcttgtcagaacccagattctgaccactgggatgggcgattcccctctggctagggctggtctaaatgctccctccatggttgctggctgagttctgtctggtgctgctttcctctgtgacagggcagcactgattcccaatgcaaagtcccacaatcactgtgctctctatcccccaagcacacaaagatgccctgcaccaggcagccactgctgggagatgggcagggttggcactggcaattcaaggaagtctttcctaccctcttcagtgtctctttcagtgatatgaaattaaaaccaagtactgtgatctcccactttatttttggctcttatgaagctgccttttgtgtgtcgataattgttaaattttctgtttctgtgggaaagatgaccttagaggcttctactcagccatcttgctcctcttcgttgttctgtattattattccttcaaagaaactttctacttcagtgtatgcatccttattaaggcaaataactcagacttaaaaataatttatcatcaggtatttttgcaggcctcatattaaccacaaagcaaatagtctctaatagatacataaaaatgaaaagcaagaagttaaaacatactaccacacaaagtccttatacacaaaaaagaaaggaagaaggtatatagaggacttacaaagtaaccacaaaacaaataacaaaacggcagttataaattcttacctattaattgcattgaatgtacatggactaaattctccaattaaaagacatgaaatagctgaatgggttaaaaaacaaggcccaactctaagttcctacaagtaatgtacttcacctgtaaaattacacctgcactagaaatgaatggagagaaaaaggtattccatgcaaacagagggcaaaaaagagcaggagctgctatggtgatatccaataaaatagatttcacatcaatactgtaaaaacagacaaaggagatcattatataatgataaaggggtcaaatcagtaagaagatataaaaactgcaaatatatgtgttatcaacatgggagcacctagatatataaagtaaatactactagaactaaagagatagaccccagtacaaaaatagttgagaatttcaacaaccaacattctgcattgataagttcctctagatggaaaatcaaaaaagaaacattggactttattttcatgatagatgaaatagacttaataaatttttacagaacattttactcagcaaatgcaggatgtacattcttcccatcagcacatgcagcattctttagatagaccatgttagaacacaaaaacttctcaggaaattttaaaatttcagtcatatcaagttatcttttctgatcacattggaataaaacaataacaaaaggaactttgaaaaatatacaaatacctgaaaattaaacaatatgctcctaaatgacaaatgggtcaatcaaggaattaagaagaaaattaaaaatttcttgaaccaaatgaaaatggaaacacaatataccaaacctttgagatatggcaaaagaagcactaacaggtatgtttatagcaataaacacctacctcaaaacagtagaaagacttcaaatagcctaggatgtaccttaaagaagtagaaatgcaacaacaaatgaaacccaaaattagcagcaggaaagaaataataaagatcagagcaagaaataaacgaaattgatacaaaaaatacaagtcaaaagttgttttgtgaaaaataaacaacatcaacaaggctttatgcaaactaagaaaaaaatagagaaaacaaaaataaatcaaattgaagataaaaaagagatattacaactgacatcacagaaatccaatggatcattagagactattatgagcaactttatgccaataaattgaaaaccctagaagaggtggataaatttttttgacacatagaatattgattgaaccaagttgacacattaagaaatacaaaccatgaacagagcaataaccagcagcaagacaccagcagtaataaaaagtcctccatcaaagaacaatctagaacctgatagcttcagaacaactgaattctaccaaacatttaaagaactcatacctattgtacacaaactatttgagaaaataaaggaggtgggaatacttccaaactcatttcacaaggccagcattaccctgatgccaaaaccagaaacgaacacacacaaaaaagaaaacatcactgatgaacatagatgtaaaaattctcaacaaaatagtagcaaacaaaattttaaaacacattaaagagatcattcatcacgaccaagtgtgattcatcccaaggatgcaagaatggttctgcataggcaagtcaataaacataaaacataacattagtaggatcaaggacaaaaatatataatcatttcaacagacgccaaaagcatatgataaaattcgaattctctctttatgataaaagctctcaacaaactgagcataaaaggaaaatacctcaaaacaataagatcatatgtaacaaacccacagctaacaccatagagaatggggaaaaaaatgaaagctcttcttctaagatcatgtagaagacaagtatgcccactttcaccacttttactcaatacagtagtggacgtcctacccagagcaactaggcaagagaaaaaaataaaaggaatccatattggaaaggaagaaatcaaaatgtcctcatttgcatatgatataattttatatttacaaaaacccaaagaccctctcaaaaatctatctgaataaacaaaaaattcagtaaagtcgcaggatacaaaatcaacataaaacataattaccataactatatttcaataaacagcaatctgaaaaggaaattaagaaagcaatctcatttgcaattcgttacaaaaagtaaaatacctagtaataaactacaccaaagaactgaaagatttctacaatgaaaacaataagctgatacaaaaaatagaaagacatcccatgtgcatggattagaagaaccaatattgttaaaatgtccctattacccaaggcaatctacagattcaatgcaatctctatcaaaataccaatgacattcttcacagaattttttttagtcctaaaagttacacaaaatcaaaaaagacccataaagcgaaagaaatcctaagcaaaaagaacaaagctggagtggctgagctaatttgcattcccacccgcagtctactagtgttcccttttctccacaacctcaccagcatgttgatttttgactttttaataacagccattctgactggtgtaagatgctatctcattattgctttcatttgtatttctcaaatgattagtgatgttataagtttttttatatgcttgttggccatgtgtatgtcttctctggagaactgtcagttcatgtcctttgcccatttttaatgggtttgtttgtttgtttgttttattgttgctttatttgagtcccacatagagtccaaacattagacctttgtcaaatgcataacctgcaaatattttttcccattctataggttgtctgtttactctggtgttagcttcctttgctgttcagaagctccttggtttaattagttcctgcttttcaatttttggttttgttgcaattgctttttggagtctttatcataaaatctttgccagggctgatgttcagcgtggtatttcctcttttcttctgtgtttttaacacttttacatcttacattcaagcctttcatccatcttgggttgaattttgtatatggtcaaaggaaggggtctagtttcaaaattttgcatattgctagccagttatccaagcactatctattgaatagggagtctttccccattgcttgcttttgtcagctttgtcaaagatcaggcagttgtagatatgtggctttatttctgggttatctaatgactgtgttgcattggtctatgtatctgctcttatgccagtatcatgctgttttcattactgtagccttgttgtgtagtttgaaatcaggtagtgtgatgcctctcactctgttccttttgtttaggattgatttggctatttgagctccactgtgacatttacccatgtaacaaacctacatgtgtacccctaacctaaaatgaaagttgaaaaaaaaaaaggtttttaactaaatgtaaaattatgttttaaaagatcacataattagtaaatggtacaatcagaacttgaacactaatctgacattaaatcttgcacttctagccattataccatattactttccttttacactatactgtcttcactcaatatgtaattattttggaaattaaggacactaaaattcccataaacactaacatttttagaatatttgtatgtttgctcacctttcaccattttttgaagttcacacatatacatgctcatcaacttttgcttcagcttccctgaaggaagatctaaggagaagaaaaacactttccaaaatatatcaatacaaaagattgttataaaaagtcaatgacatataattgacaattggataaatggacagattctaagaatttcagactattaagtgaaattaatatagtcagaagactaaaaaccaaatatataaaagtaaaaaagaattccatattaatccattttctgattaaattatcaaagaaaagagagaattttgaaagcagcaagataaagtgactgacttgttacatactaagagaatgtcctccataagacgattgggggatggcagatttctgcagaaaccttgtaggccaacagagagtgggatgatatgttcagagagatgaaaaaataaaaggctaacaaaaattactgtatcttgcataccatccctcaataatgaaaagaaatactttcccacacaaacaaaagttgagtgagtctgtcagcaccccacctccattattattatttccaaagggaaaccttgaactttaaaaaatggcactaaagagcagcatgagagcatatgaacatataaagctcactgataaatgactaatgtgaaaagtccagtattaatattatactcaacaataaaaaactgaaaactcttcctttaagatcaagaacaagataaggattctactctcaccacttctattcaatatagtccttgaaattctaacaagagcaattagggaagaaaaagagataaaaaggtaagaaaaggagataaaatatgaagtgttttatggaggattaaacacgtaaaaaatgaaatagcatcctatacctattaggattatcattatcaaaaataaataaataaatcaatcaatcaatcaataaataaacaagaaataataagtgttcaaaggatatggagaaattggaacccttgtatattgttggtggccatataaaatgctacactcaccatgaagacactatggaggttagaactaccatatgattctgtattttcagttatgggatctcaattcttcagaaaagaattgaaatcagtatttggaagagatatttgcactcccatatgttcattgcagcattattcacaattgccaagatatggaagcaacttaactattcatttacatatgaatgaataagcaaaatatgttatatacctataatggaatattagcctcaaaaaagaaagaaaaaggtcatacccaacatgtatgaaccttgggctagcacagaagaacaaacactgtctgatttcacttatatgagatatctaaaaaaaagtcaactcatagaagcagaaagtaggatagtggttttcagggacagcggacagaggggaatagggagttgtcatttaagggcataaagtatcagttatgcaagatgcaaatgtcttggaaatctgctgtacaacattatgcttacagtaaatactgtactgtatctaaaaatttgttaagtaggtaaatctctcagcttaaggagattttgggctgagacgatggggttttctaggtaaatctcatcttatgtatttttatcacaatattttaaaaatgaataagtgttttgagagcccccaactaaatttggatttcagtaccagagtggttaaaaaccctgccctaaaaagaaaatgaatgggagctggatgtaggggtttacagtgttcacgcaatacttttccttcagtggatggcctgatgcctagttgtttgacccttgaccaggggaaccttcacacaggaagcttgtttatactggcagatgcccttggggctcttatccgacccatgtacagtttatgtctgcctgaccattgctctggcactggttgcctaacattgtgttctcactgcagtcctagggaaaacccagcctgaaacagcccctagtttttcagacagaaagcgtaaattcagtacaccaccacaagaagaagcaaattcaaagatgtctacttacagatcctgggaaaggagagaataatgaattgggagggcagtgttctgtccccatgtcagatgaggcagaaatgaagcaactggctgagaaaccaaaatctcagaaatcaccactacaggacttatctatgtaaccaaacaccacctgttccccaaaagctattgaaataataacaataataataataataataataaaaggaatacatggcaactagcagtttatataaagaaatcaggtgtgggtcacttaaagtttgcaggtaaatgcctgaatagttcatttaaaggaagcaacaggaaagcagggaacccagtcagctaaacaggagagatgactcaaagttatctctggcttctggtttgagcaatttggaagtggtgtgagaactagaaactgtgtcaagggcgactaagccctgctgtgctgtgagaaagttaaacttgtaatcaaaatgaacgatgagacaacataaaattgtaggaattccctctaacaagatacatatgtattctgaaaacgtaataaaaactattgactcctttctatgctaataaacaaaaccatcacgaggttatatgccattaaacataagtaatataaaaataggtttccttgttgcattctggatttactacacaggaccaactacacagtgaatgctgtggatatacaatctgtcactcaataagttgtacattttagtgacatttctgattgtaatggaggtaaatggacatttcagctcctgaggtactcactgggagtttgactaatatctgtaaatttttacttttaattttgtggccctcaggatagtgaattgtcttgcagtggtttttgttgtcatgtgagcaaattggctttagaatactaataaaagcaattacttataataaataaataaacctcaggccccatagtttaatcctccataaaacacttgctgtcttccaaaaaattaatgacaattatgaccatcatcgtcttaccatcattttacgataatttaaaaatcaacatattgtggtatcttcagttctctttgtcacttactttagctttgagagacaggacttggtggttgaaatatgagtttgagacttggtttgcttttgtggaggaaggtggcagcattttcaaatggaactgtcttcttttcccacacttttagtcatcatctttgtaggtagtattatacttttgtctcatttttatcaaatagaagctaccaaagatacctttgaaaagtcttcagaaattatcctgcttcataagacacagtctgtatctctttctgaacatatttaagcatctaacttccagcctcttctctagtattaataacttcttcacaaatagttccataatgttatcattatcacttaatagatttctttaaatcacgttgcaagaaaatattccatgaaatagacccagcctttatactttaacaatccctagctgcctgggccaatattattctcatttgtaggatgtaggctccacagattataatatgtttctttcctttttaatcatcacagatttgcaaactttatggcctattttggccttaatctccatgtccagcatctggggaacaatgttttcctgttgcagactctctttggtgcagtcatcctcctggccaactgtgttgcaccttgggcactgaaatacatgaaccgtcgagcaagccagatgcttctcatgttcctactggcaatctgccttctggccatcatatttgtgccacaaggtgagaaaagatcacaggtggaagagagaaatgcctttgcctcttttctcagggattgtacttgtcacacctatctgaagccaagaaggaaagggagaattgggttcttaggatttcctgacaccaatctggggatttgggacagattctgccacaagttgctggaaaacgagtcaaagatgagtaaaggttggctctattatatggttgtcctcatcatattcaacaaatactaagaaactgaagccatttatttctgacagtttctctacaacagcaatcaattacttactctttggccaatcaaactttaaatgagtattgaggtataggccttgtcattgtttcccaacatgaggacataatactgctacttcctctgtctgggctctttcttattactacagcttcagtgacaatgtactccctaattcccatgtatctacttgtgtgccttgtatttggtcaccataactgcaatctggtttaggggagtcatcttgacttcaagggaacaaaagtgccccatctttatgtaaagaactgtacagtagaaatgaagaaattgtcagttaatagcctcttgtagattctattttaagaaattaactgatcatatgtaataagtaagggaacccaggtggccaccagtcttcacctaactcttagtgtagtaatgtatctaacaggatctcagattggtgtgctccactccccctcttgaatgccagcaatgatccaagtgtgctacaaagcaacagcaccctccaatgtcatgaggctatgacaggatttcttcagttggatagaaacaagcctctgaaacttcccttcagtgctttccaaagtctgactttttttcctcttttcgaggtccttattcctaatccttaaaacattaatactctctagcttctctcctaacatagacctcctgatcttttatgactctcttctgcaaccctagccccatgtcaatactgtgtatgtacctaggttttaacggccaggagaacatggatgggtcttatactcccaagtattgcccacatgacagtcctatgttctaccaggtaggcagaggagtccctggacggaataaatgaaaaaacattcagctcaacttacacgcctctctcttgctatggcatatctctgatatatagtgagaagtgaagtaatagctcagatcctttttatgcattatttaagccacaaggcgaagacaaatcatgtttctcagctatcagccactgcacattctttgcctctatgcagtttccctacagtacatttaacccttgcaaacacctccaatacagtccttttcacttctaccttggggatgctgattccttcagctcagatttcctgaggccttgtgttcttcctttctccagaaatgcagacgctgcgtgaggttttggcaacactgggcttaggagcgtctgctcttgccaatacccttgcttttgcccatggaaatgaagtaattcccaccataatcaggtacagaaccttaagtatgccctgtcaggttcaaaatggacctttctcagataattgacactttttgcgggaagaaatctaagactggttcattaagaaaataaatcataacagtcataaacacaaataattatagaccaactttatctcaagctgactttttgccactgtattaagtcctttgatgtattatagtatcccacataaccttctgagccacctgagaggttggtgctaaggatagcagtatttcctaaatgatgaaaatgcatctaatgcacttgtgaactgaaaaattaattgctagcaaataaaagtgaaaatttcaaacacaggagtatttcatcacctctgtgtgtctaaatgttcccccataattagagcaaaatgataaatcacaaattgcctgtgtggatttttaacagatattcttgtattgctgtttccactcaaagggcaagagctatggggatcaatgcaacctttgctaatatagcaggagccctggctcccctcatgatgatcctaagtgtgtattctccacccctgccctggatcatctatggagtcttccccttcatctctggctttgctttcctcctccttcctgaaaccaggaacaagcctctgtttgacaccatccaggatgagaaaaatgagtgagtaaatagcccggttgcccctcagaggatctgtgtgctataggtctgtgctgaggaaggcaaaataccatttagggccactgtcctctcaaaaggcttagacttaggattttcccatgtaatcagtgccttaggtctaggtacagccacatgccttcccacagtgacctcagacaccctctgaggctctccagatcacacagaccagctctgcccagcttgtcaaaggaggcttcatagtgaagaagccaaaattaggtctcctcttccctccctgccctagtgtgatatgcacactgttgaaggtattttacaaatatgcagagatccaaacaccagattttcatccctgggaaaccctcaaacaagtgggtacctgtaagctgtctgagattgccagtgcttacaggcctgactactaggccactgaagaatttgtggaagagtatgcagatgcaggggtatccaatcttttggcttccctggtctacagtggaataagaattgtcttgggccacacataaaatacactaacactaataatatctgatgagctaaaaaaaaaaaaaatcacaaaaatatctcataacattttaagaaagtttacaaatttgtgttgggccacattcaaagccatcctgggccacaggcagcctgtgggccataggctggacaagcttgcaccaaggcgtccaaggatgacaagtagaaagtatccaagctgccttcccagatcctagtctgggagcttcatcttttacttcacaaggtttactcaatcccttgggggcagagatatggtttttaccaaactaatggacaaagaatcaacattccttaaagaatgcgggacttacatgtttagtccatgtcttttcatttttgtgattttttgttggtttctttgtatttgttctaggagaaaagaccccagagaaccaaagcaagaggatccgagagtggaagtgacgcagttttaaggaattccaggagctgactgccgatcaatgagccagatgaagggaacaatcaggactattcctagacactagcaaaatctagaaaataaataacaaggctgggtgcggtggctcacgcctgtaatcccagcaccttgggaggctgaggcgggcagatcatgaggtcagaagataaagaccaccctggccaacatggtgaaaccctgtctctactaaaacaaatacaaaacttcgctgggcacagtggcacaggcctttaattccagctacttgggaggctgaggcaggagaattacttgaacccaggaggtggaaattgcaatgagccaagattgggccactgcattccagcctggtgacagagcgagactgtctcaaaaaaaaaaaaaaaaaaaaaagaaagaaggaaagaaagaaagaaaagaaaagaaataacaagatatagtgagtcagtagattcacttcacaattgtggtactaaataactaaatataagctatctacatataatagtaagaaaaagtttgaagaaaattatataacactttaaaatcaatcataatagactatttatgtagttataggtccctagcaagtttctggataggaagattgagtactattaaacacaatgtgtcttcttcaattatttgatagagtaactggtgggataattacaatgaaaaatctgctacttttacaaaaactttaaaataaattcaaatttatctaggaattaatagtagacatttggttcagaaaaaagaagatcagggagtgaaaaatgtagctgtcaggtaagtggggtagcatgcacagaattttatcataagttgtaatattcataacattattagcagatgcatttacaaaacaaagaaattcaaaagtagactttagtatgtataacatttaatgtgtaacaatttcagtattgtacattcttagaggaaacacctaattatggaataaatagcattagccaactaatcagaaataaatgactaacaattcaactttatatcctgtattagtcagggttctctaaagcaagagaaataatagtatatatgtgtatataaaagtgagtttattaggagaattgactcacacggtcacaggatgaagttccacactaggccatttgcaagctgaggagccaggaagccagtccaagtcccaaaaccccaaaagtagggaagctgaccatatagccttcagtctgtggccaaaagcctgagagcccctgacaaatcactggtgtgagtccaagagttcaaaagctaaggaacctgaagtcggatgtttgagggcagaaagtatccagcatgggagaaagatgaaggctgaaagactcagcaagtctgccctttccatcttcttctgcctgctttattctagctgcactggcagctgactagatggtgcccacccagattgagggtgggtctgcctctcccagtccactgactcaaatgttaatctcctttggcaacaccctcacagacacacccaggaactatactttgcatccttcaatccaatcaagttgacactcaatattaaccatcacatttcctaaaccaatataccaattattgattatgattatgacaatcatttcacattgtatacatacatgtatcatcacactgtacatctcaaatatatgcaagttttatttgtcaatcatacttcagtatagctgagaacaagttaaatggaacaaataaaccatgctttcaaaggagccttggctaccaaaattcaaaaaagaaaaacatgttattaataggaaagtaaattccaaataaacatatatatacttgactactcatttaagccttctgtgaagaaaacccaagaaattatgggagaaagctataaaaatatacaacaaaatgattaaaaacattaaattttcatggtagacctcaaagttatttaactttcttctttgtaagtgtattctaagttgaagcaaggaatatgcaacagcttaaaattttataaattatataattttttcacagaattaggaaaaacaatttttaaaatcacatggaaccaaaaaaaaaaagagcctgcatagccaaagtaatactaagcaaaaggaataaattggaggcatcacattatccaacttcaagttataccacaaggctatagtaaccaaaacagcatggtacttgtataaaagtagacacatagaccaaaggaacagaatagagaacccagaaatagagccccatacttacaacaaacctatcttcaacaaagcatacaaaaacataaataggggaaagaacatcctgttcaataaatggtgcagggaaaactggatagccacatatagaagaataaaactgaatccctatctcttgccatctacaaaaatcaactcaagatggatcaaagacttaaatttaagtcctaaaaattctagaagaaaatctagcaaaaacatttctggacattggtctgggcaaagaatttatgtctgagaccccaaaagcaaatgcaacaaaaacaaaaataaataaataggatctaattaaattttaaaaattcttcacaacaaaagaaataatcagaagagtaaacagacaacccacagtgtaggagacaatattcacaaatcatcatcttacaaaggactaatatccagaatctacaaggaactcaaatcagcaagaaaaaaacaatctcctccaaaagtgggtaggacatgaatagataattctcaaaagaagatgtacaaacagccaacaaacatatgaaaaaatgcttaagtgcaagaagggcgattaaaatgtcaaaaaaaatagatgttggcatgtatgtgttgaaacgggaatacttatacactgttgtatcctctctggaacacagtatgaagatttttcaaagaattaagagtagtagagaaaatagcagatgtaccattcaatcccgcaatcccactgctcggtatctacctgtattagtctgttctcacactgctataaagaactgcccgagactgaataatttataaaggaaagaggtttaattgactcacagttctgcatgactggggaggcctcaggaaacttacaatcatggcagaaggggaaccaaatacttccttcttcaaatgatggcaggaaggagaagaatgagtgctgagcaaaggaggataccccttatgaaatcatcagatctcgtgagaacttagtcactatcacagaaaccgcagcacaggagtaactgcccccatgattcagttacctcccaccgggtccctcccatgatacatggtgattatgggaactacaattcaagatgagatttgggtggggacacagccaaaccatatcactacccaaaggaaaagaagccattatataaaaaaaaaaaaacctgcatgcatgtttattgcagcacaattcacaattgcaaaaatatggaaccaacctaagtgccccgccaccaatcagtggataaataaaatgtggtacatatacatcatggaatactactcagccataaaaagaaacaaaataatgtcttttgcagcaacttagattggctggaggccattattctaagtgaagtaactcaggaatggaaaaccaaatattgtacgttctcacttataagtgggagctaagctacaggtatacaaaacatatggagtggtataatggacattagatactcagaaggggaggggaaaaaaccctacatattgggtacaatatacactacttaggtgatggatgcactaaaacctccaactttaccagtatacaattcatccatataaccaaaaactacttgtaccccaaaagctattgaaataaaaaatatacatatatttaaaattcagatgacatccactcagaaaaaaattataaattattgttatattttaaattacaaaatacaagataaactttagaagacatacatatttagatttcttatgtctatgaaaaaagaatacatgattcaatatactattggggaacaccaagaacatataattttcaaaggactaaagtcacatgactaaacatttatgaaaaagtgtgcaagcctattggaaatagaatagcataaaaggtccagaaataaatccaagcatatatggccaactaattttggacagggacaccagaaagacacaattgaaaaagggtaccctcttcaataaacggtgctagaaaaaaattgtatttccacatgtaaaggaataaaatcgaatccttatcttacaccatatacaaaaatcaacttaaaatgaataaaagacctacatgtaagaccataaaactcttggaataaaacataggagaaagaagagaacatagctccttgacattggccttggcaacaattccattccttggataatacactaaaaggtcacgctacaaaggcaaatataaatagataggactacattaagccaaaatgtttctgcacagcaaaggaaacaacaaaatcaaaaggcaacctatggattggaaatatttgcaaactatatatctgataagaggttaatatccaaaatttatgtaaaaacttacacaactcattagtaagaaaatatataattcaataataaatggacaaaatgcctgaatagatatttctccaaagttgacataaaaatggccaacaagtataggacaaggtgctcaacatcactattcatgaggacagaataatgcaaatcaaaactactatgagatgtcaccttatattccttaaaatagctattatttaaaaggtgagttaacaagtatcgtcaagagcatgtactttggcattgttggtggaatgtaaattgctgcagccattagggaaaacattataaaggtaccatgtaagaaaacttcacaagtatcacctgaacctaaaataaaagttaaaaagaaaagattccaccccaaaattaaagacagaactaccatgtgatccagcaacccctcttctgggtatatacccaaaagaaatgaaagtaccaccttgtaaaaaacatctgcactcccattttcattgaagcattatgcacaattaccaagatacagaaacaatctaggtgtccatcaacagatgaatgaaaaaggaaactgtaatatttacacacacacacacacacgagtaatattattcagcctttaaaaaggagatattcaattgtacctaaatctcagcatcacacaatatatccaggtaacaaatctgcacatgtgccccctaaatgtaaaagttggaattataaaaaaaaaaaaataagaggagattctgccatttgccactacacggatgtacctggaaaacattaggctaaataaaataagccagacacaaaaaggaaaacattgcatgacctcacttatatgtgggaaaaaggtcaaataaatggagatagagaataaaatagcagttaccagagacaagatgggaaggaggaaatggggagatgtaggtcaaagtacaagatatgtaggataaacaaggctaaagagctcacgtacaacatgaagactatagttgataatagagtatagaattcagaatttttgctaaatgactagattatagatgttcttgccacagagtgaaaactaagttaactatatgaggtgatagatacgttaatttgcttcaccatggtgactattttatacacacacacacacacacacacacacacacacacatataactctcatagcattatgttgtataccttaaatatacataattaaatttatttttaaaaagaagagaaaactcataacatgaaaaaaattattaggtcatcatgtaatagcaactaagcagtatgctagaagctctgaatgcacagaagaaatgaaaaaaagacatcacacggatttaatagatatgagtatttgtctgcaaatatagatgtaacattgcattttagttgttaccagtaacaaaatttcaatttaaattccaccttgcctctgggttggcaaaaaaaaaaaaatgcaaataagttattttcaggaattatttccacaaatctttcacatcaaagctatctagactccacaggcacatgcagagtgtgtcaagaaataaagtagtaataatggaagattgcactcattatcagttatccgcttagaggttatcatgtagctactgagcctgcacacactcagtgctgaaaccctaccattcccatcacaatgaggcattgaaatggggattctggtgtggccacttacctccatttgcaaccactctgttaggagttctctgattccatggagtatcctaaaggtgaataccgggttctggttcccccaggacccagagacactcctccaccctcacccttcccaaatactccacttattttgataaactctttagcttttgcacagaccctctagttacactgccaatttagcttttgaaaaaaatagtcttcaagacttcttttgcttatcagcttcaaaacaccttccgagggatcaaaaagtaaagacatgacaacccgcaggaatgtgggaaagaggatattccaggaaatcatccataatggatatcatgagtttatccagtctcattcttgtgcctaatgaaatgtttgatagcccattatgatgaagactacatggcatccgtttctgtgcatcaccccagaagatagtggtcagttcataaacatgatgtttcatggaagagaatttcccacaggtcttcatgagtctttaaagctagagaccagtgcttgtggcccaacagataatatttttactggagaagtctagtgagcacaactgtaaaaaaaatctactatggtggggtgagtgaacgggtttcctttccatttgacttggagtaacagaagcattcttcaaagacctagttaatattttgcagtgattatcattttgaaataggattatcagtgaacatctgtaactcactctttgttgtccagtgtttcttgaacggaattttgtaaaaagaaaaaaaatcagagaacgaatgaatacatttgaaatcgttgaggaaatgctggaaattagggctaattatctctcctaattgtggtaaaggagcttcttcctggacatggatattcatagcctgttatccaaaccctcctgagccatgtagctatagatattttttgaaactcatgtgctataaatcatgattctaatagttagctggatataataccatggaatccagtcttaattttgtaaagaacagtacataaaacaagtgcagctaaagaaacacaaataccacaagatctaacttatttgtggaatctaaaaacttcaaactcagaagtgtgctgccagtaaggtggcagaataagaagtcatccactcgtatcccccaaaaacaacaagaattctgtacctgtcaacagagaaaaagcctctttacatgagctggagactgaggttgaagtctgtgaaaccccagtggagcccaagactttgaaaagtcattttaagagtgcaggcccacacccagatggcaggcctaccaatcatgctcctgcattgaaagtttgaaagagcctcatttcccaaagggcttagctacagccttgtatggccttgaccctggaaccaaaactatctgccaaagcctccaggaggaatcacaacagtatcttggcaaaaaggtttgactgcccaccaacattggtctcagcagtggactggaaagttaccctataaaagctacagttcccctcaactgtggtcacagattgacactgcttgcacaaggcctcagaaagagctctcatgtgtgacaccaggacaggcttgaaagcctctgttccacagcacagtctaaatgggctctatctttcagcccggcattatcttgcccaagcagagaatggctgggagtcacccatctgagcctccataacaggcttactaggttccatctcattgcagagcctgaaggagccaatctcagctcaaatccattggtgccacagccagggaattatctgacctgtacaaggaacagctgggagacatgcccatctgaacaactgggacaggcttgccagcatctgttccatagcaggtcctcaaggggcctggtcttagacccagcccctcttgctgcaatgagggaataatcccaaaggcacagggatctgctgggaaactcaccccatctgagcctctttgacagacttatcagactgtgtctcacagaaattcttgaaggggcacagtctcagcttcagcctcttactgccatagccagaaaactatcccacctatgcagggaactgctgggaaatgcacctatctgaagtaacaggacagggtttctaacttccatcccatagcagatcctaaaagggtcaaatgtcagctccagcacctgtcactgcagtcaggtaactatcctacctgtgctgggaactgcttagatatgtgcccatctgagccaccagaagaggcttgcgatgcatcctctttctcacagaagattctaaaaaggcccagtctcagctccagcccttttctgcaacagcctggaaactatcctacctgtgcagtgaacttctgggagatgctgtcatccaagacaccagcacaggcttgccatcctctgtcccacagtaggacatgaagaggccttagtgctacactagatcaagcacttatgaatctagtgaccatgacaaacagcatgctcagagttgctggatagacgtcttgtacaagaactgtcacagagaaatccagactatgaacactaaaataaatacctatttcttcaatgaatagacattgatgcacaaccacaaggatcaaaaacaatcaaagataaatgatgtcagaagatggcagaataggaacagctccgatctacagctcccagcatgagggacgcagaagacgggtgatttctgcatttccatctcaggtactgggttcatctcactagggagtgccagagagtgggtgcaggacaatgggtgcaacacaccatgtgggagccaaagcagggcgaggcattgcctcactcgggaagcacaaggggtcagggagttccctttcctagtcaaagaaaagggtgacagacggcacctggagaatcaggtcactcccaccctaatactgcacatttccagtgggcttaaggaacagcacaccaggagattgtatcccgcatctggctcggagggacctgagcccatggagtatcgctgattgctagcacagtagtctgagatcaaactgcaaggcagcagtgaggctgggggaagggcacctgccattgcccaggcttgcttaggtaaacaaagcagccaggaagctcgaactgggtggagcccaccacagctcaaggaggcctgcctgcctctgtaggctccacttctgggggcagggcacagacaaacaaaaagacagcagtaacctctgcagacttaaacatccctgtctgacagctttgaagagagtagtggttctcccatcacgcacctggagatctgagaatgggcagactgcctcctcaagtgggtccctgacccccgagcagcctaactgggaggcaccccccagtaggggcagactgacacctcgcacggccggatactcttctgagacaaaacttccagaggaccgatcaggcagcagcatttgcggttcatgaaaatccagttctgcagccaccactgctgatacccaggcaaacagggtctggagtggacctctagcaaactccaacagacctgcagctgagggtcctgtctgttagaaggaaaactaacaaacagaaaggacatccacaccaaaaacccatctgtatgtcaccatcatcaaagaccaaaagtagataaaaccacaaagatggggaaaaaacagaacagaaaaactggaaactctaaaaagcagagcacctctcctcctccaaaggttcgcagttcctcaccagcaacagaacaaagcaggatggagaatgactttgacgagttgagagaagaaggcttcagacaatcaaactactccgagctacaggaggaaattcaaaccaacggcaaagaagttaaaaactttgaaaaaaaattagacgaatgtataactagaataaccaatgtagagaagtgcttaaaggggctgatggagctgaaagccaaggcaagagaactacataaagaatgcagaagcctcaggagctgatgcaatcaactggaagaaatggtatcagtgatggaagatgaaatgaatgaaatgaagtgagaagggaagtttagagaaaaaagaataaaaagaaatgagcaaaacctccaagaaatatgggactatgtgaaaagaccaaatctacgtctgattggtgtacctgaaagtgatggggagaatggaaccaagttggaaaacactctgcaggatattatccaggagaacttccccaatctagcaaggcaggccaacgttcagattcaggaaatacagagaacgccacaaagatactcctcgagaagagcaactccaagacacataattgtcagattcaccaaagttgaaatgaaggaaaaaatgttaagggcagccagagagaaaggtcgggttaccatcaaagggaagcccatcagactaacagcggatctctcggcagaaaccctacaagccagaagagagtgggggcaaatattcaacattcttaaagaaaagaattttcaacccaaaattgcatatccagccaaaataagcttcataagtgaaggagaaataaaatactttacagacaagcaaatgctgagagattttgtcaccaccaggcctgccctaaaagagctcctgatggaagcactaaacatggaaaggaacaaccggtatcagccactgcaaaaacatgccaaattgtaaagaccatcaaggctaggaagaaactgcatcaactaacgagcaaaataaccagctaacatcataatgacaggatcaaattcacacataacaatattaactttaaatgtaaatgggctaaatgctccaattaaaagacacagagtggcaaattggatagagtcaagacccatcagtgtgctgtattcaggaaacccatctcacatgcagagacacacataggctcaaaataaagggatggaggaagatctaccaagcaaatggaaaacaaaaaaaggcaggggttgcaatcctagtctctgataaaacagactttaaaccaacaaagaacaaaagagacaaagaaggccattacataatggtaaagggatcaattcaacaagaagagctaactatcctaaatatatatgcacccaacacaggaggacccagattcataaagcaagtcctgagtgacctacaaagagacttagactcccacacaataataatgggagactttaacaccccactgtcaaccttaggcagatcaatgagacagaaagttaacaaggatacccaggaattgaactcagctctgcaccaagcggacctaatagacatctacaaaactctccaccccaaatcaacagaatatacatttttttcagcaccacaccacacctattccaaaattgaccacatagttggaagtaaagcactattcagcaaatgtaaaagaacagaaattataacaaactgtctctcagaccacagtacaatcaaactagaactcaggattaagaaactcactcaaaaccactcaactacatggaaacggaacaacctgctcctgaatgactactgggtacctaacgaaatgaaggcagaaataaagatgttctttgaaaccaacgagaacaaagacacaacataccagaatctgtgggacacattcaaagcagtgtgctgagggaaatttatagcactaaatgcccacaagagaaagcaggaaagatccaaaattgacaccctaacatcacaattaaaagaactagaaaagcaagagcaaacacattcaaaagctagcagaaggcaagaaataactaaaatcagagcagaactgaaggaaatagagacagaaaaaaacccttcaaaaaattaatgaatccaggagctggttttttgaaaagatcaacaaaattgatagactgctagtaagactaataaagaagaaaagagagaagaatcaaatagatgcaataaaaaatgataaaggagatatcaccgctgatcccacagaaatacaaactaccatcagagaatactacaaacacctctacacaaataagctagaaaatctagaagaaatggataaattccttgacacatacaccctcccaagactaaaccaggaagaagttgaatctctgaatagaccaataacaggctctgaaattgtgcttaccaaccaaaaagagttggtaagccagccagccatttgacccagccatcccattactgggaccacatggattcacagccgaattctaccagaggtacaaggaggaactggtaccattccttctgaaactattccaatcaatagaaaaagagggaatcctccctaactcattttacgacgccagcatcatcctgataccaaagccgggcagagacacaaccaaaaaagagaattttagaccaatatccttaatgaacattgatgcaaaaatcgtcaataaaatactggcaaaccgaatccagcagcacatcaaaaagcttatccaccatgatcaattgggcttcatccctgggatgcaaggctggttcaacatacgcaaatcaataaatgtaatccagcatataaacagaaccaaagacaaaaaccacatcattatctcaatagatgcagaaaaggcctttgacaaaattcaacaatgcttcatgctaaaaactctcaaaaaattaggtattgatgggacgtatctcaaaataagagctatctatgagaaacccacagccaatatcatactgaatgggcaaaaactggaagcattccctttgaaaactggcacaagacagggatgccttctctcaccactcctattcaacatagtgttggaagttctggcagggcaatcaggcaggagaaggaaataaagggtattcaattcagaaaagaggaagtcaaattgtccctgtttgcagatgacatgattgtatatctagaaaaccccatcgtctcagcccaaaatctccttaagctgataaacaacttcagcaaagtctcaggatataaaatcaatgtacaaaaatcacaagcattcttatacaccaataacagacaaacagaaagccaaatcatgagtgaactcccattcacaattgcttcaaagagaataaaatacctaggaatccaacttacaagggatgtgaaggacctcttcaaggagaactacaaaccaatgctcaatgaaatcaaagaggatacaaacaaatggaagaacattccatgcacatgggtaggaagaatcaatatcgtgaaaatgaccgtactgcccaaggtaatttacagattcaatgccatccccatcaagctaccaatggctttcttcacagaattggaaaaaactaccttaaagttcatatggaaccaaaaaagagcccgcatcaccaagtcaatcctaagccaaaagaacaaagctggaggcatcacactacctgacttcaaactctactacaaggctacagtcaccaaaacagcatgatactggtgctacagtcaccaaaacagcatgatactggtaccagaacagagatatagaccaatggaacagaacagagccctcagaattaattacacatatctacaactatctgttctttgacaaacctgacaaaaacaagcaatggggaaaggattccctatttaataaatggtgctgggaaaactggctagccatatgtagaaagctgaaactggatcccttccttacaccttatacaaaaattaattcaagatggattaaagacttaaacgttagacctaaaaccataaaaaccctagaagaaaacctaggcaataccattcaggacataggcatgggcaaggacttcatgtctaaaacaccaaaagcaatggcaacaaaagacaaaattgacaaatgggatttaattaaactaaagagcttctgcacagcaaaagaaactaccatcagagtgaacaggcaacctacaaaatgggagaacattttcataatctactcatctgacaaagggctaatatccagaatctacaatgaactcaaacacatttacaagaaaaaaacaaacaaccattaaaaagtgggtgaggtatatgaacagacccttctcaaaagaagacatttatgcagccaaaaaacacatgaaaaagtgctcatcatcactggccatcagagaaatgcaaatcaaaaccacaatgagataccatctcacaccagttagaatggagatcattaaaaagtcaggaaacaacaggtgctggagaggatgtggagaaataggaacacttttacactgttggtgggactgtaaactatttcaaccattgtggaagtcagtgtggcgattcctcagggatctagaactagaaataacatttgacccagccatcccattactgggtatatacccaaaggattataaatcatgctgctataaagacacatgcacacgtatgtttattgcggcactattcacaatagcaaagacttggaaccaacccaaatgtccaacaatgatagactggattaagaaaatgtggcacatatacaccatggaatactatgcagccattaaaaaatgatgagttcatgtcctttgtagggacatggatgaagatggaaaccatcattctcagcaaactatcgcaaagacaaaaaaccaaacaccacatgttctcactcataggtgggaattgaacaatgagaacacatggacacaggaaggggaacatcacactccagggactgttgtggggtggggggagaggggagggatagcattaggagatatacctaatgctaaatgacgagttaatgggtgcagtacaccaacatggcacatgtatacataggtaacaaacctgcacattgtgcacatgtaccctaaaacttaaagtataataataacaaaataaaaaaatatttaaaaaaaagaaaaacgatgtcaccaaacaaacaaaacaacataccagtaattggcactaaacggatgcagacataaaatccacctgacaagaaaatcaagagaactgttctaaagccactaatcaaccaaccaaaaaaatcgtagagaagacccaaacaaacaaaatcagaattgaaaaaggagacaacaactgagaccacagacatacaaagaatcattagtgactattatgaacaactatatgacaatttggaaacctaaaagtaatggataaattaccagacatataaacctaccaagattgaaccaagaaaaaaacataaaacctcaacaaattaataatgagtaacaagagtaaggtcataataaaattctcacttcaaagaaaatcccaggaccagatagactcactgatgaattctaccaaacatcaaaagaacaacaaatatgaattgagtctactaaaatccttcaaaaaaattaaacagcaaggaatgcttccaaactcattctaacatggcagcattaccctgacaccaaaaccaggcaaggacacatgaaaaaagaaaactaaaagccagtattattaacatatatgcaaaatcctcaacaaaatactagcaaaccaaattcatcaacaccttaaaagatcattcaccatgatcaagggggattcctcccaggaatacaaggatagttcaacacgtgcaaatcaataaacatgatacatcacattaacagaaccaagaattaaatagatttaaataaatgatgaaaaaatatttgacaaaactcaacatcctcttatgaaaaatatcctcaacaaactaagtatagaaggaacatacctcaaaataataaaggccatatgtcacaaacccacagctaacattatactgaacagggaaaaatggaaagcctttcttctaaggtcttaaacaaaacaaggatgcccgcttttaccacttttattcaacataatatcaaaagtcccagccagagcaattaggcaagagaaacaaataaagggaatccaaattggaaaggaagaagtcaaattctcttgtttgcataagataacttttttcgtgggagtttaatcttttcactgacaagtaagctttattatatgtcaaatcaacattttagagttttttcattgacacattatatttacatgtttattgggtatatgtgagcgtttgttacatgcatggaatgagtgataatcaagccagggtaatttggggtatccatcaccatgcatgtatgcatgtttatcatttttaggtgttttatcatttctagtcttctagttactttgcaatatacataatagtattgctacatatggtcaccctagtctgctatcaaacattaggatgatttcttcaatctaactgcatgtttgtatccataaacaacctctcttcacctccctttcccagtttctgatatctatcctattcttgatgtccatgagatcaagtttttacatcccacatatgagtgagaacatgtggtatttatctttttgtgcttcccttacgtcacttatcataataaaacccatttccatccatgttgctggaaaaggattccactctttttaatggctgaatagtgtatgtgtatatatgtgtatgggtatttgtgcaggtatgggtacctatgggtgtgggtgtaggtgtgtatccagaaaacaaatagtacatataaacacatacatgtacatgcatgcatgtgcacacacacactcacacacacacaccatttttcttgtccaatcagccattgatgaacacttaggttgattccatatctgttctattgggaatagcattgtgataaacctgtgagtcaaatgtatccctttgagaaaataatttcttttcttttggatagataccctgtagtgagattgctgcatcatgtagtagttctagatttagtttttctgagaaatatctatactgctttccataatggttgcactaatttacattcccaccatgtctaagagtacccttttctctgcaacctcaccagcatctgggtgtgtgtgtgtctgtgtgagtgtgtgcatctgtcaataataaacattctgtggtgagataatatctcattgtggtttttatttacaatccctgataattagtgttgagcatttttcatatactattggtcttttgtaagtcttcttttgaaaaatattgttcatttttagtgggattgtttggttttctatagttgaattgttattcttgtatagaatacatattagtcccctttggatgagcactttgcaaatattttctcccattcaagtgatttgcacttcccttgtaataggtgatgttgagcagattttcatatacctattagccatttgtacatctttttttaggtaagattttatttattatgatgggtgtgcttgcctgttcctaagttcattccagtctggaacataggaagataatgctacctgcatagctgctacaccattcagccatttctttcctttgtttttaactgggttaagatagaaaaccctagttcacacaaactagttgttgtgaatggtagtaatagcaggacactctttctatttaacaatggaaagtcttcctttaccttattccaaaatgctgataagcttaaggtctcataatcattctttaatgtatatgaagaactaaactgcaataattcattctcttcttcaggcaccaagtttagctcaattattgattcagggttttgaaaagcaaatggatattttacccaactgttttcccttaatgtttcaaatttttcttctggaaagaaacggttaaaagtttgagataggtcacttccaagatggcctaataggaacagctccagtctacagctcccagtgagatcgatgcagaagatgggtgatttctgcatttccaactgaggtacctggttcatctcattgggactggttggacagtgggtgcagcccatggagggtgagccaaagcagggcagggcatcacctcacccaggaagtgcaaggggttgggggatttccctttcctagccaaggaaagctgggagtgactgtacctggaggaatggtacactcctgcccaaatactgcacttttcccagggtcatcacaaccagcagaccaggagattccctcccaagcctgactagacaggtcccacacccatggagccttgctcgctgctaatgcagcagtctgagatcaacctgggatgttggagcttggcagggggaggggcatccactactactgaggcttgagtaggcagttctatgcccacagtctaaacaaagcaacagggaacttcaaactgggcggagcccaccacagctcagcaaggcctactgcctctctagattccacctctaggggcagggcatatctgaacaaaaggcaggagacagcttctgcagacttaaacctccctgcctaacagctctgaaaagagcagtggttctcacagcacagagttcaagctctgataatggacagactgcctcctcaagtgggtccatgaccccatgattcctgatggggagacacctcacagtaggggccgacagacacctcatacaggcaggtgtccctctgggacaaagcttccagagaaaggatcaggcagcaatatttgctgttctgcaacctccactggaaatacccaggcaaacctggtaatactccagggtctggagtggacctccagcaaactccaacagacctgcagatgaggggcctgactgttagaaggaaaactaacaaacagaaaggaatagcatcaacatcaacaaaaaggacatccacaacaaaaccccatccataggtcaccaacatcaaagaccaaacgtagacaaaaaccacaaaaatggggagaaaccagagcagaaaggctgaaaattccaaaaccaaaatacctcttctcctccaaaggaacacaactcctcaacagcaagggaataaaactggatggagaatgagtttgacaaattgacaaaagtagtcatcagaaggtcggtaataacaaacttctctgagctaaaggagcatgttctaacccattgcaaggaaactaaactttgaaaaaaggttagacgaatggctaactagaataccagtaaggagaagagcttaaatggcctgatggagctgagaaccacagtatgagaccttcatgaagcatacacaagcttcaatagccgattagatcaagtggaagtaaggatatcagtgattgaagatcaaattaatgaaataaagtgagaagacaagactagagaaacaagggtgaaaagaaacaaataaagcctccaataaacatgagactatatgaagaccaaatctatgtttgattggtgtacctgaaagtgatgggagaatggaaccaagttagaaaacactcttcaggacattatccaggagaacttccccaacgtagcaaggcaggccaacattcaacttcaggaaatagagagaacaccacaaagatactcctggagaagagcaaccccaagaaacataatcatcatattcaccaaggttgaaatgaaggaaaaaatgttaagggcagccagagagaaaagtcaggttacccacaaagggaagcccatcagactaacagcagatctctcagcagaaaccctacaagccagaagagagtgggggctaatattcaacattattaaagaaaaaatttttaacccagaatttcatatccagccaactaagcttcataagtgaaggagaaataaaatcctttacaaacaagcaagtgctgagggattttgtcaccatcaggtgtgccttaaagagctcctgaaggaagcactaaatatggaaaggaaaaagtggtaccagccactgcaaaaacaaaccaaaatgtaaagaccatcgacactatgaagaaaccgcatcaactaatggggaaaataacctgctagcaccataatgacaggatcaaattcacacataacaatattagcattaaaggtaagtgggctaaatgccccaattaataggcacagatgggcaaactggatgaagagtcaagactcatcagtgtgctgtattcaggagacccatctcaagtgcaaagacacacttatgctcaaaataaagggatggagaaatatttaccaagcaaatggaaagaaaaaaaaacagagtttacaatcctagtctctgataaaacagactttataatacaggagcacgcagattcataaagcaagttcttagagacctacaaagagacttagactcccacacaataatagtgggagactttaataccccactgtcaatattagacagaccaatgagacagaaaattaacaaggatattcagcacttgaactcagctctgaaccaggtgggcctaataaacatctacagaactctccacctcaaataaacagaatatacattcttctcagcaccacatagcacttattctaaaatcgaccacatagtggttccaagatggccgaataggaacagctccagtctacagctcccagcatgagtgacgcagaagacaggtgatttctgtatttccaactgaggtaccaggttcatctcactggggtgtgtcagacagtgggtgcaggacagtgggtgcagcccaccaagcaagagccaaggcagggtgaggcatcacctcccctgggaagtgcaaggggtaagggaactcactttcctagccaagggaagccatgacagacagcacctggaaaattgggtcactaccaccctaatagtgcacttttccaatggtcttagcaaacagcacaccaggaaaatatatctcgtgcctggctcagagggtcccatgcccacagagcctcactcattactagcacagcagtctgagatctaactacaaggtggcagtgaggctggggggaggggtgactgccattgctgaggcttgagtaggtaaacaaagcggccaagaatctcaaactgggtggagcccaccacagctcaagaagacctgactgcctctgtagactccacctctgggggcagggcatagctgaacaaaaggaagcagaaacctctgcatatttaaatgtccctgtctgacagctttgaagacagtactgattttcccagcatggagtttgagatctgagaatggacagactgcctcctcaagtgggtccctgacccccaagtagcctaattgggaggcactccctggcaaacagggtctggagtggacctccagcaaactccaacagacctgcagctgagggttctgactgttagaaggaaaacaaacagaaaggacatccacaccaaaaccccatctgtatgtcaccatcatcaaagaccaaaagtagataaagccacaaagatggggaaaagacagagcagaaaaactggaaactctaaaaatcagagcacctctccccctccaaaggaaggcagctccttgccagcaacagaacaaagctggatggagagtgactttgacaagttgagagaagaaagcttcagatgatcaaccttctccgagctaaagggggaagtttgatcccattgcaaacaagataaaaaccttgaaaaaagattaggtgaatggctgactgaataaccagcatagagaagtccctaaacgacctgacggagctgaaaaccatggctcaagaactatgtgatgaatgtgcaagcttcagtaactgattcgatcaactggaagaaagggtatcagtgattgaagatcaaacgaatgaaatgaagtgagaaaaggagtttagagaaaaaagagtaaaaagaaatgaacaaagcctccaagaaatatgggactatgtgaaaagaccaaatctacatctgattggtgtacctgaaagtgacaaggagaatggaaccaagttggaaaacactctgcaggatattatccaggggaacttgcccaacctagcaaggcaggccaacattcaaattcaggaaatacagagaacaccacaaagatactccttgagaacagcaactccaagacacataattttcagattcaacaaagttaaaatgaaggaaaaaatgttaagggcagccagagagaaaggttgggttaccatcaaagggaagcccatcagagtaacagtggatctctcaacagaaactctacaagccagaagagagtgggggcaaatattcaacattcttaaagaaaagaattttcaacccagaattgcatatccagccaaactaagcttcataagtgaaggagaaataaaatactttacagacaagcaaatgctgagagattttgtcactaccaggcctgccctaaaagagctcctgatggaagcactaaacatggaaaggaacaatcggtaccagccactgcaaaaacatgccaaaatgtaaagaccatcaatgccaggaagaagctgcatcaactaacaagcaaaataaccagctaacatcataatgacaggatcaaattcacacacaacaatattaactttaaatgtaagtgggctaaatgctccaattaaaagacacagagtggcaaattggataaaaattcaagacccatcagtgtgctgtactcaggagacccatctcacatgcagagacacacacaggctcaaaataaaggaatggaggaagatctaccaagcaaatggaaaacaaaaaaaggcaggggttgcaatcctagtctctgataaaacagactttaaaccaacaaagatcaaagagacaaagaaggccattacataatggtaaagggatcaattcaacaagaagagctaactatcctaaatatatatgcacccaatacaggagcacccagattcataaagcaagtccttagagacttacaaagagacttagagtcccacacaatactaatgggagacttcaacaccccactatcaacattagacagatcaatgagacagatagttaacaaggatattcaggaattgaactcagctctgcaccaagcagacctaatagacatctacagaaccctccaccccaaatcaacagaaaatacattcttctcagcaccacatcacacttattccaaaactgaccgcatagttggaactaaaacactcctcagcaaatgtaaaagagcagaaattataacaaactctttctcagaccacagtgcaatcaaactagaactcaggattaataaattcacgcaaaaccactcaactacatggaaactgaacaacctgctcctgaatgactactgggtacataacgaaatgaaggcagaaataaagatgttctttgaaaccaacgagaacaaagacacaacataccagaatctctgggacacatttaaagcagtgtgtagagggaaatttataacattaaatgtgcacaagaaaaagaaggaaagatctaaaattgacaccctaacatcacaattaaaagaactagagaagcaagagcaaacacattcaaaagctagcagaaggcaagaaataactaagatcagagcagaactgaaggagatagagacacaaaaaacccttcaaagaatcaatgaatccaggagctggttttttgaaaagatcaacaaaattgatagactacgagcaaaactaataaagaagaaaagagagaagactcaaatagatgcagtaaaaaattataaaggagatatcaccaccgatcccacagaaatacaaactatcatcagagaatactataaacacctctacacagataaactagaaaatctagaagaaatggataaattccttgacacatacaccctcccaagactaaaccaggaagaatttgaatccctgaatagatcaataacagcctctgaaattgaggcaataattaatagcctaccaaccaaaaaaagtccaggaccagatggattcacagctgaattctaccagaggtacaaggaggagcttgtaccactccttctgaaactattccaatcaaaagaaaaagagggagtcctccctaattcattttatgaggccaacatcatcctgataccaaagcctggcagagacacacacacaaaaaaatttcaggccaatattcttgatgaacatccatgtgaaaatcctcaataaaatactggcaaacagaatccagcagcacattaaaaaacttatccaccatgatcaagttggcttcatacctggggtgcaaggctgcttcaacatacacaaatcaataaatgtaatccatcatataaacaaaaccaatgacaaaaaccacatgattatctcaatagatgcagaaaaggccttcaataaaattcaacaccccttcatgctaaaaacactcaataaacttggtattgattaaacacatctcaaaataataagagctatttatgataaactcacagccaatatcatactcaatgggcaaaacctggaagcattccctctgaaaactgacacaagacaaggatgccctctgtcaccactcctattattcaaaatagtattggaagctgtggccaaggcaatcaggcaagagaaataaataaatggtattcaaataggaaaagaggaaatcagattgtctctgtttgcatatgacatgattgtatatttagaaaaccccattgtctcagcccgaaaaactccttaagctgaaaaacaacttcagcaaagtctcaggatacaaaatcaacgtgcaaaactcaaaagcattcctgtacacaaataatagacaagcagagagccaaatcatgagtgaactcccattcacaattgctacaaagaaaataaaatacctaggaatacaacttagaagggatatgaaggacctcttcaaggagaactacaaaccactgctcaaggaaataagagaggacacaaacaaatgaaaaaactttccatgctcatggatggaaagaatcaatattgtgaaaatggtcatactgcccaaataatttataaattcagtgctatcctcatcaaactaccattgacttttttcacagaattagaaaaaactactttaaagttcatgtggtaccaaaaaagagcccatataaccaagacaatcctaaacaaaaagaacgaagctgaaggcatcacgctacctgacttcaaactataatacaaggctacagtcaccagaacaacatggtactggtaatgaaacagatatatagaccaatggaacagaacagaggcctcagaaataccaccacacatctacaaccatctgatctttgacaaacctgacagaaacaagcaatggggaaaggattccctattcaataaatggtgctgggaaaactggctagccatatgcagaaaacagaaactggacccatttacaccttatacaaaaatgagctcaagatggattaaaggagggaggagccaagatggccgaataggaacagctcctgtctacagctcccagcgtgagcgatgcagaagacaggtgatttctgcatttccatctgaggtaccgggttcatctcacttgggagtgccagacagtgggcgcaggtcagtgggtgtgtgcaccgtgcgcgagccaaagcagggcgaggcattgcctcacttgggaagcgcaaggggtcagggagttcactttccgagtcaaagaaaggggtgacagacacacctggaaaatccggtcactcccacccaaatactgcgcttttccgactggcttaaaaaacggcgcaccacgagattatatcctgcacctggctcggagggtcctatgcccacggagtctcgctgattgctagcacagcagtctgagatcaaactgcaaggcggcagcaaggctgggggaggggcgcccgccattgcccaggcttgcttaggtaaacaaagcagctgggaatctccaactgggtggagcccaccacagctcaaggaggcctgcctgcctctgtaggctccacctctgggggcagggcacagacaaacaaaaagacagcagtaacctctgcagacttaaatgtccctgtctgacagctttgaagagagcagtggttctcccagcacgcagctggagatctgagaaccggcagactgcctcctcaagtggctccctgaccccgagcagcctaactgggaggcaccccccagcaggggcagactgacacctcacacggcaatgtactccaacagacctgcagctgagggtcctgtctgttagaaggaaaactaacaaacagaaaggacatccacaccaaaaacccatctgtacatcaccatcatcaaagaccaaaagtagataaaaccacaaagatggggaaaaaacagaacagaaaaactggaaactctaaaaagcagagtgcctctcctcctccaaaggaacacagttcctcaccagcaacggaacaaagctggatggagaatgactttgacgagctgagagaagaaggcttcagacgatcaaattactctgagctacgggaggacattcaaaccaaaggcaaagaagttgaaaactttgaaaaaaatttagaagaatgtataactagaataaccaatacagagaagtgcttaaaggagctgatggagctgaaagccaaggctcgagaactacgtgaagaacgcagaagcctcaggagccaatgcaatcaactggaagaaagggtatcagtgatggaagatgaaatgaatgaaatgaagtgagaagggaagtttagagaaaaaagaataaaaagaaatgagcaaaacctccaagaaatatgggactatgtgaaaagaccaaatctacgtctgattggtgtacctgaaagtgatggggagaatggaaccaagttggaaaacactctgcaggatattatccaggagaacttccccaatctagcaaggcaggccaacgttcagattcaggaaatacagagaacgccacaaagatactcctcgagaagagcaactccaagacacataattgtcagattcaccaaagttgaaatgaaggaaaaaatgttaagggcagccagagagaaaggtcgggttaccatcaaagggaagcccatcagactaacagcggatctctcggcagaaaccctacaagccagaagagactgggggcaaatattcaacattcttatagaaaagaattttcaacccagaatttcatatccagccaaactaagcttcataagcgaaggagaaataaaatactttacagacaagcaaatgctgagagattttgtcaccaccaggcctgccctaaaagagctcctgaaggaagtgctaaacatggaaaggaacaaccggtaccagccactgcaaattcatgccaaaatgtaaagaccatcgagactaggaagaaactgcatcaactaacgagcaaaataaccagctaacatcataatgacaggatcaaattcacacataacaatattaactttaaatgtaaatggactaaatgctccaattaaaagacacagactggcaaattgcataaagagtcaagacccatcagtgtgctgtattcaggaaacacatctcacatgcagagacacacataggctcaaaataaaaggatggaggaagatctaccaagcaaatggaaaacaaaaaaaggcaggggttgcaatcctagtctctgataaaacagactttaaaccaacaaagatcaaaagagacaaagaaggccattacataatggtaaagggatcaattcaacaagaagagctaactatcctaaatatatatgcacccaacacaggaggacccagattcataaagcaagtcctgagtgacctacaaagagacttagactcccacacaataataatgggagactttaacaccccactgtcaacattagacagatcaatgagacagaaagtcaacaaggatacccaggaattgaactcagctctgcaccaagcagacctatagacatctacagaaccctccaccccaaatcaacagaatatacatttttttcagcaccacaccacacctattccaaaattgaccacatacttggaagtaaaggactattcagcaaatgtaaaagaacagaaattataacaaactatctctcagaccacattgcaatcaaactagaactcaggattaagaatctcactcaaaaccactcaactacatggaaactgaacaacctgctcctgaatgactactgggtacctaacgaaatgaaggcagaaataaagatgttctttgaaaccaacgagaataaagacacaacataccagagtctctgggatgcattcaaagcagtgtgctgagggaaatttatagcactaaatgcccacaagagaaagcaggaaagatccaaaattgacaccctaacatcacaattaaaagaactagaaaagcaagagcaaacacattcaaaagctagcagaaggcaaggaataactaaaatcagagcagaactgaaggaaatagagacagaaaaaacccttcaaaaaattaatgaatccaggagctggatttttgaaaggataaacaaaattgatagaccgctagcaagactaataaagaaaaaaagagagaagaatcaaatagacgcaataaaaaatgataaaggggatatcaccaccgatcccacagaaatacaaactaccatcagagaatattacaaacacctctacgcaaataaactagaaaatctagaagaaatggataaattccttgacacatacactctcccaagactaaaccaggaagaagttgaatctctgaatagaccaataacaggatctgaaattgtggcaataatcaatagcttaccaaccaaaaagagtccaggaccagatggattcacagccgaattctaccagaggtataaggaggagctggtaccattccttgtgaaactattccaatcaatagaaaaagagggaatccttcctaactcattttatgaggccagcatcattctgataccaaagccgggcagagacacaaccaaaaaagagaattttagaccaatatccttgatgaacattgatgcaaaaatcctcaataaaatactggcaaaacgaatccagcagcacatcaaaaagcttatccaccatgatcaagtgggcttcatccctgggatgcaaggctggttcaacatacgcaaatcaataaatgtaatccagcatataaacagaaccaaagacaaaaaccacatgattatctcaatagatgcagaaaaagcctttgacaaaattcaacaacccttcatgctaaaaactctcaataaattaggtattgatgggacgtatttcaaaataataagagctatctatgacaaacccacagccaatatcatactgaatgggcaaaaactggaagcattccctttgaaaactggcacaagagagggatgccctctctcaccattcctattcaacatagtgttggaagttctggccagggcaatcaggcaggagaaggaaataaagggtattcaattaggaaaagaggaagtcaaattgtcccagtttgcagacgacatggttgtatatctagaaaaccccactgtctcagcccaacatctccttaagctgataagcaacttcagcaaagtctcaggatacaaaatcaatgtacaaaaatcacaagcattcttatacaccaacaacagacaaacagaaagtcaaatcatgagtgaactcccattcacaattgcttcaaagagaataaaatacctaggaatccaacttacaagggatgtgaaggacctcttcaaggagaactacaaaccactgctcaatgaaatcaaagaggatacaaacaaatggaagaacattccatgctcatgggtaggaagaatcaatatcgtgaaaatggccatactgcccaaggtaatttacagattcaatgccatccccatcaagctaccaatgactttcttcacacaattggaaaaaactactttaaagttcatatggaaccaaaaaagagcccacattgccaagtcaatcctaagccaaaagaacaaagccggaggcatcacactacctgacttcaaactatactacaaggctacagtaaccaaaacagcatggcactggtaccaaaacagagatatagatcaatggaacagaacagagccctcagaaataacgctacatatctacaactatctgatctttgacaaacctgacaaaaacaagcaatggggaaaggattccctatttaataaatggtgctgggaaaactggctagccatatgtagaaagctgaaactggatcccttccttacaccttatacaaaaatcaattcaagatggattaaagacttacatgttagacctaaaaccataaaaacccaagaagaaaacctaggcaataccactcaggacataggcatgggcaaggacttcatgtctaaaacaccaaagcaatggcaacaaaagacaaaattgacaaatgggatctaattaaactaaagagcttctgcacagcaaaagaagctaccatcagagtgaacaggcaacctacaaaatgggagaaaattttcgcaacctactcatctgacaaagggctaatatccagaatctacaatgaactcaaacaaatttacaagaaaaaaacaaacaaccccatcaaaaagtgggtgaaggacatgaacagacacttctcaaaagaagacatttatgcagccaaaaaacacatgaaaaaatgctcatcaccactggccatcagagaaatgcaaatcaaaaccacaatgagataccatctcacaccagttagaatggcgatcattaaaaagtcaggaaacaacaggtgctggagaggatgtggagaaataggaacacttttacactgttggtgggactgtaaactagttcaaccattgtggaagtcagtgtggcaattcctcagggatctagaactggaaacaccatttgacccagccatcccattactgggtatatacccaaaggactataaatcatgctgctataaagacacatgcacacgtatgtttattgcggcattattcacaatagcaaagacttggaaccaacccaaatgtccaacaatgatagactggattaagaatatgtggcacatatacaccatggaatactatgcagccataaaaaatgatgagttcatgtcctttgtagggacatggatgaaattggaaatcatcattctcagtaaactatcgcaaggacaaaaaaccaaacaccgcatattctcactcataggtgggaattgaacaatgagatcacatggacacaggaaggggaatatcacactctggggacagttgtggggtggggggaggggggagggatagcatcgggagatatacctaatgctagatgacgagttagtgggtgcagcgcaccagcatggcacatgtatacatatgtaactaacctgcacaatgtgcacatgtaccctaaaacttaaagtataataaaaattaaaaaaattaaaaaaaaaagatggattaaagatttaaatgtaagaactaaaaccataaaaaaccctagaagaaaacctaggcaataccattcaggacataggcatgggcaaagacttcatgactaaaacaccaaaagcaattgcaacaaaagccaaaattgacaaatggggtctaattaaactaaagagcttctgcacagcaaaagaaatgatcatcaaagtgaacaggcaacctacagaatggaagaaaatttttgcaatctatccatctgacaaagggctaatatccaaaatctgcaaggaacttaaacaaatttacaagaaaaaaaaaaacctcatcaaaaagtgggcaaaggatatgaacaggcacttcacaaaagaagacatttatgtggccaacaaacatgtgaaaaaaagcccatcatcactagtcattggagaaatatgaatcaaaaccacaatgagataccatctcatgccagttagaatggttatcattaaaatgtcaggaaacaacagatgccagagaggatttggagaaataggaacattcttacactgttggtgggagtgtaaattagttcaaccattgtggaaaacaacgtggcaattcctcaaggatctagaaccagaaataccatttgacccagctatcccattactgggtatatgcccaaaggattataaatcattctactataaagacacatgtacatgtatgtttattgcagcactattcacaatagcaaagacttggaaccaactcaaatgcccataaatgttagactggataaagaaaatgtggcatatatacaccatggaatactatgcagtcataaaaaagaatgagttcatgtcctttgcagggacatggatgaagctggaaacaatcattctcagcaaactaacacaggaacagaaaaccaaacactgcatgttttcactcatcagtaggagttgaacaatgagaacatatgggcatagggaggggaaaatcacacaccagggcctgtcatggggtggggtacaaagggagggataacattagaagaaatacctaatgtagacaatgggttgatgggtgcagcaaaccaccatggcacatgtatgcctatgtaacaaacctgaacgttctgtacatgtatcccagaacttaaagtataataaaaaataaatatgtaaataaataacaaataaataaataagagtaaagtatcaatttggtggtgaagtataatgatcataagtagaaaaattcaattgtgggaaggaaggtggcccatttttctttcagttgcttgtgggcggtagaggcattcttcaagcacctaattaatacttccattctggttatcattctgcattaggatggccagtgacctttttttcatttactggtgcattataatattttttcaaattaaattttataaaagaaaaagaaaccagtctaagacctgatgattatactttatgtcagaagggaaatatttgaaattatggaaaatcatatctcccaattgtattagagctccttcaggacaggcatactcatagccccttgaaaggaagctctttcaacaatcttcctctaagcaacatagctatcaataattttggatagtcatcttatataaaacaagacctaattaatttattgaattaagttccctggaccaggttcctagaccaaggtggtgcctgaaacaaggacagattattcatgtatcatcaggtgatttacaggacaaattggcacaaaaatcactatggaaagaggtatccaactgtactccttcagctgctcttgcaaaagtccacactcattcccaagcagcatgcctctaaacatgtgaactagtctatctcctataacttcctcttatatacattctgcctagtgttaccccttcatctatcacttgcatttatgaatcttataatctgagctgggaactaaaacatatgaaagaggttctagattcctacttttaccactaccaactcaagcatctaatataagtcaagtgtttgacagcagcagttgtagaaactagtcaccaacctaaattatgtcattcaaaggcaccagggaccttcaataggcacattcagagagcctctgaatggacttctactttccatgttataatctgtaaagggaaatcagtggatgccttgtcagcaagagattcacatttcttttgtttgttcctctccagtttttacaatcctccaattactgacactattcctctcaaatttgctatctgacatttgtccttggatgtggcactggtatttcattaacagatactaggtccaggtgaagatgagactgctcacatgcacttccttaaacatggctctcaagtacagtttctctccatttgtaaacctgtgaactaaacagataagctttctgtcccctacacattactcagacagtggagtgatgagcatagtataaccaacacatacatttttattcaaagagatgtaatgcaaagtacagagaagtcattgatccagaacagttctgaaacccagctgggcaaatgttgcaggttccatgactaagactcatccatatcttccccaagagttgttctatatgactcctggctacatcctcccagctctttgttctgccttctaagtcatcctttcattttcattaaaactgacgtatagctgaagacatagttttctcagcctgattcttatcagtaatgtttgaagatccaatggtctgttttcattgcctgctctctctgtccatttctgtccaaactggtagtgtttctcctgatataattctattaaaaatttcctgggtctcctttgaatctttttggagggtctgctcattaaataaaagacatctaaaaatcttcccaagtaagcccatctcttcattatgcttctatcaagaaacaatgcccttaagcttcttaaaagtgatgtttttattgaaagaatctgtgagtcatgacatcgaaatatttagagaaccttttgaactgagtaataatctggggcatcatgtaagacagctttgatgttttaacaaaggttttttttaaatttgtgtgggtacatggtaggtgtatatatttatggagtacataagatgttttgatacaggcatgaaatgtgttataattacatcatggagaatgacgtattcatcccctcaaccattaatcctttgtgttacaagcaattcagttgtactcttttagttattttatgatgtatagttaacttatttttttttttttttttttttttttttgagacggagtctcgctctgtcgcccaggctggagtgcagtggtgggatctcggctcactgcaagctccgcctcccgggttcacgccattctcctgcctcagcctcccaaggagctgggactacaggcgcccgccactacgcccggctaattttttgtatttttagtagagacggggtttcaccgttttagccgggatggtctcgatctcctgacctcgtgatccgcccgcctcgtcctcccaaagtgctgggattataggccaattaacttattattgactatagtcactctgttgggctatcaaatactaggtcttattcattcattccattttttgtactcattaactacccctacctcccaacaaccccagtcctcccactatattccccagcctctggtaaccttccttctgctctctatctccatgagttcaattgttttgatttttagatctcacagataagtgggaacatgtgatgcttaccttgctgaggcttatttcacttagcataatgaactccagttccgtttaacaatggttttttttttaacattcaactcccaacttattcatgtttgacatttccttcttttctctctttgcttgcattttactctaagcagcaatatgaaatcaggctgtatttttagtgctttacccagaaattccccaacaacacccagttcattaggcatgttttctgcgttccacataccatatggaagaatattgctaaacatctgccattcataacaagaagtcctttcctccagtttccatgtttttcacattgctttaagtctcactcacaactgcctaaaaatcacataatgcttctaaaaatattttcaaggctgttcaagctttatataactttctcatcaaaatctttctagttgcagaccactgcctgcttccaaaccactttcacgtgtgcagatattattaggatagcactctgctcctagtatgaagagatgtatgaattacttatcactgcaaaacaaatcatcccaatacctagccacttataccacaaacatttacctcacacagtttctgaaggtctagcatcctaaagcaacttagccagatacctctggttcaaggtcttttatgatgttgcagtcaaggtgtcagcaggggttgaatttgtctaaaggactgactggtgctggaggatctgcttcaagatggctcactctctagctgctgttggaagaaggcttcagttccttgccacaaaggcctgtcctcagggaatgtcctcatggtatggcatcttgctttcctaggagtaaataacccaagaggcagagcaccctgccttcttatgactgtctgcaaagccacacaccatcacttctgttttgttcagttactcagaagtgagtcaccacatccagcccacactcaagtagaagagaattaagctctaatttttaaagacaggattattaaactataagtgcatatatttcttttcaaaaccacaaactgcatcactgttcaacttctacctttgcccagtcttgtgttccttatatgcttacaaatgttggttctaagagcacccgaaaaaaaccttcctgcatgtacatttctgcctcagactctctttctcagtgaaccaacccaaagaaacctatggcaatggctaacaaaacacagcaatgctttgtgcaaaatagatgggctaccaacaagagtattactattatatacaatcaaaagaagtcaggaaagataatcaacaatttgagggcagattgccccataaaaaattatggtttcttttttaatttccacatcagagccgggtctcagaacccaaagccactggatgaaggagaagttgtatccctagaaggaagacctctgaaacaccagagtaattgcatatttaaatgattcctccagaccttcccaaagaaatctatgccatttacttgcatgaacatgcactggaaacattctgaggactgctgagcacagagttcatggtggcataaatattcagggactcaaagagtcatcatgctgccattttaaagcaggagttttgggagtgacataatagaggatcacaaccaaggcctcaaaggagttattcccccattccttcctgaataatgggattcaccatacttgatgacgtgcagaacacccacaggtccttgacctgtggaataagaactaccaaggtgaaaaaagtcaagtggacacaagaaaactgtatctcactccctcctaaaatagtaaatcaaaaataacagtgtgttcctagtgaataacaacttttctacccttaaaagcttaaagtacacaggggttgtagtctccagtatgtctccatctaattgcttggagggccagacttaagtccatttgagtctggccctacaaataattgacagattgtcttagtctatttagtgttgctataatagaatatgtgaggctaagtaatttataaagagaagaggtttatttagcacccagttttgtgggttagcaagttcaagggtcttaccatggcttctggcaagggctttcatgttgcatcctaatatgacagagaaggacaaagaggaaatgcacatgtttgaagaaacaaaacccaaggggcaccctgacttgtaacaaccatctcagctccagagctccccatagcttggcctttgctgtaactgcatcacagttcagcttctccctctgcccaatcctgttcctccaccttccccagtaaatttcatgcccacaaacctcagactcagagtctgtttcgcagggagcctggtcagtagattctgtataatgttggactgaaatgaaactataaaaactgaaaaccccaaaacacatatttcctgtagagaaggggaagatctgttaacaggttctacccatgtgtctcactacgaaacttctttaaggaattccagccatgaagctagacagaaggaccagctgttgttcattagagcatattctgggtactgttggaagaaaaagagcaaggaactaagattgtgaggtgtaccatggtcctgtgctgtttccatccacctgacaccttcacttccttcaccacaatgatcacatggctctggagaactgaccaatcacgttattttgaagcttatgttatgaagccctaaatccatctgtactgttttctactccaggatttgatagtcacttaaaccaggaagttcctcactttgcttaaggtattttgtttgctgtcccttgcaactaagagagtcctaacacaggtctacttgttagccctgggaattcctagagagattagactaatgaagcctctaacaggttcatttctcatatttggaaatagacagatcactaaagccacacacacccttttctttctatacttttcttaatatcatacatctgccaggctccttgtgttaagagtctgggtgtatgttcttgatggacaagccctgatgagccttgcccacacccctttccaagcccagccttgtagagcagtagtcctaagtgtgagccgccaaaaccctgtttaatcaatgatctataggcagttatcagagtgctgttctcctgttgccccgtgaagtgacagggctttggggaatgtgctcagggctgcagtggacccctctccacagggtacagaggtatggaagaacagagtccttggcatctgcatttgagcaagacacagaaatttcttgttatatttccctcagctgagatggtggtaaagtttgctaccactacagttgtgtcagactgggctccctgagacattaaagctgccctcttgataggtttcactatccaggcaagttctgccacagccacaaagttggcagtctctgtgctacatcaataccaaaagactaattaacactaaggagtttctgaggttccacagatttctacttcctccctggactgaattctcaccccagccctcataaacaagacacgccttcttgcttccactcttgtaagcagaaattgaatgtgggtaatcaaaactcagtgtctataccctgcagacaactaccatcccaagggtgccaacaatcagttttgtaagtttatcctactcactgatatatgctactactcacctgatagtgggattatatgcagttgactctgcccctgctagagagccctgtggatggcacagccctttgccatggcccaaattgtctctattgtgatgcatcattggtccttaattacccatttcctctgcttttctcttggtccattgtgaatcagcactttatttcagtttccttattctataaatgttcactcagttaaagcaccgccaaagctggttgaagggggagtctgttgaaaagggccacaaagtctgcaatagtagaaataatggagatgaacccatagccatggagtgagggaatatcctcatcgagttgtttctaaaatgtgcaaaacagtgcctggcacagtgggaacacttgaatgtcaccactgttgtcattattttattcctactgactctgttggcaaagcatgtcaatgaaggcttccaatctaacaggtgcctctgcagctttcaatcggagctgctgcatttattttatccctttttcacattggacagctcagtggtacactccagaagatggggttctgctgcaaaagaaaagtgtagctctggaaaatcagtggaggctacagttcctcatctttccaacacagaacctacagccaactctgaccacagctcatgggttcaggcaaagctgggggcagccacctttcattaggacaaaaagacaggaaacctgtggcatccacttatttgttttcaaaagcccttctttttgaagcaaagcttctttttgaagtaccaaaaattaatcatttacaaagcatcccccatatttttataaactcagaaatgttttagctttgaagttgaaatttaatattttttaaacaaatgtaaaaattgatctttttatatttcacctagaaaactgaataagctgaattaccaggaatatttttttcactttcatttttaagtaaaaactttgcaacggaaaacaaaatagtacgtagaaatattttgtaaactataaggtattttgaaaacactaattacatgttgttgttttttacttcaagttctgggatacatgtgctgaacatgcaggtttgttacatagccatacacgtgccatggtggtttgctgcacccatcaacccgtcatctaggttttaagccctgcatgaattaggcatttgtcctaatgctccccctcccctttctgcccaccccctgacaggccctggtgtgtgatgttctcctccctgtgtccaagtgttctcattgttcatctcccacttatgagaacatgcagtgttcggttttctcttcctgtgttagcttgctgagaatgatggtttccagcctcatccatgtccctgcaaaggacattaactcattcctttttatggctgcataggattccatggtgtatatttactacattttctttatccagtctaacattgatgggcatttgggttggttccaagtctttgctattgtgaataatgctgcaataaacatacatgtgcatgtgtccttatagtagaatgatttataaccttttgggtatatactcagtaatgggattgctgggtcaaatggtatttctggttctagatccttgaggaattgccacactgtcttccacagtggtcaaactaatttacactcccacaaacagtgtaaaagctttcctatttctccacatcctcaccagcatctgttgttcccagactttttagtgaccaccattctaactgacgtgagatggtatctcactgtggttttgattttcatttatctaaagaccagtgatgatgagctttacttcatatgttttttggccgcataaatgtcttcttttgtgaagtgtctgttcatatccttcacccacttttcgatggagttgtttgttttttcttgtagatgtgtttaagttccttgtagattcagaatattagccctttgtcagatggatagattgcaaaaattttctcccattctgtaggttgcctgttcactctgatgatagtttcctttgctgtgcagaagctcttagtttaattagatcccatttgtcaattttagaattttagtttttgttgcaattgctttttgtgttgtagtcattaagtctttgtccatgcttatgtcctgcatggtattgcctaggttttcttctagggtttttatggttttaggttttatgtttaagtctttaatccatcttgagttaatttttgtataaggtgtaaggaagggatccagtttcagttttttgcatatggttagccagctttcccagcaccaattattaaataagaaatcctttccccattgcttgtttttgtcaggtttgctgaagatcagatatttgtagatgtgtgatgttatttctgaggcctctgttctgttccattggtctatatatctgttttgataccagtaccatgctattttggttactgtagccttgtattatagcttgaagtcaggtagtgtgatgccttcagctttgttctttttgcttaggattgtcttggctatgcagcctcttttttggttccatataaaatttaaagtatttctttctaattctgtgaagaaagtcaatggcagcatgatgggaattgcattgaatctataaattactttgggcaatatggctattttcatgatattgattcttcctatccatgagcagggaatgtttttccatttgtttgtgtcctctcttattgagcagtggtttgtagttctccttgaagaggtccttcacatcccttataagttgtattcctaggtattttattttctttgtagcaattgtgaatgggagttcactcatgatttgcctctctgttcatctattattggtgtataggaatgcttgtgatttttgtacattgattttatatcctgagactttgctgaagttgtttatcagcttaagaagttttgggactgagacaatggggttttctaaatatacaatcatgtcatctgcaaacagagacaatttgacttcctctcttcctgtttaaataccctttatttctttctctttcctcatttccctggccagaagtcccaatactatgttgaataggagtggtgagaaggggtgtgtttgccttgtgccagttttcaaagggaatgcttccagcttttgcccattcagtatgatattggctgtgggtttgtcataaatagctcttattattttgagatatgttccatcaatacctagtttattgagagtttttagcatgaaggggtgttgaattttatcgaaggccttttctgcatctattgagataatcatgtggtgtttgtcattggttctgtttatgtgatggattacatttattgatttgtgtatttgaaccagccttgtatcccagggatgaagccaacttgatcatggtgaataagctttttgatgtgctgctggatttgatttgccagtattttattgaggattttcgcatcaaagttcatcagggatattggcctgaaatgttctttttttgttgtgtctctgccaggttttggaatcaggatgatgctggcctcataaaatgagttagggaggaatcactttttttctattgtttagaatagtttcagaaggaacggtaccagctcctctttgtacctctgttagaattcaactgtgaatccatctggtcctgggctttttttggttgataggctattaattactgcctcaatttcagaacttgttatcaatctattcagggattcaacttcttcctggtttcgtctttggagggtgtatatgtccaggaatttatccattttttctagattttctagttgatttgcatagaggtgtttctagtattctctgatggtagtttgtatttctgtgggaccagtggtgatatcctgtatgtcaggcctctgagactaagctaagccatcatatcccctgtgacctacatgtatacatccagatggcctgaagtaactgaagaatcacaaaagaagtgatatttaaatggcctgttcctgccttaactgatgacattcaactgcaaaagaagtgcaaatggccagtccttgccttaactgatgacattagcttctgaaattccttctggctcatcctggctcaaaaagctccctgactgagcaccttgtgacccccactcctgtctgccagagaacccccctttgactttaattttcctttacctacccaaatcttataaaacagccccacccttatctcccttcgctgactctcttttcagactcagcctgcctgcacccaggtgaaataaacagcctcattgttcacacaaagcctgtttggtggtctcttcacacagaagcgagtgaaattttggtgccatgacttggaccaggggacctcccttgtgagatcaatcccctgtccttctgctctttgatccgtgagaaagatccacctatgacctcaggtcctccgactgaccagcccaaggaacatcacaccaattttaaatccagtaagcgacctctttctactctcttctccaacctctctcactatccctcaacctctttctcctttcaatcttggcaccacacttcaatctctcccttctcttaatttcagttcctttccttttcttgtagaaacaggagatgcattttatccgtggacccaaaactccagcaccggtcacagactcaggaagacagtcttcccttggtgtttaatcatacgcggatgcctgcctgattattcacccacatttcagaggtgtctgacccctgaccccttctctccatttctctaccccttctccacttttatggggggcaagaacacccccaaccccttctctccatgtctctaccccttctccacttttctgggggacaataaccccctgaccacttctctccatgtttcttggggagcaagcaccccccaccccttctctctgtgtctctactctctcttttctctgggcttgcctccttcactatgggtaggcttccaccctccattcctccttctcccttagcctgtgttcttaagaacttaaaactgtcaggcctctgagcccaagctaagccatcatatcacctgtgacctgcaagtacatatccagatgtctggttcctgccttaactgatgacattccaccacaaaagaagttaaaatggcttgttcctgccttaactgatgacattaccttgtgaaattccttctcctggctcatcctggctcaaaagctcccccactgagcaccttgtgacccccacccctgccagccggagaacaacccccctactttgactgcaattttcctttacctacccaaatcttataaaatggccccaccccatctccctttgctgactctcttttcagactcagcccacatgcactcaggtgaaataaacagccttgttgctcacacaaagcctgtttggtggtctcttcacatggatgcaagtgaaaaaaaacctcttcaactcacacatgacctaaaacctaaatgccttattttcttctgcaacaccccttgaccccaatacaaactcgacagtggttccaaatagccagaaaacggcactttcaatttttccatcctacaaaatctacataattcttgtcataaaatgggcaaatggtctgaggttcctgatgtccaggcattcttttacacatcggtccctccatagtctctgctcccaatgcaactcatcccaaatcttgcttctttccctcccacctgtcccctcagtcccaacccaaagcatcactgagtgtttccaatcttccttttctacagacacatctgacctctccccaggctgcccctcaccaggccgagctaggtcccaattcttcctcagcctctgctcccctaccctataatcctttttatcacctcccctcctcacacccggtccagtttacagtttcattctgtgactagccctcccccacctgcccagcaatttcctcttaaaaaggtggctggagctaaaggcatagtcaaggttaatgctcctttttctttatcccaaatcagatagcatttaggctgtttttcatcaaatataaaaacgcagcctagttcatggctcgtttggcagcaaccctgagatgctttacagccctagcccctaaaaggtcaaaaggtcatcttattctcaatatacattttattgcccaatccgctcccgacattaaataaaagtacaaaaactaaattctggccctcaaaccccacaacaggacttaattaaccttaccttcaaggtgtataataataaagtagaggcagctaagtagcaatgtatttctaagttgcaattccttgcctccactgtgagacaaaccccagccatatctccagtacacaagaactccaaacgcctgaaccacagctgccagggtttcctccagaacctcctcccccaggagcttgctacaagtgatggaaatctggccactgggccaaggaatgcccacagcccgggattcctccaaagccatgtcccatctgtgaaggaccccactgaaaatcagactgttcaactcacctggcagccacttccaaagcccctggaactctggcccaaggttctctgactgactccttcccagatcttctaggcttagcagctgaagactgacactgcctaatcaccttagaagcctacaggaccatcacagatgctctaggtaactctcagagtggagggtaagtccatccccttcttaatcaatacggaggctacccactccacattaccttcttttcaagggcctgtttcccttgcctccataacttttgtagatattgatggccaggcttctaaacctcttaaaactccccaactcttatgccaacttagaaaatactcttttaagcactcctttatagttatccccacctgcccagttcccttattaggccgagatattttaactaaattatctgcttccctgactattcctgggctacagccacaccttattgccaccttttcccccagttcaaagactccttcacatcctccccttgtatctccccaccttaatccacaagtataggatgcctctactccctccttggtgaccgatcatgcaccccttaccatctcattaaaacctaatcacccttaccctgctcaatgccaatatcccatcctgcagcatgctttaaaaggattaaagcctgttatcactcacctgctacagcatggccttttagagcctataaactcttcttacaattcccccattttacctgtcctaaaaccagacaagccttacaggttagttcaggatctgcgccttatcaaccaaattgttttgcctatccaccccatggtgccaaacccatatactctcctatcctcaatacctccctctactacccattattctgttctggatctcaaacatactttctttactattcctttgcacccttcatcccagcctctctttgctttcacttggactgaccctgacacccattaggctcagcaaattacctgggctgtactgctgcaaggcttcacagacagcccccattacttcagtcaagcccaaatttcttcctcatctgttacctatctcggcataattctcataaaaacacacgtgctctccctgctgatcctgtccagctgatctcccaaaccccaatcccttctacaaaacaacaactcctttccatcctaggcatggttaatgcagtcagaattctcacacaagagccaggaccgtaccctgtagcctttctgtccaaacaacttgaccttactgttttagcctagccctcatgtctgcatgcagtggctgccactgccttaatacttttagaggccctaaaaatcacaaactatgctcaactcactctctacagttctaataacttctgaaatctattttcttcctcatacctgacgcatatactttctgctccccagctccttcagctgtactcactctttgttgagtctcccacagttaccattgttcctggcccggacttcaatccagcctcccacattattccagataccacacctgaccctcatgactgtatctctctgatccacctgacattcaccccatttccccatatttccttcttccctgttccttaccctgatcacatttagtttattgatggtagttcccccaggcctaatcgccacacaccagcaaaggcaggctatgctatagtaaaagccaccagcccgcctcttagaacgtctcattttctttccatcatggaaacctatcctcaaggaaataacttctcagtgttccatctgctattctgctactcctcagggattattcaagccccctcccttccctacacatcaagctcggggacttgccactgcccaggactggcaactcttaactccctcttagagaggatagatgatctttgctggcaggggaccctccaatactttcaccctgatgaagttctattctttacttttatactcactcttatcctcattcccattcttatgccaccctctacctctccccagctacctccaccacactatcaacctcactcattctctcctagctgtttctaatccctccttagtgaacaactgctggctttgcatttccctttcttccagcgcctacacagctgtcctcaccttacatgcagactaggcaacatctcctgtctccctacactctgaacttcctttaacagccctcacctttaccctccagaagaactcatttactttctagacaggtccagcaagacctccccagacatttcatatcagcaagctgccgccctcctccgcacttacttaaaaaacctttctccttatatcaactctactccccccatatttagatctctcacaacacaaactactattcctgtggccactcctttatgtatatcttggcaaagacccactggaattcccctaggtaacctttcaccttcttgatgttcctttactcttcatctccaaagcccaactacgcacatcactgaaacaactggagccttctagctctgtattacagacaagccctctatcaatactggcaaacttaaaaacattagcagtaattattgcttaggaagacacttacccagtatttcactccattcttggctaccttccccttgctcgtcagactctcctcccaggccctcttcttgtttgcttatacccagccccgtaaataacagtaaaagtttgctcatagacactcaacgttttctcctacaccatgaaaatcaaaccttcccctctacgctgttaccccattagtccccattacaacctctgatggctgccgccctagctcgatccctaggagtctaggtaaaagacacccctttcagccctccttctcatctttttactttgcgtctccagttttgcctcacacaaggtctcttcttcctctgtggatcctctacctacatgtgtctacctgctaattggacaggcacatgcacactagttttccttacccccaaaattcaatttgcaaatagaaccaaagagttccctgttcccctcatgacaccaacatgacaaaaaagagttattccactaattcccttgcttgtcggtttaggactttctgcctcccctattgctctcggtactgcaataacaggcatttcaacctctgtcatgaccttctgtagcgtctctaatgacttctctgctagcatcacagacatatcacaaactttatcagtcctccaggcctaagttgactctttagctgcagttgtcctccaaaaccgctgaggccttgacttactcactactgaaaaaggaagactgtatattcttaaatgaagagtgttgtttttacctaaatcaatctggcctggtgtatgacaacataaaaaaactcaaggatagagcccaaaaacttgccaaccaagcaagtaattatgctgaacccccttaggcactctctaattagacgtcctaggtcctcccaattcttagtcctttaatacctgtttttctccttctcttattccatttaatttttcaattcatgcaaaaccgtatccaggccatcaccaataattctacacgacaaatgtttcttctaacaaccccacaatatcaccccttaccacaaaatcttccttcagcttaatctctcacactctaggttcccacgccacccctaatcccgctcgaagcagccccgacagacatcgtccattatctctccataccacccccaaaaattttcaccgccccaacacttcaacactattatgttttattttccttattaatataagaagagaggaatgtcaggcctctgaacccaagctaagccatcatatcccctatgacctgcacgtatacatccagatagcctaaagtaactgaagaatcacaaaagaagtgatatttaaatggcctgttcctgccttaactgatgacattccaccacaaaagaagttaaaatggccagtccttaccttaactggtgacactaccttgtgaaattccttctcctggctcatcctggctcaaaaagctcccccactgagcaccttgtgacccccacccctgcccaccagagaacaacccccctttgactgtaattttcctttacctacccaaatcttgtaaaacagccccacccctatctcccttggctgactcttttcggactcagcccgcctgcacccaggtgaaacagccttgttgctcacacaaagcctgtttggtggtctcttcacaaggatgcaaatgaaactctgtatcattttttattgtgtttatttgatattctcttttcttctttattagtctagctagcagtctatttccttaattttttcaaaaaaaaaaaaagcccctggattcagattatttgaaaagttttttgtgtctctgtctccttcagttccactctgatgttacttttttcttgtcttctgctagctcaatcatcccaggtcaacatcccaggtcaattcctgctgtgctggcagcaggaatttcaagccagtgattcatagcttgctgggctccatgggagtgggacctgctgagcgagactacttggctccctggcttcagcctcctttccaggtaagtgaacggttctgactctctggggttccaggcgccaccaggggatgaaaaaaaaatttctgcagctggctcggtgtctgcccgaacagccgcccagttttgtgcttgaaacccagggccctggtggtgtaggctcaccatggaatctcctggtttgcggattgcaaaagctatgggaaaagcatagtatctgggtgggatagcacagtccctcatggcttcccttggctgggaaagggaggcctcctgctccttgcacttcccgggtaaggtgatgccccaccttgcttatgctcgccctccatgggctgcacccactgtctaaccagtcgcaatgagataaacaggatatctcagttggaaatgcagaaatcacccgccttctgcataggtctcactgggagctgcagactggagctgttcctattcgaccatcttgccagaacccccaacaagaatatttttaaaacaaagtaaataccaccatactcctggaaaaaaaaaatacacttttgctgtctgccaagaagcagcagcatggggttcacaaatagttggattcctagtaaagattctgcccagctgaaaattggctttgaaaataatgcgaccagaaactttgggagaacagaactttaagtggctcagatagccttcttagagtttggattaccattggttgttctcctaaagtgataagaagtttctagaggaacagtgtggagatcaaaatggcctatgatcaccagaatgctatatatccagcccctatgccctttgtgctgtacttgcctatgtgggttataaggacccaagtcctacagagtcaggaatcacccttccctttaaaatcttccttctttgacaaagccccgctcctacatgactgcaggaaatccagttctttcccaaaatattccagaggataccaaaggtagcttacattttcaaccaacatggtgcctctctggtctgcttgtttcctatggaccaccactggtcctgagcctcttctctccatagctacaaactttttgggtaccacaaaccatacttctccttttattccccaagaacagcgaataacaaagcttgaagataacaaaaggggagtatgtgacaataacttaaaactgggaactagagagcagcttctttctactcctggtgtcacccaagggtcccttctggcttttcccctgccgcctctgccctgctgcccctatggtggggtccattccctttttttcagttggcatctctggctgacatgttctccacccctaggcagcaaaaccagattcctttatggctctaaaatctctgcagaggtgtttgtttcctaaagttatcttttctatcattaagcaaaataactggattgtgcgcagccccctgctggatcatgtgtcactagtactgggcctccctaccattaaggaacccagcactttcaagttctctgattctccatgtgacatgcccaagtgaaccaataccaccactgccccaatcacccacccattcccaaaaagtgaaaaataagcacacaaacaagtgactagtgtttaatctcagaaacatttgcattcagagtacgttcccttagaattttctcctctccactccatgaggagtgggcatgtgctttattatatcaacaagactaagaagccgcacccgagtggtcccactcaaaaaagagatttctgtttctacctcaaaatgcagaaaccattacagattaaaagagaaacacacacacacactttgagaaactcgcccttcctcatcttcaaagtgtggggtatgcattccagatctctcagcctgatggacagcttggaagtggaagggaccaatgtccagcaagtggactttgccccatgtccattgtgccttgtgtcttcctagccaactcagaactcctcacatccagcccccagactaccgctcatgggctcaggcaaaggtgggagtagccagggtttggcacttgggagacactcaaaaatattttttggacaaacaagtgaatgtgagccctgaaactttctagagagtctctgtcccattgggttcaagccagtaaaaagccagagaagtgtctttctgtcccaaacataagcaagagatggatgagtcctctgtgcagaagttactaaacactccttggtgtggaggagttttttgttaatgaaacaacatccagtttgtttgatgaaagattaatatggtcaatgagctcaaagtcatcttcagattaaagcattcactaaaacatggctgggttagtttgcagctaaaaggaataaatatactttataaaatatgagttcctggtactcaggttctgcttccaaggaagtctcaacctagaccatataatgaatagagactgaaggaagaggtattgggaactcaactgattctcaggcaggggagtgtgagaagaaatggggaagaggaactagggatatcagtttcatcctggtcatgattcacagaaatgagtgcagagggaagacaaagtcagatgcccagactgcagtgttggggaacaggaggccattgagtttagattgctaagaaaaggatggagggtaaaaacattgaagagtttcagtgagagtctattttctccaaataggagaaaagcttatggagataccaacagaccttatctgaaacactctgagggttccatcttgctcttttccacattcttcatattttctaggtatctctggaggcataagagaacacttttctagcttttttgggtggtttcagctaccagctatcactacaatccccagccataatttcagatcttccatcctgtcaactttcttcaaaacacaaaaataactcctttctctccctcactcacacagtagagttcaattgattaaacttatcaaattattttaaatattcatctgaaatcagtgagactagaaacttcacattttagggtaattatgaggtacaaaagcaagataaattgtcttatcgatgatacttttgatagaagatttttaaacaataaggcataaagttgatgtataattttaaaaagaaaatatttcttgggatatgtgtttctagattaaggtaccatgggccctgaataacgaatctcagtttttcttaaggtcctcctcctctgagctacactgtgggtcgaaaagggcaggattatcataaatggaaagaagctagagacattttagttaaataaaaagaacatctggaaaaagacatcttcgttactggaaatattcaagcagaggtttctgggatgtttctgatggcactcaagcatcggagaccaaggtcagcctaagacacaagcaaggtcccatcctacaaagagagtgaaattagatccgtatatgaaatgcctagcacagtgcctggcgcataagagatacacactagataccagatccttcccatcctgagagtctgtgggtctatgctcgtatatattggatgtatttctggaagggtaattggatacattgtagattcttccagaagttcacaattttcttaatcggagccattgagagaaggcaagggaaggaagcatgttctttttgcttgtgtcagtaactcttcctctagctggagttttcatcaccttcaggcagttattggtttgggctttatgctatccactacagctgaaataactgctccagcagccttcgctccttccatcagggcgtgctctacctgcaaagcacatcagttcacaggacaatcagtaccaatcctaggcttgcaccctcccctacctccaccccaccatacccattcagcaaccagcctgtctggagtctattcccaagagaagaagcagtccatgctatcttatattttcaaaactcctagagtgacaagagaccaagaaaagccaggattgttggagacagacaaccccttcctccctctgtgccatttggcccagggtctgcttccagtgtggggctcagaggcaaaggatctcacagcaccacagccactgaggccctcattctacaaacaggggatccaagagccagggagcggaactcacttggacagagccatacagtgaattcatgtccaaacttagctcttgggttcttgggcctcatgactcctaggcccaagcttcttcagaggacttcttgtaatgccctcagtccttggggtcttcatgtgcaaattctcacgggacgggaggtttctcacaccagggcccaccaagccccggacactagagaaaagcctcacaagaatggagtgcaggctggagaggatgcagagcagagaggaggaaggtgcagaaagtaaagggcacagcagggaggctgccaatggtcactgaggatgggctggcaaaagcagagactaacattggaatgtgagcccaatctgcttagacaacagaagaaacatagaaaaaaaatagaataattatgttcttcttttaatccttaattttttccatctctttaaagggggataataggttgggtgtggtggctcacgcctgtaatcccagcactttgggaggctgaggcgtgtgggtcacgaggtcaagagattgagaccatcctgaccaacatggtgaaaccccatctctactaaaaatacaaaaattagctgggcatggtggcgtgcacctggagtcccagctactcgggaggctgaagcaggagaaccgcttgaacctgggaggcagaggttgcagtgagccgagatcacgccatcgcactccagtctgggtgacagagcaagactctgtctcaaaaaaaaaggggagtagtgataataaatgctttctctgctcatctcatggagttttagtaaggatcacctattaacatgaatagcccaagttttcacatacatttaggattcaaagttatttcacatgcactgaactacatgaatttattacttctctatatgggaggaagtgacagagccaaatgcagtataggccaggcaggtaatgtgagtgaggcaggtgggtgacatacctaccccttatcccctgcaaagccacagcatgtccctacagagtgtcagcaagtaggaatgccagcccagtggcctgatcaattgtatgttaaaaagaaagctgagggccaggctcagtggctcatgcctgtaatctagcactttgggaggccgaggcgggtggatcacctgaggtcaggcattcaagaccagcctggccaacatggcaaaaccccatttctactcaaaatacaaaaattagccagacgtggtggcgcacacctagtaatcccagctacttgggagactgaggcaggagaatcgcttgaacccaggaggcggaggttgcagtgagccgagattgcactactgcactccaacttgggcgacagagcaaaactctgtctcaaaaaaaagagagagagagagaagctgagaacctacatctttttatataaaatttctatatttttaaatattggcaagtaattcaaacaaaaagtgtgtgtgtgtgtgtgtgtgtgtgtgtgtgtgtgtgtgtgtatccaagatgtggcccacaaagtactaggttgcaattttatcaacagagtatctgcttctgcttatccctgctttgttaaggaagaaatggtctttggccagtcacggtggcttacacctgtaatcccagcactttgggaggtcgaagtggaggatcacttgagcccaggagttcaagaccagcctgggcaacatagcaaaaccacctctcaacaaaaaaattaaaattaactgggtgtggtgatgcacacctgaagtcccagctattcaggaggctaaggcaggaggacggcctgagcccaggaggttgtggctgcaatgagccatgattatgtcattacactccagcctaggtgacagagtgagatcctgtctccaaagaaagaggggaaaaaaagaaaagaaagaaaagctttcagaaatatactgatttgaccaaggatacccctctagttaatagttgagctggggctccaatcgctggtcttactattagcccagtgccttttctactcctccctgggttaataaaggtgaaaatacctcctgaaccataaagtcctgcagaaatagaaggccctactagtataacgaataatataatgaaagccctgattaccattctgatcactaatgaaatgacaaaccccaagaaagctctggaagaagccatcatcagagcaaatggggtcacacctgctggctccggggtacgccatatctgaggccattgacaaagtgctcacagttcccttcaatcaggctgtactgcacgatcttgttgaccatcttttttgtacgctggatgatcttgtccaccggcaagggcaggtacgtcccatctagcttgttattgaccttccaggagcagccatgcagcacatcctccagacgactgtatttcaccacggcccgattgctaaagatggaagtaatgctgcccacctcaaactcctcacctggagaccaaagacaaacaaaggttgggaaatacaaggagtagcaaagcagagcacagtctaagactctgagtaagctgcttcccctggagtctcattggcaccatcagtagaagggtggcagaagaggggaagttggaatcaaagaaccgcagagaatcaactttcctgagaagccctttgccctgcgcctcactccctgctctcaacccgcacaggagtctctttctcattaaactcttggagcaccttcccatgtggtcccagactgtgttgcactgacctacccaagtcctaggatttgagtctcatttcctgagaagacttcagtaatcttcacaaacatgtaaagagcactctctatgtaagtgtcagctcatgggtaaaaggctatcacatacatgattatggtggttccatgtcacgcctccctctgggctgccacagggacacaggggaagccagccaagcagggctctgaatggcacctgctcctgccagcttccacctacagccacttgactgacctctactcaaatacggggattctcattaagggtatgtttgaaaacagggttccacagctttgaaaaaagaaatgtttgaaaggtgctacattatcatattcagccctgagatgagacagagactgaaagagggtcaggaacctgcccaaagctgggtgggtagtcatttaaagtagcactgctacaaccatgttgatatgcgaatgtgtatacccttccctttataagttgtccaagggcaagaaatgctccatgatcttttcttacaaatttgaagaaaatctgctgattttataaaagctggcaatagataattcagcattcaggagcagaaatggcagaattcattttcagagagcaagataggggtgggggaagacataactgataagtatctctgtggttgtacaagagggaaactcctggacttagtctggaaagaagagatgaatttctacattctttgagtaggttctgagacaagaagtgggaagggtatgagtggatggggcagagaagagaggcaatgagaaaggggctctgctccatgggaacatccctgcatggtgagagactgggccagaggaagaggacaggacacagggatgacagctgagaacaagttaggaccaaaggcctttggtatagtgcccttctgtaattcaactttgaactggcaatacctgcacaggagacagcattcaaagtgcattcaatggtattcaacagggtctacctaccccttcctctcccaaaccccaacccttatcaggcctcatctcctgagataaccactgtgaccagcagttctagatacccaattttaagttgtttcccattttgctgtactcttcctctactatcatcacctcctcccccatcaaatctccactaagatttaattaacacaaattgaatctcagccatatgttaagcagctgtgagaaatgaaaagagggctgtatctacatttagggtgaaacagcaaggagcatgttggaacagcagcgagacaaggtgaggacgaaggtgccaaaggtgatcaagaagccagatgcagtgtctgaggactatagaaaacaaatgacgatcagaacatgtgagcatctgcaccctccttggggaatcctcagaaagatgaggatagatgctcaacttttgtcaatacaaaatggagctcaagttctaaaatgtgtgtatttaaacaaagggccctctaggaggtcagggaacttgggccacgctctttacacttgtatcactcttaggcctggacactcattggtttttggtgaacagagaccaagctctgtcacacagtaagcaaaggtccagtcatgcttcaaggggtcccattgctaaagaatggcagtaactgaggaacacagtaattaactgtgcttctatttactttgctaacttcaatatcagtatttcaatagactattcactcttacttgggggagccagatggaccacgcaatcatcttctacatagatggcccagtgctcatagccaattcgaaaaatctcaatcaggtctccaggtctgggtcttggttttccctataatggaaaaataaaagataaatggcacatgctcaaggaactccagagaccttgttttaggatcagggacagctcagcctaaagatcccctcagtgtggttcatcacttcacagaaacccaagctaaagaaatttctcttcacactgaggaccaaagaagtcccctcctctcctaccccactcacattactaaagccatcaaggatacccgtgccagttatcaatgtattgcctctcagctgtgaatgtatcctccaatatataccctgtgatagatgactaaacttgttttaagcatttcttccttaaagcaagtaagatgttaaaccttctcagtaaagggtgctggctttctcttgtactgcaagacaaaggggttctcctgcagtttctggctggggtgggcaggatgatggtcagtagtgtgggtgtgtggacatctagtagagttctacctcagacccaggatcctcaaggcctcctgcccctgctggcaccctgattccctctgcagggcccccacgtgacccacctgaagcccagagggtgcccccatcctctgcacacccacaccaccagttgctaatagccacttcagtcctgcttgcccagcaaatgcaaacttctctattatcgtgtgtgtgtgtgtgtgtgtgtgtgtgtgtgtgtgtgtgtgtgagagagagagagagacaggtagagagagaatgagaatatacatgaataggtaggcatagagttgtacataagcatccatctttttaaaaaatatttgaccagagctccaggttgcaccttcactgctgtgttatcatctcctagagacccagcttctgtggccctgtgacctgcaggtctttggaaatccatagctaagatgttaggactccgctggaagcctagaaatggtattgctgtctctaagccagacctgatcaactacctggagcaaagaaaagagccctggaatatggagagacacaagatggtagcgaaacacccagttacatgttctcatttcacccaagacctttggccaaaacagggtataaaagattcattcccaaaagtgatactaaaaagatatggaaaatgtgaacatgagaatttacaattaaggaaaggctgtaaaagtgtgggtgagtgcaaagtgcacaaaggaggtcataatggacttaattaatgtcattaatgtcgttaatttgtcaactactcagagcaaaatattttaatgtaatacatatgtgaaagtctctagcaaattttcgaattcaaatagacataagacatggcatactggagagaaacctttcaaatgtaaagaatacggcaaattggccaggtgcagtggctcacacttttaatactagcattttgggaggccaaggtgagtggatcacctgaggtcaggagttcaagaccagcctgaccagcatggtgaaaccccatctccactaaaaatacaaaaaaattagccaggcttggtggcacgcacctacagttccagctattcaggaggctgaggcaggagaatagcttgaacccaggaggtggaagttgcagtgagctaagatcgcgccattgcacttcagcctgggtgacagagcaagactcccatctcaaaaaaaaaaaaagaatgtggcaaattatttcacatgctctcacacctaactcaacatcagagaagtcatactagacagaattcttacagatgtgaataatgtggcaaagcctttaactggtcttcaaaccttaatgaacataagagaattcacagtagagagaaaccctataaatgtaaaggatgtgacaaagccttttaagtgcatctcaagccttagtaaacataagataattcgtgctggagaaaaaccctacaaatgcaaagaatgtggtaaagcttttaaccagtcttcaactcttattatacataagagattcatactggagagaaaccctatgattgaatatggcaaagcattttaaaggtccgtaaacataagataattcataccggagataaactctacaaatctgaaaaatgtggaaaagcttttaaccacacctcatacttttctaaacataaaataagttatactggtgagaaatcctagaaatgtgaagaatgtggcaaagcctttaaatggatgtcacaccttactgtatgtaagataattcatactaaagaaaacccctacaaatataaataatgtggcaaaacttttaattaatgttcatgccttattgcacacgaaagcatttatactttagaaaaattgtacaaatataaagaatgtggaaaagccattgctatctgctcacatcttactcaaaatcagagaattcatacttaatgaaaccattataaatgtaattactgtaaaaaaaactttcagaaaatataagcctttaaagtgaataagagtatttattctgaagaaaaacattacatatataaagaggactgtagtgcctttacttgtattacaaaccttattgtacatattttatactagaggaaaacaccaaagcagttgttcaaaccttgttgaacatcagagaatttatgttgcaaagaaaccttacagatgaaatgaatgtagaaacacatttgtttaaaaactccagcatgaagaacaccagagagttcatactaaaagatacttttgcagatgcagtaaatgtgaaaaaaatatttaatcaaacattaagtctatataaacatcagaggattcacagtagaaagaactaaggtatagacacttcatacattacactaaatcagagtgttgagtacagaaaataattcaaagccaaaactgtcagattttttttgtatataactttaaaagaaacagaagactttttttgaagagttataattacaaagtatttgttttcccttgaaaaaattatagcttgttgaaagcaaatgtaatttaattctcaaattacttcatgctgttccttcattcctattgtttatgtgaaagcatgtgatccattattgttgcatcagatctatgatagattctttttcattagttgggcattatttatgaccatttccatggaagagtaaagacattgaaataaatgtaaggtgcgcaatgaaaatctaagtggagaggctctttgtggttgacttataacattgtttgagtgaagcaagaggtaagtgttcagagtaatattcttctacatgacagtgagacgaaaacattttgaattttagtagtaaatcattttaccaattgtacttttatgtaataaaatgcagtacattttgaaattctgatttaagattacaggtgaacttaattttttaaacaaaattgtttttaaaaaacattaataggctggataaagaaaatgtggaatactatgcagccataaaaaggatgagatcatgtcctttgcagggacatggttggagctggaagccgttatcctaagcaaactaacacaggaactgaaaaccaaacaccgcatgttctcacttataaatgggagctgaatgatgagaacacgtggacacacaggaaggggaacaacacacactggggcctgtcagggtgggggttggaggagggagagcatcaggaacaatagtgaatggatgctggacttaatactaaggtgatgggttgatctgtgcacaaaccaccatagcacaattttacctatgtaacaaacctgcacatcctgcacacataccccagaacttaaaagttgaagaaaaaaaaaggaaagaaaaaaacagcccaaacagccatcaataaggaccagttaagtaaataatcctatatccacacacacagagacattagagagaggaagttgaatttacatgagcagcgtaatgctgctgagattcatgcttgctgcagcatgcgtcagttactccattatatggaggcaccacattttgcttaaccaacgttgttctttttcagtatcactttggctatcccaggtcctttgtctttccatgtaaattttaggatcacttcatcaatggttatcaaaaaaaatattttgacagggattgtgtttaatctgtagatcgatttggtgaagactgccaccttaagattgcagatatttcgcaatccacaaacatggaattttttgtgtgtacttaaatcttcaatctcccttaccaatgttttgtagcctaacatttttgttaaagttattcctaagtatttttatgctatgatgaatagaattatttttttaatttcattttcaggtagttcacttgtaatataaagaaattccattgatttttgtacattagccttatattctgcaactttgctgaacatatttaattctaatggttttgtggcccaggcgcggtggctcatgcctgtaatcccagcactttgggaggccaaggtgggtggatcacttgaggcaaggaattcaagaccagcctgggcaacatggtgaaaccccatctctattaaaaatacaaaaaaaaaaatgagccaggagtggtggcacacgcctgtagtcccagttacttgggaggctgaggcacgagaatcgcttgaatccgggaggcagaggtggaagtgagctgagatcgtgccactgcaccaccgcactccagcataggtgacagagcaagactctgcctcaaaaaaaaaaaaagttctaatagttttgtaagtacaggcatgtctcattttactgtgctttgctttattgtgcttcacagatatttcattttttacagattaaaggtttgtgacaaccgtgcgtcagataagtcaattggcgccttttttcaaacagcgtgtgctcgctttgttagcattttttagcaataaagtatttttaattaaagcatgtacttttttacatgtaatgctattgcaaatttaataggctacagaataatgtaaacataacttttatatgcactgggaaaccaaaaaatgtgtgcgactcactttcttgcaatattcgttttattctgacggtctagaaccaaacccacaatatgtctgaagtatacctgtatgtgattgactccttaggattttctacatacattgaatttttcataggtgccctttttcaagttgaggaaactccctttaactgagttcaagagaatttttttttatcatgaatggcagattttgacaaatgctttttccagaggtattgagatgatcatatgatttttgtcctttactctattaacatgatatttttttgttgttttttttttttttttggttttttgagaggaagtctaactctgttgcccaggctggagtgcagtggcgcaatcttggctcactgcaacctccacctcctgcgttcaagtgattctcgtgcctcagcctcccaagtagctggattacaggcatgcgtcaccactcccaggtaatttatttggtttgtttcaccttgttaaccaggctgatctcaaactcctgacctcaactgatctgcctgcctccacctcccaaagggctaggattacaggcatgccccacagcgcccagccctggtatattacattaattgacttgggggtgttacaccaaacttgcatttctgggataaatcttagtcattgtgtataatcatttttatattcatgctggattccatttgctagcatttttctgagggtttttacatgtatattcatagagatattagtcttgtagcttcctttttttgagataccttggctttggtatcaaggtaatactggcctcacagaatgagttgggaagcatttcttcctctattttcagaaagagtttatgaaagattggtaatttttcttatttaaacgcatggtagaattcttgagcaaagccatctgggcatgagattttctttgtgaaaagatttttatttactaattcaatttagattttctagtttttcttgagccagttttataatttgtgtctttctaggaacttacccaattcatctcagttgtctaatttgtttgcttaaagtttttcatagtgttcccttttatgtctataagattgatagtgagccccctcttacattcccagttttggcaatttgagtgctctctctttttttcttggttagtgtagctaaaagtttgtctattttacctttccaaaatactatcttttggcttcattcattttctttattgatttctgttttctatttcattgatttctactccagttgttatcattttcttacttctgcttgttttggttttagtttgctttgtttccctagtttcctaaggtaggagcttagattattgatttgagatattttttcctttctaatacaggcatttgcagctataaattttcctctaagcacttcagctgcatctcataaaattgatatgttctgtgttcattttcactcaactcaaaatattttctaacttccttgttctttttttgaccatgggttatttagatgtatgttgcttaatttccaaatacttgtaaatttcccaaaatatcacttggctattaatttctaatttaatttcatgtgatcagataaaatattttgcaggatttcaatcccttcaaatttactgagacttgctttatggcctagaagagggtctacactggaaaacactcatgtgtgctagagaagaatatgtattctgttgttgagtaaaatgttttataaatgtcagttagatcatgtcagttagttgcttacatcttctatctgctcactgattttctgtctagttgttctatccactattgagagtggggtattgaagtctcccaactattatttctgaattcccaatttatccctttatttctatcagtttttgcttcatactttttgggattattttgttggatatgtatatgtttataattgttatatcttcctgatgaattcaccttttgtcattatagaatgaccctttttttctaataatacctcttctcttaaaatctattttgtctgatattagtacaaccactcctgctacggctactgtttatatcaacctatttgtgactttagatctaaagtgtgcctcttgtggatggcatataactggatcttgtactatcaagtcatatgatctctgcctttttttggtgtgtttaattcattcacatttaatgttactattaataaagttggatttatgactataattttactgtcaatcttctgtacatcacgtcttttttgttcctctgttcctcttttgccttcttttttgtatcaaatacgtattttctaatgatcattttaattcctctgttaactttttaataacatttttaatagttttctttgtggttgctctagggattacaatgtgcatcttgacttattgctatctacttcagattaatactaacttgattcctgtaaaatatggaaacttaaaattagctccattccttcttccctcctttatgttattattgtcagatatattacatccaaatatgttataaaccgaagacagtgttacaaatattgctttatacaaatttttgtcttttaaattagttaagagaaaaaggaaaaagtatacttatggtcatttatattaactacattttaccatttctggtactctccatttcttcctgttgattaagatacttactgtctggtgtcattgatctaatacagcttcatttcagtccctctcctttgtgctattactattatatttattatatatttgcatgttataagaccaagaataggatttataactagttttattcaattacctttcaaattggtcagcataaatgataaaatatatatttagattcttctgtataattacctttactggtgctttgtatttcatgtggcttagaatgctatctggtgtgactttctttccacccaaagaattttctttgctatttattttaaggcaagtgtgctagccacaaattctctcattctccattcatctgggactatctttatttcaccttcatttttgcaagatacattactggatacaaaattattggttaacaggtttttttctttcagcatttttaatatgtcatcccactgccttctggtctccattgtttctgatgaaaagttgactattgttttttattgtgcatctcttgtatacaataagtctttttttctcttgctgttttcaagattctctctttgtgtttggctttcatctgtttgaatgatatgtctgggtattcacagagcttcttgggtgtatagattaatgttttacatcaaatttggaaagtattcagttatcttttatataggtatttttttctgcctttttatcatctctctttctgggaccccaattatacatttgttggtttgctcaatggtgtctccttggcctctgaggctctgttcatttttctttttctttttcctcctactcttcatactaggtagttgctgttgatccatctttgagtttgctgattcttttttctttttggtaactcaaatttgctgttaaatcactctagtgaatgttttattttggccattgtgtttttcaaccccagtattttcatttggtgcttctttatcatttctacctccttattaatattgtatatttgatcggtcattgtcattccactttcctttaattctttaaacttgattttatttacttctttaaatatactcaaaatagcagtttagaagtatttgctacatgcaacatgtaggcccactaggaaacagtctctactgtttttgtgtgtatgggtccctctttcctgtttctttgcaggtctcataatttgttgttgaaaaactggacgttctaggtaacataccgtagcaactgtgggctctgatctccttccccacccaaccagggcggacggttgttgctgtttgcttgtttgtttgttgtttgtttagtgacccacctggactgattctgtgatgtctgtttgtctcacagcatgtaaccactgagatatctgcttagagtttttttcttgtttttatttttatttatttttttgagacagagtctcgccgtgtcgcccaggctggagtgcaatggtgtgatctcggcccactgcaacctccgccttccaggttcaaacgattctcctgcctcagcctcctgagtagctgagattacaggtgcctgccaccatgcacagctaatttttgtattttagtagagacagggtttcaccatgttggcgaggctggtctcgaactcctgacctcatgatccgcccacatcagcctcccaaagtgctgggattacaggcgtgagccacagtgcccggcttcttgtttttaagcctggcttcctagatcggcatagcttaatggccagaagttgagccacaccttgtgccgcgaaggctttaccttttgtcagtggatctctgtgtggcttggagaattcattcaaagttccagatttttatgagtctccagtctgtcctgaatgtgaatgtgtatgcagccttgtgcataccttctagaccaccagacacatgtggcagcttttcaagaccctctttagttgtatcattacctggatttccatgttaaatttttggcaggcctgttggcctattgcttgtcctaaccagtactgcaacctcaagctagctgcaattttggtcttccatgattgtcactgagataactcttgttttcaacaaccctgggcatggaagtaaagtcagtcaccctctgctgccacgccattccctcccacaagccccacccacctggatagaacttccttaccacaaccgcagagctggaggtgaaggggcaatgctaaaacactacagacttccactgttctttctgagaaccaatagactttcttttttttttttttagacggagtcttgctctgttacccaggctggagtgcagtggcgcgatctcagctcactgcaacctccgcctccctggtttcaagggattctcctgcctcagccacccgagtagctgggactacaggctcgcgccaccacgccctgctgattttttgtatttttagtagagacggggttttaccgtgttagccaggatggtctcaatctcctgacctgcccgccttggcctcccaaagtgctgggattacaggcgtgagcccacgcccgaccacggatggactttcttaaattaacccttctcaatctgttgtatggctttggtcaaatttccagtctttaaatgactgtctttggcaattttgtctggcttcataattgttttgggaaaagaggatttgctgagatctgcactcagccattccacaagtcctgcccacttgcagcaatgagtttttgtgggcacaaagcaaacagtatacactacaatatttcatggaaggaactgaggccaagagagaggaagtgctttgtctaaagtcccacagcaagtccatggtcgagctaggaccagaactactcccttgcccctgccaacaaaccaactctttcttctgccttaaagggaaaatgtaatggcagccacatatccactagagggctccccataccaggcttctcacccagaaagcagaatgatattgcaggagacttcaaactggacttcattttcttttgccataagcccagggaaagcagtagggatatcccccaccataaatcccggaagccggtagtatacagaagaggttgagtgctacgagttgggaagacagcatgtgagtgatgtagatggatacagaggagcagaaagcagccaagagagtaagtgaagaaaggcaaagtggaggagagctctttctcgtcctttgaagaagactaaaaaggaacaatagcaaatagtattttctttgtgattcagatagtaataagactatattgctttaagcagatgcctctgtcttcataaatggcaaaggatcagagaaactgttttaaaatgttcataagaaagtctgaagtttaaatattttgaagctcattttaaaaaatcaagtcaggttcaacatttgcatgtgcagatgcaggtaaacagttaaattgcctttaatttataatttaggtatatacagatttttgattcatagattgtctaattattttttcctttcagacataggtaaatgagagaggaagagaagttatttagcctaatttctttatatgaacatatgtgctaagctgaggccatttctgctattatacacacatgacacaggagaccccataggcccatcctcactgttacagtaatctaaggaccattactatctaagtcctgacactggtcaggaagaaaaacagaaatgcccatggacaaaagatgaacaagaagtgaagaacaggcgccagagctcaaatcaatccaactcaggctattatttctggcattgatcagggtgaaggaaatggcagtaacagtaagattatgggacaggtttttctgagtcactccagagggaaagccacttgacacgttatgttactcttgaactaacccctgattccatctcactctacctgaccacagaccccaataccttagagtcctaaccaatgcctttcacccaccatccaccatatctagtggagggcagggctctcagagtcggccaagccagctggacggtcacgtctgttctttgtaggaacatgcggtccgttcttcaccatccctccaccttggacatatttccccaccaaccaaatagccagttacttcccactcaacatggctaggtcattccctatgacaacaaacaagcaatcaatcaaatccttgttgttgtttcctggaaaactgacagcaagaagataacccaattcattgtgaggccaatctaagccagaagaaagctcagaaaacccaagttctgttcatcaaggatgtcgaacaagctttgtggtacagaaaacagaaggctcagggattggagaaggaaagaggagggaattttggaattttaagtattttcttttgcattttaatactctctcatctgcaatattgccactggatgaggtagtaaggtataaaactaaatgggattcacagagacttaacagttatccactctcttgttaaatttcctcccactgtaaatcgattatattgagtattgattctcagccttggttacaaattgaaatcgcctgtggagctttaaaaagttcagattggtctggagtatagcctgggtgccagagttttaaaagctccttaggtgagtttaaggtgcagccaaggttgcggttatactggggtcttttctacagtcccatccttccctttttcttttctttaacatctctccagcatttcatgaagttctgctaacttcatgagccacagagtagctgtctgtatgctacagagccgcctccaatcccagttgatgctggtaccttcaattctaggtgaagattttgctgccctgtttgcctttgtgtgattggattaattcgaaagccttgtcttcaagctctttcttttattaatacttgttcagttctatttcccatgcattttgtatatctctaagtgtgtctttcatttccataagttgtgcttttaatttataatttctatttttctggagcatttttcatccatatgctgtattgtcttaaaaaattgctttaacttggttttcacctttctctggtatctccttgaatagcttaataatcaaccttctgggctgggtgtggtggctcacgcctataatcccagcactgtgggaggctgaggcaggtggatcacctgagctcaggcgttcaagaccagcctggccaatatggcaaaacccctcctctactaaaactacaaaaattagtgagacatggtggcacatgcctgtaatcccagcaactggggaggctgaggcaggagaatcacttgaacctgggagatggaggttgcagtgagccaagatcgtgccattgcactccagcctgggtgacagagcaagactccatctcaaaaataataataataataataatcaaccttctgaattctgtttgtccctttagaataaatgttcatttcaaagctccccgtacatctgcacaggctggcaacccagctctggcccttctcccggaaacaggtgcccacttagagaaactcctattttctaaggcctcctatctgacaaagaaaaaaataatcatagcaaagacttggaaccaacccaaatgtccaacaatgatagactggattaagaaaatgtggcacatatacaccatggaatactatgcagccataaaaaatgatgagttcatgtcctttgtagggacatggatgaagctggaaaccatcattctcagcaaactatcgcaaggacaaaaaaccaaacaccgcatgttctcactcataggtgggaactgaacaatgagaacacatggacacaggaaggggaacatcacacaccagggactgttgtggggtagggggagcggggagggatagaattaggagacatacctaatgctaaatgatgagttaataggtgcagcgcaccaacatggcacatgtatacatatgtaacaaacctgcacgttgtgcacatgtaccctaaaacttaaagtataataataaaaaaaaagaaaaaaataatcaaaagtatgaacaaagcctcctagaaatttgggattatctcaaatgaccaaaactaaaaataattagtgttcctgaggaagaagaggaatctaaaagtttggaaaacacatttgagggaataattgagaaaaatttccctggccttaccacagatctagacatcaaaatacaggaaactcaacaactgggaaattcatcacaaaaagatcatcatccaggcacatagtcatcatgttatctaaaatcaagacaaaggaaagaatcttatgagctgtgaggcaaaagcgtcaggtaacctagaaaggaaaccctaataggttaacagcagattgctcagcagaaaccctgcaaaacagaagggactggggtcctatctttagccatctcaaacaaaataatggtcagccaagaattttgtatccagcaaaattaagcttcataagtggaggggaaataaagtctttttcagacaaagaactgctgacagaattcaccacaactaagccagcactacaagaaatgataaaaggagttctaaatcttgaaagaaaacttcaaaatacaccaaattagaacctccttaaatctcacacagcctataaaataataacacaatttttaaaaaaaaagatattcaggcaacaactagcacaatgattaaaacagcacctcacatctcaatactaaaattgactgtaaatggcctaaatgctccacttaaaggatacagaatggcagaatggattaaaatccaccaaccaagtatctgctgtctctaagagactcacctaatgcataaggacacataaacttaaaaggggaggaaaaagatattccaagcaaatggaaaccaaaagtgagctagagtagctattcttatataagacaaaacagaccttaaaacaacaacggtttaaaaagaccaagagggacattatataataataaaaagatcagtccaacaggaaaatatcataatcctaaatatatatgcacataacacaagagctcctaagtttataaaccaattattactacacctaagaaatgagatagatggcaacacagtaatagtggggggacttcagtactccactgacagcactagacaggtcatcaagacggaatgtcaacaaagaaacaatggacttaaacaataccctagaacaaataaacttaacagatatttacagaacattccacccaacaactgcaaaatatacattcttttcatcagcacatggaacattcgccaagatagatcatttgataggccacaaaacaagtttcaatcaatttaagaaaatcgaaaatatatcaagtaccctctcagaccacagtggaataaaattagaaattaactctgaaaggaaccctcaaaactatacaaatacaaggaaattaagtcatctactcctcaatgatatttggtcaacaatgaaatcaagacagaaatttaaaaattctttgaactgaacaataatagtgacacaacttatcaaaagctcagtgacacagcaaaagtggtgctaagaggaaagttcatagcattaaatgcctacaccaaaaaaaaaaaaaaaaaaaaatctaaggttacacctcaaggaactagagaaacaagaataaaccaaacctaaatcagcagaggaaaagaaataaccaagatcagagcagaagtaaatgaaattgaagcaaaaaaaaaatatatatatatatatgtatatatatatatatatatatatatatatatatatatatatacacatatatatatatgaaacaaaaagctggttctttgaaaagataaacaaaattgatagaccattaatgagattaaccaagaaaagagaagagatccaaataaattcaattagaaaagacatgggagatattaaaactgagaccacagaaatacaaaagatcattcacacacacaaactagaaaatctagaggatatggataaattcctgtaaatatgcaaccctcctagattaaatcaggaagaaatagaaactctgaacagacgataacaagtagcaagattgaaacagtaatttttaaaaatgccaacaacagaaaaaaaaaaaaaagtccaggaccagacagattcacagctgaattctatcaggcattcaaagcattgatatcaatcttactgaaactattccaaaagacagagaaagggggaatgctccctaaatccttatataaagccagcatcaccttaataccaaaaccaggaaaggacataaaaaaaaaaagaaaactacagaccaatatccctgatgaacacggatgcaaaaatcctcaacaaaatactagttaactgaatcaaacagcatatcaaaaagataatccaccatgatcaagtgggttttatagcagggatgcagggatggtttaatatatgcaagtcaataaatgtgatatatcacataaacagaattaaaaacaaaaatcacatgattatctcaatagacacagaaatagcatttgacaagatccagcatccctttatgattaaaaacctcaacaaaatcagcataaaagggacaaacctcaaggcaataaaagccatctacgacaaacccacagccaacattatagtgattggggaaaagttgaaagcattcccccagataactggaaaaagacgaggatgcccactttcaccacatttattcgacatagtgctagaagtcctagccagagcaatcagacaagagaaagaaataaagggcatccaaatcagtaaaaaggaagtcaaactgttgctgtttgctgatatgatcatagacctggaaaaccctaaagcctaatccaaaaagtcctagaactggtaaatcaatttagcaaagtttcaggatacaaaattattgtacacaaatcagtagccctgctgtacaccaacaatgaccaagctgagaatcaaatcaagaactcaaccccttctaaaacagctgtaaaaaaaaaaaaatacttaggaatatacctaaccaaagacatgaaagatctctacaaggaaaacaaaacactgctgaaagaaatcacagatgacacaaacaaatggaaacacatctcatgctcatggatgggtagaatcaatattgtgaaaatgatcatactgccaaaagcaatctacaaatttagtgtaattcccatcaaaatacctattcacagaactagaatgaaacaatcctaaaattagtatggaaccaaaaaagagcccacatagccaaagcaagactaagcaaaaagaacaaatcttgaggcatcacattacctgactttgaactatactgcaaggctatagttaccaaaacagcatggtactggtataaaaacaggcatgtagaccaatgtaacagaatagggaacccagaaataaaacaaaatacagccaactgtcttcaacaaagcaaacaaaaacataaagtagaaaaggacatcctattcaacaaaaaatgctgggataattggcaagccacatgtagaagaataaagctggatcctcaactctcaccttctacaaaaatcaactcaagatgcatcaaagatttaaatctaagatatgaaaccataaaaattctagaagataacatcagaaaaacccttctagacattggcttaggaaaagagttcatgatcaagaacccaaaagcaaatgcaacataaacaaagataaatagatgggacctaattaaaccaaaaagcttctgcacagcaaaagaaacaataagcagagtaaacggacaacccacagagtgggagagaatttgtacaaactatgcattcaacaaaggactaatatccaaaatctgcaaggaaatcaagcaaataaatcagcaaggaaaaaaacaatcccatcaaaaagtgggcaaaggacatgaacaggcaattctcaaaagaagatatacaaatggccaacaaacatattaaaaaactgctcaacgtcactaattatcagagaaatgcaaatcaaaaccacgatgcaataataccaccttactcctccaaaatggccataacttaaaaataaaaaaaataatatgtgttggcatagatgtggtgaaaagggaacacttttacactgctggtggggatgtaaactgatacaatcactatggaaaacaccatggagactccttaaagaactagaagtagcacaacaatttgatccagcaatcccactactgggtatctaaccagaggaaaagaagtcattgtatgaaaaaggcacttgcacatgcatgtttatagcagcacaattcacaactgcaaaaatatggaaccagcctaaatgaccatcaaccaatgagtggacaaagaaaatgtggtatatatatatatgcacacacacacacatacacacacaccacggaatactactcagccgtaaaaaggaatgaaacaatgacattcacagcaacctggatagagctggagaccattattctaagtgaagtaactcaggaatggaaaacaaaaaaatcatatgctctcacttataagtgggggctagctatgagggcacaaaggcataagaatgatgtaatcaactttagggactcagaagggaagggtgggagtggggtgagggataaaagactacacattgagtatagtgtacactgctcaggtgatggatgcactaaaatctcagaaatcaccacgaaggaacttttgcatgcaaccaaacaccacctgttcccccaaaactattgaaataaaaatacagataaaaatgtatcaaatatgtaaatgtaaaaaacaaaactataaaatacctagaagaaaacaggagaaaatctttgtgacactggattaggcaaaggtctcttagatacaccaccaaaggcactattcatagagatttatatgaaatcatgttgtatgtccacttctttggcggtctccttcatataactattttgagtgacatccgtgttgttgctttttatcaacagttcattcctttttattactgagcagtatttcattacatttccgttttataaaaggaaaagctgacacattggacttcatcaaaatttaagaacctgttctgaagagacaagccacagatggagagaaaatattataaagtatatatctgatgacgtacttgtatacagaacttctgaagaactctcaaaacatacaaaccaataggaaaaaatgggcaaaagatttgaacacttcaccaaagattatatatatggatggcaaatatacgcatgaaaagacgttcaacattattagtcattaggaaaatgcaaatgaaaaccacaatgagatacctacacatctattaaaatagctaaaatttagaagattttgaccatgccaaatgctgatgaactggaactcttataaactgctggtaggaatgtaaaatgatacaaccactgtggaaaacagtaagttaaggttagagctcttttagaatttgtctggcaggcttggaaagccccaaaaaagaaaaaaaaaatgttaaggaaaacagtaaattaaatatacatctaccacatgacctagccatttcattcctacatattcacccaagaggaaaaaatatacagtctgcacaaagactcgtacataaatgttcaagcagatttgtgatagtcaaaaactagtaacaactcaaatgctcaatcaacaggtgaacacataaacaagagtggtatatccatacaatgaaatactgctcagtaataaaaaggaatgaactgttgataaaaagcaacaacatggatgtcagtcaaaatagttatatgggctggctgcagtggctcatgcctgtaatcccaacactttgggaagccgaggcgggaggatcatgaggtcgggagatcgagaccatcctggctaacacagtgaaaccccgtctctaccaaaaatacaaaaaattagccgggcatggtggcaggtgcctctagtcccagctactcgggaggctgaggcaggagaatggcgtgagcccaagaggcagagcttgcagtgagccaagatcacgccactgcactccagcctgggcgacagagcgagactccatctcgaaaaaaatatatatagttatatgaaggagacagacaaagaagtgcacatacaatatgatttcatataaatctctaaaaatgtgaacacatctatggtgacaaaaagcatatcagttgttgcctggggatgggagtggtatgggaagagagagggattacaaaaggcacaaagaaacttttgtaaatgacagagattattcattatcttgattgtggtgaagatttgacaggatatatatatagatgtcaaaatgtatcaaactatacacttcactggcatatatatatgccaaatttatcaaattgtatattttagatatgtggagtttactatatgtcaattacacctcaataaaactgctttaaaacaaagcataaccaacatcccaaatcaggatatttattagaccatctaaaccaagtttgtccaacccgcagcccacaggccacatacagcccaggacagctttgaatgtggcccaacacaaatttgtaaactttattaaaacattatgagacttttttgtgggttttttttttttttaagctcaacagctatcgtcagtgttagtgtattttatgtgtggcccaagacgtttcttcttccagtgtggcccagggaagcctaaagattggacacccctagaaacaaagtaaaatacaatatgtagagaagttgccaggaggttaaagatagtcactttgagaattcttgttacacctacctcagctgcttgctttattaacttgccttcattctcaggctttggaattgaactccagtctgctttctggctgggtgtggtctccaagctaactacagccttctccctaaatgattttgcaatcacaaagttaacaaatatcactatttcataattattggaaaatctgtattacagatttgtgatttttaagatggcttttggtttggagactgtagggaacatttccccccgtttgtttctgtgaacccattagctttcatacaaaagaattgctgtttgctggttttctgacaattgttcaaatgctaatgatagcaagaagcagttttgggggtttttattttttaatttgctaataatgtctttttaatgtttatcaaagtgatacttgcacatggtttccagtacataagaatttataatgaaatgcaaggagccttcctcctttcccttttcatcccagccctactgcccagaggcaaaccccttgaactctttcttccaataattagccccagatttctaagaaagcttgataagccacaacactgcaactgcaagtaatatgaatgaaatcagtatatttctcccttgaaacaaaatgttacaggagaggacagaaatgaaaggcaagaatatgctttcaagcatattaaattaaggtagtatagtagagtaaaatacttcgaagccaaaagatctaggtttgaatcctagctttcatgattgctgtcccaccttgagctagtaaattaatgtctgactctcagcttgattatctttaaaaatagagatgaaaatgtgtctcacagtggtcaagaaggtgaaaggacacagcacatgtaaacatctggtataccaccaactcagaaatgactttttctttaccttttcccatgctttaaactcttctccagaaaaaaatagtgtgtggggcagaggggacacccctcattttcagtagagctcctctccaaaatttcagcccctcggaattttttaaagcagcaatcatcatgttgttaatgaaagtgaattcaggaaatctgccaaaggccgactcattgttcactgattagtgagaccaaggacaatactgtaagcctcctgctaaagccattcatttctctggggtctagagaatggccttgtggctagaaacagctgcaacgcatgcctgtggccagcaggtcccaagcccagtaccatctgttatcacccaggatcacaccagccttccccttgctgggtaccggctggctggttcacacaaaaaccacctctgggtttgttttacagaactgcattccaagtcaattctccaaaagatttcttccacccaaagaccccaaccttacaatcttcttacccttgctggatgcttctgccctgttctaatgtgcccggcggaggctgcttggctgggagctggaccaacgctgcgaatcccacggattcttctaattcaaggggggaaatgctatttagacctgtgaaaggagagttcgagcaagcaccttgaccgctacggagagtgggctcagagctctagtctagcatcgtgcctggcccctggttaggcctcagaaaatcttgggatgaatggagagggttgtggaactaggtgctggagcgggttcagttcctctgccaaagagagactttgggattcctgggaacggaatcggggagaggatgaagaagggcgcctcgcctctatcctaagcccgatgggaggaacctctgccgagccagagccggtcttaacaccaccctccggagctgccaccactgcctcacttccatatgagatatagcgggaaggagggagtggctgcctggctcgctttgattagctttataacaagcggtcgttctgaaatactcgctcatgatggctaacagacaacacaatcgccaaatgtcttaagaaaaggagctttgagggtaaccgcccgctgggacctgaaggacaattgcggattgtccttcagccgcattcttggggctgacctgagtggggcacagctgaacgtctgagcgcaggcggctggtccttgggcccggtactggcggttcgcgaggcgggtttggggaggggtgggggaatcctagggaggcggagcgcgtactccccctcggcgcccgggctcaggcccatcccgcctctgcggcctcgccggcccccaggccttgcaggggactacgcccctggcgagttcccagtcggcgcggcccctggtcggcggagccgcggaagcttgggcactgggggcggctcggggaggaaccgcggaggggaaagcgccgcgggctgcaaacggcagaggcgcgcggggtggcgacagtggcgcgggcgcagtgagcgcgtccgagaacagaatgggacgaaacggggcgcttagaggcccgggaatctgtgggtcttttaggcggagaggggcgaaggaggttattcgttttggggaaggtcatggaaacagcaaaggctcagaggtggtgcctaaagtggctggagaagctgaacggtttggaacagaggcgtgacttggaggggtaaatggagaccagattaggaagccttgggaggcacaatcaggggttaaaatcttgaacaattcagagttgttttatttttaaaaatatatagaaaatgaaatctacacttacgtaatagataacttatgaaaaagtacatggaatacacatgttgcagtcttgccaatgtaccttaatgtagcagtttctccttgtctggactgatacccgggattctttgtcctactccaagaaaattaaggaacgggacataaggtgaggtgggagcgaaagtttaataagcgaaagaagaaagctctccacagtgagctgagtatgcaagtggattgccctgttacagctgaattcaaaagcttttgcaagaaaatctcttatctctgtagtagtttgagtaacttctcttatcagtaaagctgtcttacgcagctgtggttatgtatctatgcaagcacaaagcaccgccttttttgtttgcataactgtgggtttgttttaggtaagcccccctcctccctgtgaaagttcccaccatgtatatgcctgaaaaggggagaaaactttcctgggagctccctaattatacaaagaacaaaaggcttctgtgctggaccctgtctgcttatctgtgtgcaggtggagcctgagttttttaccaggttgttttatttttgcctgttgctgtgacttttcaggcaggccgcttctgcattgagtcttccccaactgattttctctttccttctctctcgcacacagttaggaaacataatgtaattactacccatgacaaaaccatcctacgtaagaaatggaacattcctagtacagatgctccccacctatggattccttccttatcccttctccctctgcacgcccaacgtctatcctgacctttgtgtctgtcataccctcactttttaaaatagttttttaaatcgcttctttgtatccctaatacatcactttgttttgcttctctgaaactttataaaaatggtgctatggtctgggtgtttgtgactccataaaattcatgtgctagaattctaacccccaaagtgatggtatcaggagatgggccctttggtcatgagtgggattcataagagcccttataaaggaggtcctgcagagctacctagccacttccaccatgtgagaacacagcagttgctgagaccagtccctcacaagacaggaatctgctggtgccttgatcttggacttcccagcctccagaactgtgagaaataaattgttgttgtttataagccacccagcgtatggtattttgttatagcagcccaaatggactaagacaaatggtatcatgctgttaagttctcttctgcaattttcttctttcaaagttgtttctataatacatacacagtgctgtatagtcctgtaattcattttcactgcagtaaaatattccactatgtggctataccacaatttattgacctagtgataaagccacttggtgatttgttggttcttttttttttttttttttttttcaatttggggttggaaacaattgagaagaacccaatttgtatcctggtgtatgcatgcagacatcacacaagatgtaatacctaggagtatatacaaatatccaactttacaataaaacactagaactatttccccaattggtggtcccaatttcacttctaccagcaatgggtaagatttattaatttacatcctcaccaacacttagtattgtcacacttcttgatttttccaggtgagtgaatgtaaaatagtatttcaccagcgttttaatttgcatttccctgatcactaataaagttgagacctttacatatatttatcacattccctctttttaaaagtgtctgttcatgtcctttgcccatttttctttggagttgtgttctttttgatttgtagagctctttgtatattcttgatactcatctttagtcagttatacttgtttacacacattttcttgcagttcatggcttgtcttttcactttcttcatgatgtcttctgacaagtagaattcatgtcttttcttttgtggtcagctccctatcttttcatgaagtctttcttgccctgaattcagaaaacattctcttatattttctttttttttttttttttttttttttttggagatggagtcttgctctgtcgcccaggctggagtgcagtggtgctatcttggctcactgcaagctctgcctcccgggttcacgccattctcctgcctcagcctcctgagtagctgggactacagacgcccaccaccatggccagctaattttctttttttttttttttttttttttgtatttttagtagagacagggtttcaccatgttaaccaggatggtctcgatctcctgacctcatgatctgcctgccttggcctcccaagtactgggattacaggcgtgagccaccgtgcctggccagatagtctcctatattttcttgaaaatgtttttaaattttgcctttttcgctaatccatttggaattgatttttgtatatgtgggaggcagggatccaacttcatttttcctcatatgaataactgtctcagcatcacttgttgatagtttccacttcttcatagatgaacaaggccacctctgtcctgcataatgctttgaaagagcaggaatactgttgactctattcagtatcactgataaatgtatctgtctttgtgctactatcatgtggttttaattgctacatctttatgataaatcttgatgtacaaatatctcaagatccctccttacttattcttcctcaggaacttctcaaccatgcttgagcttttgcctttcattataaattgcaaaactagtttgtcaagttgctcaaaataccctattggcattttgcttggaattacagtaaatcaataaatcagcttggcaattttggcatctttacaaaattgtttctttcagttaataatgtattctatctctctattgttaggttttaaaacctttcaatgaattcttctaatattcttcataaatatctaatcttagtatattgcattttccctctacttatttggaagtttacactgtattcttttacttattgcccttgaaattttaacatgtatgcttaagtctaaaattaatatcctaaacaatcctctgaaacaatgtaaggaccttggaacactttcactctaatctttcctacccatgctattttagtctgcccctttttaatccccaattcacattattattaccattattatattaggcagacattcttttagatttgcctatatgtttgccaccacctttgctcatcattccttcttgcatcacaaaccttctgtctgaggtcacctttcttcccaaaatacagatgggccttgaaggtcctatagtgaagttctattggtgattaactgctggttctcacggtgctgagatgaggacctcagtgcttcctgtgacaccatgtggaggagctgagatggagaagcagaaggacttctaattctggaaaggcctgttaaattaagcttagcctaaagctgcctccttacgtattttaagttcagcctaaaggtttctctgtacatagtgaaatgtaacttaactggatgtgtaaacagactataacctactcttgtgccagccaccgagttttagccaactgttcaaatcatgttcaaataaggcaaatgccaagctgtaacccgtccagctgttgctgtacctcacttgtttctgtatatcactttcctttttctgaccataaatcatcttcgacaatgcagtatcactggagtgtctctgaatctcctgtgattcgacaggttgcctgattcataaattatttgctcatttaaactatgttcaatttaatttgtctttcttttgacacgcccaaagggagacccaggtgcctctctggcggtggggggtgagagtcctcagtggcagagagtgttggaatgaaagaactttgcctgcacactgtctctatggagaccacatacacaaaggcccccagcacaagagaactacgcagagctggagggagtccatggactgtcccacggcacactagaatctatcacctctgtcccttctccatgctcccaactgcaaagggaggaagaggtggtgtctttgaggtagacatagtagcccctgtcatccttctattccagggtactgcagtgggagggagggtgcccaaaggagcaaaccgtgctccccacatccaggcccttagccatgcatctcacctgccattagtaggatatggaatcaaaagcttaacattaattatggcttttgttttgaatttctactttttactatggacattttcacatacatatgaaagtaagaaagaaaagaagtattctgtttgagaaatgcaagcctcctttaaattatcagacccaaagagacactggaatgagaagcagtcgtgtcccactgcccccttaagcttagtaatgatttcgaagctgcttgctaggcaggctccagactgagaacccacatagcctgccaccctctggattatacccatggcatctttttttgtggggggattgggggggatattcatcccttcaaggatttatccattgtgttacaaacaatccaattatattcttttatttttaaatgtataattaaattattgactatagtctccctgttgtgatatcaatactaggtcttattcattctatttttttgtacccattaacaattccccctccctcccacctccccactacccttcccagcatctggtaaacatccttctactctgtatctccatgagtttaattgttttgattttttaaatcccaccaataaacgagaacatgtgatgtttgtctctctgtgcccggcttatttcacttagcataatgacctccagttccatccatgttgttgccaatgagagaatctcattctttctcgtggctgaatattactcccttgtgtatatgtaccacagtttctttatccattcatctgctgagacactttgcttccgaatcttggctattgtgaacagtgctgcagtaaacatgggcatgcagatatctctctgatatactgacttcctttcttttgggcatatacctagcagtgggattgctggatcatatgacggctctatttttagtttttaggaaccgccaaactattctctatagtggttgtactaatttacatccccaccaacattgcacagcagttcccttttgtccacatcctccagcatttgttattgcctgtcttttggatacaagccatttaattgatatatcattgtaattttgatgtgcatttatccgatgatcagtgatgttgagcactttttcatttgcctgtttgccatttgtatgccttcttttgagaaaatgtctattcagatcatttgccttttttaaaatcaaattattagatttttttcctatagagttatttgagcttgttatatattctggttattcatcccttatcagataggtagtttgtatatgttttctcccattctgtgggttggcttgacactttgttgattgtttcctttgctgttcagaagattttaacttggtgtgatcccatttgtccatttttgctttggttttctatgcttgtgaggtattcctcaagaaacttttgccaagaccaacgtgaaagttaccccaatgttttcttgaagtagtttcatggtttgaggtcttagattgaagttgttaatccacttgatttgatttttatatatggcaagagataggaatcaagtttcattcttctgcatgtggatatccaattctcacaacaccatttattgaagagattgtcttttcatccaatatatgtgcttggcacctttgtcaaaaatgagttcactgtgggtgtatggatttgtttctgagttctgtattctgttccattggtctatctgtctttttatggcagtagcatgctgttttgattactgtaactctgtagtataattggtagtcaaataatgtgattcctccagttttgttccttttactcaggatagctttggctactcttgtgattccacacaaattttaggatttttttttcaatttctgtgaagaattacattggtattttgatagagattgcactgaatctgtagattgctttgggtagtatggacattttaacaatattgattcttccaatccatgaacatgaaatatctttccattttttgtgtgtcctcttcaacttctttcatcattgtttcacagtttcattgtagagatatttcacttctttggttaattcctaggtcttggattttatttgtggatattgtaaatgggattactttttaaacttctttttcagattgttcactgttgacacatagaaatactactgatctttgcatgttgattttgtatcctgcaacattactgagttggtttatcagttctaatagtttttcggtggactctttaggtttttccaaatataagatcatataatctacaaacaaggataattttacttcttccattccagtctggatgccctttatttccttctcttgtctaattgttctaacgagaacttccagttctatgttgaataacagtggtgacagtaggcatccttgtcatgtcccaaatcttagaggagaggctttcagattttccccactcagtatgatactagccatgccagctggtatctccctaggtcacatgccaccctaattgattggctgtatacccaacctggcactagaagttgcctaggaattgcagttcttgtgtcctagactgcctttcaagtttacctaggaccccagagcacttcaccctgtggtggctaggcttgccaagaaactcaagttctgaccactggctagggctggttcaaatgctccctccatgcctgagcgctggctgagcccagcatggctttattctctgctgtgacagagcagcactgagttccatgtaaaatccttcagtcaccatgctctccctccccagagtgcacagattctcttctctatggtgcatggccactgctagggggtggggtaggggtggtgtcagcaattcaagactgtctctcttgccttcctcaatgtctctttccacaatatgaagtgaaaaccaggtaccacagttgctcacctgatttttggtcctcgtgatgatgcttttctgtgtgcagatagttgataaaatctggtgttcctgtggtggggggcgggtggtataggcttctattccacatctcgctctgccccttctctgtttttcatgaaggacactagaatcttcccagtcatcaggttcaagatactggagtcactcatccatcccctttccctcgactcccttattcagctggctgtcaggttctgtcaattcttcttgcctagtatttctcctaaatatcctaccctctgttccagaatgatttgaaactgacctctagagaaagaggatccgtggaagagttttctagtgatctagaaggctatcagatagaagagggaggcagagatatagaccaaagtaggtgaaagtacacattagtccctcctctaggccccaagagttacacccattcagaagcagggattgtgaaagagcctgctggaacaaagaaggggacagagggggccacctcaagatccctgaccacaaattatttttcctaggctgttaattgataattgattaataatagttataattggggtattataattagtaaattataattttttattataattttaaatttatatataattttaaaattataatttactaattgtaatgccccaattataatctgtggccagttagaagaagagtatgggactagtttgtgcttgagccacaattccaggtctactgggataaattgaggagcagaggctggacaagagccataaatcatcagtggttatgaaaccacctttgcaaatttatgatggtgagaaaattatgacagggaaagagatctgatccaactaacatccatcttgctcttgacctccaaactgcccttgatcattcctgagtttaggccaagctaactttgggagacatttatgtaaaaagtaaagtagaggttcctcttcaaagactttcctccccatctaattagaaataaatagtaacttctcttagaagcaaaatttattcaaagacctgtgctaacattcttaaatatctgctagccgtaatagagaaatcaatgtactttatgttcttagctcccacaatttagcctaaatatttgccctggcatgcttatactggtccaagcaagcattaggttatagcctgttcctcttccttatttgaaggtatttttacctttctcagcattccgcaagttacttcctccttcctttgttctcctctgcctttgcctctcttaaaaagctctaagttgctagccaatcgggacaactacagaatatgaggtcccgttccagccagtggaaaccggacacagcagtagggtgaacacatcaggttataaatgaccctgtctcctttgttgagtgtactcttatggcaaaactgctggcgagtgtaccctttctgcagaaagtataaaaatggccttgctgagaaaattaaatttattttcaagtgctatttcattatggtactggggaacaaacatttcaaacatttagtttatagtttaaatgataatagcccttccctaaaactaacccacctttgtaaagctaatgaaaggccaccaggttaggaggatgagaggagcctagattctgccaaggtgtagaggtaaacaattaccagccattattccagagatcataagatttgcaactcccccaattactcctgcagataatatcatgattgtagaacctcagattgacaatttgagatgtattttcaggtttttgcatttctgacaatcaaccgatggctccacctggacctgccaaccccgccaagcagtcgtggacccagaagcagactccctggcctgccaaactatccttacaaaaccctagcctccaacttttcaggaagattgatttgagtaataactccatttaccacgtggcacggctggcctcaatgattaaactctattgcaatgctgtggtctcagtgaattggttttgtctgtgcaatgggcaggaagaacccatggggcggttacagttacattcattcattccataaatatatttgaatactcactctgtgtcaggcactttgctcaatactgagggtataggaataagtctgccatcatgaaacatagtcagggagtacagcgaatggggagaaaaattaaacagttcttcaaatatacaacgagtgatggtaggcattgtaagggaaaaatggagtagggagctgagctggccgtggggatgcaccccaaccaccttgcacatgtgttctcaggacctcctgagggctgtcatgggccatggtcactcatatttggctcagaataaatctcttcaaatattttagagttcgactcttttcatcaacaggtgggaatagatgatcccctgccaggtttggggagaaaggtgtgaggactaaactctgatttttttatcttgcccaaattcctgaggggtctggggagtcatgccctacaaatcataaattctcatcagatgggttttatttaaccctatatattgtgactgactttccaacctagctctggcataacattaggagacaaggaaaaaaatcaaaatattttaccccaaaacatgtttctttgccatattttgaaatgaccctgcaaagttgttctttgtgggggaaaatgtgcaactgtaaagaatctctgttaacatagctaggtttttttcttccagaccctcctaatctcctaaagagattaactgagacctgaataggaaacatttgtcatccattgtctctaagggcagccacgatcagacttcaaaagaactttggtctccacaatctttatcttaatctgaactttccctttctatgaattccaggtctttagacaaactcaaccaattgtcaaccagaaaatgtttaaattcacctacagcctggaagccccctgcccccctccttcctgctttgagttgtcccacctttctggaccaaacaacctatgtatatctttttttcttttcgttttttttttttttttttttgagatggatggagttttgctctgtcacctaggctgaagtgcagttgtgtgatctcagtttactgcaacttctgcctcctgggttcaagtgattcttgtgcctcagcctcctgagtggctgggatcacaggtgtgcaccactatgcctggctaatttttttgtatttttagtagagatgggggttacaccatgttggccaggctggtctcaaactcctgacctcaagtgatccacccacctcggcctcccaaagtgctgggattacaggcgtgagccactatgcccaaccccaaacctatgtatttcttcaatgtatttgattgaggtctcttgcctctctaaaatgtataaaaccaggctgcaccccaaccaccttgcacatgtgttctcaggacctcctgagggctgtcatgggccgtggtcactcatatttggctcagaataaatctcttcaaatattttagagttcgactcttttcgtcaacaggtgggaatagatgatgccctgccagtgtcagggtcaccctaggccgttggccccctgaggtcaccagcactttcctggatttctctcacaagttctccctcattctggctcaggaagagagactgcttctctcacccctaaacactcacagacactgaggccctttcttatcctggagcaagcagaagctcttgacaagcccaataaagtcaaaaagcagttacctaaaaagagaaaggaaatgcaccatcctcttcctgcagctgcctccccggaacaggcctcatcagccctacctctggctgtggcaatagccttggggtttcaggaagataacagttacagctactccactcttaggggctgaattgggtcctttcaaaaagcctgtgttgaagccccagacccttagaatgtgactgtatctgtaggcaaggcattttaagaggtgattaaggtaaaatgaagtcatgtggttgggccctcatccaatatgactggagtcctcataagatgagaagattaagacacaaacgcagagacctggggaaggtggctatctgcaagccaaagagagaggcctcagaagaaaccaaaccctctgacatattgatcttggacttctggcctccagaacagtaagaaaataagtttctgttgttcaagccacctggtctgtgggttttgttatggcagtgaggactaaactctgacgtttttcttctcttgcctaaattcctatttaaggggcctggggagtcacaacctacaaaccataaaatctcaacagaggggttttgtttaaccttacataatgtggctcactttccatactgactctgacataacatcacatgacggataagaaggaaatcaaatattttaccaccaaatatgtttctttgccatattttaaaatggcctgcagagccattctcgtgggggggaaattgcatttgtaaaaaatctctgctaacataactagatctttcccccttccaggccctcccaagcctgaagaaattaattgagtctagcacctttttggggtctgaatagaaaacatttgccatctattgtctctaagggtggccacccttgaggcttcatctacataatgagaaccctggtctccacaacctcttatcttgacccggacactcccttctattgattccaggcctttagataataacttaactctttcaaccaatagccaatcagaaagtcttggagtccccctatgacctgtaacccccaccccgactccctctttgagttatgccacctttcgaacctgaaccaatcataaaacctggctgcagcccaaccaccttaggcacatgttctcaggacctcttggaactgtgccttaggccttggtcactcatatttgcttcagaataaacgtctttaaatattttacagagtttgactttttttatccacagcagcccaagcaagctaacgtatcctccttcctcatttcacccaggaaggaagtgaggctggatggggaaagcacaccattgacctcaagccgcaagatctgcactggttccggggctgggactaggacccagatctgattccagtgcagcgtcccatgtccagacccattcaacttggaaaccaaaagtaaaattctaggccccacaaccaactgaacggacccctcctctcagccaaaggcattccaaagttaacctgagaaacagttcagactgtgatgggaagtgggggttggatatgccttattatgccctctccccctttgaaattcaggcacaactgaccagcattaacattaaaacaaaaatctgaagactgactaaacagactcattgtagcaataagacaccaagttctatcctggctctagtatagcatcacatgacagagggccctgaaagaaattaaaccattttaccccaaaatattaatatacatatttgacatattttgaaatggccctgcaaacctcactcttgtggggaaaatctgctctgcaaagcatccccttccctttccaagtcttttccctgatccaggcatctttttaggtctgataagagctctgatgcctgcttcctggaggcttcatctgcatgataaaaccttggtctccacaccccttaacttaacccagacactcccttctactgagtccaggtctgtaggtacttacttaactctttcaaccaataaccaatcaggaagtctttgaatccacctatgacctggaagcccacctcttcgagttgtgccacctttctggaccaaaccaatgtacatatcacatgtattgcttgatgtctcatgtctccctaaaatgtataaaaccaaaatctagctcaataaccttgagcacacgttctcaggatctcctggggctgtgtcacaggccattggtcactcatatttgggtcagaataaatctcttcaactatttcagaatttgactcttttcttcaagaaactggcccctccacccttagcttcctctcactgtgtatacagagcacccttcctgagcacgtctgattgaatttctccaaataagcaccttcagtaacccagctccacctactcggcaacatctgaacaaactcagctccgcacccaaagcccttctagttccatcctaagtcaatgcttctcaaactttaaagtgcatcagaatcacctggaggggctgttaaaatgcagattcctggccccagcttccagagagtgctcctcagttggtctggggtggggaccccaaacttgcatttttaacaagtttccaggtgaggctgatgctggtggcttgtggaccacagcttaggtagcactggctaagataccttatcccaggacccttcatgcactctccctccatccagggagctgcttactctgccctcagcaccccatgcgcttgagcctttgcccagcctggtcctggtccaggaattccctgctgccaagtctgatgcaatgggtcagatcctggaacctcctaactcaggataaagttgagaggttgtgctgctttttaaagggaaagccttattgggatttgaaccagaactggaaggactgtagtaaaatgcagatatttgggcccacccccagatacaggcctcgctgtgggacatgctgctatggtcactttctccatgtacagatgaacaaagggtggcccagagataggaagtgactttcccaagggcacacagcacattagacgagaggctgaagaggaagtcaagtttcaagtctccctcctgcgcagttctgtgcttcttgtgctgccttttccaagcttaaggggctctgctttttccccttccctcattctactttcttgtgaccccagctgggccccagcatttccagctgatgctgaaatggagcctcagggggctgtaaaacttggaaaaggaagaagagtagaggaaggggcaagaaaatgagaggaagagagccaggcgtggtggctcatgcctgtaatcccagcactttgggaggccaaggcgggcggatcacgaggtcaggatatcgagaccatcctggccaacatggtgaaactcagtctttactaacaatacaaaaattagccgggcgtggtggcacatgcctgtagtcccagagaggatgaggcaggagaattgcttgaacccaggaggcggaggctgcagtgagctgagatcgcgccactgcgctgcagcctggcaagagagcaagactccatctcaaaaaaaaaaaaaaaaaaagaaaatgaggggaagagataaaaccctttgtggtgaagggaggaaggaatgggaagtcacccaaggctgtccagggagctgggggtggggctgtttctggaacctaagcacacgtaccacctccccttcctctgacctaatgagggctcgagttggaaaccacaaaccctcgttggccccacaggagccagcctctggcttctctctgcaatggccatgtgctgcagacccggagtgggtagttagttggttaatgccagtcttcctcccctggacactgagttctgctgacagcccccgcccagccagagctctgctgtataccaccgggagtggggctggtgtggagcctggaggtcgcccgctgccctcctagggctgctccagacagcattaaaacgctgcaggtcgcaggtgagactaacagctgggagagctgctccaggcatttaggaccctgactggggcagatgagtcagcccagtgggggcagggctcctggaacgaggatctacagttggagttgccccactgtcatgtcacctggagaaaaactggacccaattcctgacagcttcattctgcaaccaccagtcttccacccggtgagttgtcactctaatgtggaacctcctcggtctctgggctcttcccttccaactgggcccacactcctgggtggtggggtggaaaggacctcagtctttctgcttctcccagcacctgccctgggttctggaaggccctcctgagcttagtaaagtggctgactgctaattcccacttgggtgtaaatgactgctaggcttccagggtcactgcattttgaaagtggcgaagcctggagccacagtgctctgcccctactgtaatggatgctaggaggatgagggtgtgggggtaggattgttgggggaatgctgattacttagtaaggacagtctcatccccagcctggaaggaagggtcaggtgggaatttccactcagggataggggttgggggtgtttctctctttctcctccagctcagtcagtgcccaagaggttttctgaagccaggcaatgatttacagaaggctgaattcccagcagacaccccctactaatgagcattaattatcactttcccttacttggccctcccctcccatgagagctgcatccactcagttaattacaggcctggagggagcctgggaatgggaagtgatcaactgctgaaccaaccagctgagcttgccaagctggcatcccaagcctccctcccatgcttctcaggtgcctgaggaatgggctgaagcagctgcccaggttacggcagctccttgctttagaggctgagagctcgcacctggagggccatcctggtggttttcagttttttctaggtggtttgggttcctaaaggttgttgggagttagagagcaacacaggaaggccaatcctgtgataccactggtatgtacctgccatcctgctcacattcattccaaacacatctatgcagagccctcacggcgtcaggtgaggcactgagcctacaggagggaaagagaaggcttcagttttgaggggcttataaactagggaaaaaagccaaccagtcgctctaagccaagggccaagccagccacatgagcaaaatgccctgggagctcaggggaagaaaggaataatccaaggaacccaagtggatgatgcttggaaagagtcagggtggaaagagacaggaggaacagcccagaaaaggcaggaagttgtaaaactgtatgatgtattttaggaaggccaggcaacttctttttttttttttttttttttttttttgagaccaagtcttgctttttcgcccaggctgaagtacagtggcatgatctcagctcactgcaacctcctccatctcccaggctcaagcaattctcctgcctcagcctcctgagtagctgggattagaggtgcatgccaccacacccagctaatttttgtatttttagtagagatagggtttcaccatgttggccaagctggtctcgaactcctgacctcaagttgatccacccgcctcagcttcccagagtgctgagattacaggcatgagccacagagcccagcccaggtaacttctacatggggaaaggtgagcctgggaaggccattgttaagtgcctctccaggggtccatttcagagttagctgtcagttcctaacttgtccattcttcttgcctcccagttcctagtctccagccactcaacagtcctcagaaagccccagtaccaggcttctggggaccagggtgacatctagtggatggcaagcctccctggggtcactgcagcctgttgtgtcctaggagctggggaaaggcaactggctggtgctgaatttggcaagggagcggaatttgacttctctggtgtaatgcagctttgccgtgtgacggtccaggaaaggggattaggtggaagaaaatatttcagtgaacactgatttttacctataaggaattttctgtttggagaggaaaagttgagttttattctgctcctttcctcccactcgcctgacatagaggtccctaagccctttctccaaacctgcatggatgagtttcttttcttgttcaggtggttccttatgtcacgacgatttttggaggcctgcatgcaggcaagatggtcatgctgcaaggagtggtccctctagatgcacacaggtaaggcgggggaggtggcccagggggtgctggagctcagccctagaggcatcgagctggagggctcctccctgccactgagatctctgtgggtctctggtcagaaccgcactttgagagcctcacctcccagtaggtttcaggtggacttccagtgtggctgcagcctgtgtccccggccagatatcgccttccacttcaaccctcgcttccataccaccaagccccatgtcatctgcaacaccctgcatggtggacgctggcaaagggaggcccggtggccccacctggccctgcgaagaggctccagcttcctcatcctctttctcttcgggaatgaggaagtgaaggtgaaggaagggacgggcattgggtggtctagaatttgtgtccttgcgcccttccttccctcagccagactccccacgacacaatgttgagtggcattggtagtggtcaggtaccaagaggaccaaggagctgccatgcccggttccaggctgccctgggcccacatggcagcaagaaagctctacagtgcctggctccaaagagggcactcctgccatagtcatggcaagcacttagagagaacctactgtataccaggaactgttctaagcccttaaaagtatctgctcattgaatgctcacaataaccccattaggtaggtaccttcattatccccatcttacagccacagtggcaggggagagggacagagaacttgatctcaaggtttagacccctaatgtgagctcctgccagaaacatgatgggatcttcagacatctccaggagacagggcagctggcgggagggtagcctcttgagcctcagtttcctcacgtaaatggagcaaagatgactctttgggctgctgagaaagcacaatgaggggcctctgttggggtagagggagcgttgaaggtgccttagtctccaggccagctctgcaacctttggaagattacttaagccgcccaaggctctgtaaaatgtacctacctcatagagatgacgtgaagttaagtgaggcaaaattgaggaaaaagtgcttggcaatgcctgggacattgttatgaactcaatgaacattagctgctgataagccagcctctgtctgtctctccaggtgagtgtgaatggacagcactttctccacttccgctaccggctcccactgtctcatgtggacacgctgggtatatttggtgacatcctggtagaggctgttggattcctgaacatcaatgtaagtttccttgggaccaaggcctgggcagtggcagcctctaatttcccctgactcctggacgggcctgggaccccttcctccaccctagactgagagagaggacgccctgtgcaccagtaatagccaagggggagggagtccactgaggtttcgggtgtgagtgggctgagggggaagagaaagtgatggcagaaagggtgtccaggagccgcaggcaggagtctgtaaccagtgtgggtctggttaacactgagaagcaatggccaggaatgatttggcacactgggggccgaaacgggtggcagctggctttatcattcccacctgatgggcttattaaagcccagatttctggggcttgccaccagagattctgattcagtaagtccaaggtggggcctaggaattgggatgttcaaaatgccagcaagaagctaccactgaccagccgaatgggaacatgaggagctgtaaaggccagggctctgcccacctcccaggcataggtaggggattgcagtggtcctaaatgctgctgattcttttctctctttctgaacagccatttgtggagggcagcagagagtacccagctggacatgtgagtttcttggcagcaaggtctgagcagccacaccagctgacccgcccttctggactgctgctcccattacacaaggcccagctgccccttccctcactgctgcggttgccacggacatggctggctctgcttcagtctctggagggcctggattttcctctcccagcccctctccaggcccagcttgggaagatgaatgggggtgggctgcatgcagagggggcaagaccccgtattcctagcaggagaggccttagttgaaatgctcatttctcaaaccacctctgcaaggtggctggggttggtcttgcgggacagaaggggagatgaggcccatgtactgcccaaggccacacagggagtggatgacaaatcctccaccccgttcttccctattattccagcgctggtgaacctctgaagtccagaggatcccactggggctccaatgactcacctactgctgtgagagagacaagccccaaatattcccaatttgttagaataacaagagtttcccttttcctgagcaaataccacatggccttgtgtcctctctttctttccctgacagcctttcctgctgatgagccccaggctggtgagtgaacctccctcctgctctgtcagggctgggggcgcagcctgggtgagcagctaatgagctcagcctggtaggacatgcccccagcctcaggatttccccttcctttatagaaaactgcaggctgtgggtgggccaggcagcttatgcccccagccgcatgatttccccttcctttatagcaagctgcaggctgtgggtgggctgggcagcttcaggctgaagctccagcttcattttaccttttctccacttattgtgaacatcattacttgatacttctctgtgccaggcccggtgccaggctctaggatagaggaacaagctggtcccagccgtccagttgctcacaggctggtgggggacagaccactagatggcaattacagttaaggatgcagtgaagggagaaggacatggtggtcgggacacagagaggccaagctcagcctggacaggccggggaaagtgttcggcaataacagagtacaggaggccaggtgcttaacaaataagcagcgtgtcctggcggcaggcctgggcagaacatgcctgccccagtgctcccctggcccccggggatgggcggtcctccccagtccccctggaagtcaacttctcaatacctcccttgttccttcaggaggtgccctgctcacatgctcttccccagggtctctcgcctgggcaggtcatcatagtacggggactggtcttgcaagagccgaagcagtaagtatccagcatctaagtggaggggagggagcagcctctctgtgacagtcacatgctataaaacatcatctcttttaatctcctagcaccaccatttaatccccattttacagatgaggaaacagaggagcagaaaggagaagtggcccaatttggcagagcttatgaaggtcaggctgggactgggaccgacagccccactgctgggagcatcattcctgctggtacatctagtcaggcctagcctcttgtcccaggtcctaggaaaggggccccaggaaaggcccttcgtaggtgcaggctgaggcccagagcaaacatgtagcttcctatggtaacacaatgtgtggttcaaaagatacagccagactgccccagagaagagggctggtatttggaagccaggacttggagggacccagtgactaagtggacattaccaaacttctcctacatggtgctttcaaacccagacctgtggctccaatccagttagacaggagccactggccggcctgccttgaggaaacgcattagagtttatgacttctctgggccagaatgcctgggttggcatgtgctcaggacacctacttgtgcaaccttaggacagatacttttcctctctgtgcctctgttttcctctctgtaagaaggggatgataggccgggcgcggtggctcacacctataatcccagcactttgggaggccgaggcgggtggatcacgaggtcaggagttggagaccagcctgaccaacatggtgaaatcctgactctactgaaaatagaaaaattagccgggcatggtggcgcatgcctgtaatcccagctactcaggaggctgaggcaggagaatcgcttatacccgggaggcagaggttgcagtgatccgagatcgcgccactgcactccagcctgggcaatagagcaagactccatctcaaaaaaaaaaaaaaaagatagagggggttgataataatgccgactttaggggtggtacttagaatagtgcctggtacatggtaagtgtccacaaatgtgggtactactgcaatcatctcagtggaggtaggggagggcagagtaaggaaagcaccctatgttctccttgcttaattttgtttttatttttaagtcactgacctcactaaacccttgccctgcacactgccgatcatgcctgtgaattctgggacaggcatgaagcccagcactcgatggcctcggcctccaaagacaggcatgactgagttggattcctggttttgtctcttataaacagtgcggtcgtgggccagtcactaaacctctctgagtctgagtttccctaccggaaaaaggtgaatgataattccaacctgctagggaaaatgaaaagtgctcagtgatggaacacttcttcccacaaaacttggaggcatgagaccgggttcatattgtagctcaaagtcacaaggttactagtgacatagtcagcaagtaactgctgtttcccaagggccatgaatgcatgtgtcctcagaggccagacaggtctcataaatagtgaggaaaccagttgggaaggtggtaaaggggaaggagtatctccatacacccagtcatgccagatcttctgactatttttaaagcaaaaatagaagccatcttttatataaactctctcaatttttgaatattatattaaagttgaagaatactatggaccagacaaaacattcctatacaccagttcagccgagatccaccaacatgaagatttagcacagcacctggtatttagcgaggctgcaaccaatgcagctgctgctattttgtgaaagcaactgatggcttgaatggggcagagagagtaagagatggagggcacaggattcatctgcagtgaaaatctatccctccttcttcacctcatcccttccctcctcgttattgagtgggagtgtatgactgcagcctcaaagagcttcaacagagcttcactgggcatctggtgatttgtgattattcagtgatctagtgggcatctagtgattcatgattatccagtgatctggcgggctgagctgcatgaaggtgaggtagggagacactgaggcctcctcaccaggagttcgcaggccagaggaagacacagtgttgtctggcaggacggggtagggggagccatagtggggctggaggctccacgcagtccactctccagggttcctgccttccaagcttcttcccaacattgggccctggccacctccttcccaaagttggaaacttacggggcctcctcctgtaaggatctaccaatagcccttgaaaggcctgtccagggcggccttttcccctaccttacctgcctctgcatcccatcaggatgccgcgccttctccagcatagctcttcaagaaggaaacttgggaagttcccaagacataaaaataatctgggccgggcgcggtggctcaagcctgtaatcccagcactttgggaggccaaggtgggcagatcacaaggtcaagagatcgagaccaccctggccaacatagtgaaaccccatctctactaaaaatacaaaaattagctgggcggtgcgggcatgcgcctgtagtcccagctactccggaggctgaggcaggagaactgcttgaacctgggaggaagaggttgcagtgagccgagatcgtgccactgcactccagcttggtgacagagcaagactctgtctcaaaaaaataaaataaaataaagaaaaataatataatccggttgccctatttgagaggcaggtgccagatccccccacccccaaatctagagtcatgaatcctagttcacatcctaacctaaggccctaccactattactagtaacagagaagtcatttaacttcttgtcctcatcacttaaatgggctgacaaacctcacagcacagaatttgtgaggattaaggaaaggcaaactagcttctgtaaaacacctactgtgtgctaggaattgctagttttcacatacattatctcctttgttcctttttttttttggctctatgaggtagagattgtattatatagcaatatttttaaacaataggtatcatctgaatgcttattacgttccaggtgctattctaaataagcatttttttatgtattcatttaattcttacaacaatgccacaggcaggtacagggcagttatgttatcgtcacattacagatgaggaaactgaggcacagagagattaagagtcttgcccaaggtcacaggactagaaagtagcagagccagggttgaatcgggactgcctgactctaaccactatgctgtttggaaaacatttaagataatacctggcacttagttagcattcaataaatgttagctgtagctatcatcatcataatcatccccattttcaggaggagaaactgaagctcaggctaggcaattttcacacacttccctcccacccccatcctcctgtagtcatagatggcaaccctggaggtcaatctcaagttcatctagaactcgtgttctttccactgttctgagcattcagccatgaggctgtcataggccctcagtgcttgtttctggaggctgaagcagctcaaccttccatccactccctgacctccatccttcccctgggggctgagcagcggcctatgggcaatgggcgctgattccttctccttcctcctgcttcctgcagttttactgtgagcctgagggaccaggctgcccatgctcctgtgacactcagggcctccttcgcagacagaactctggcctggatctcccgctgggggcagaagaaactgatctcagcccccttcctcttttacccccagagattctttgaggtaggtcagagccaaatgattacatcccttcaggctggagcacagagctgaagtcccataatgacctgggagatgctggggcaggtgtgcaggacagatgttatggggtgggaggccagagccagcagagcacagcgaatgtctgtacagcagtcctcaacgctccactctgatgccagggatcccatggccagaaactcaattgatgcaggtgggggggggcccaggcatcagctttattaaaaagctcccctaatgattccgacgtgcagaaccactcctctacaggaagcagccccagttacaggtggtgaaactgaggcccaaggctgggaagatccttgtcaaagaccacagtgggctggtgacaagccgggccccttatcctgttcttttccagcactgtactgggtgccccctgggtccagtcttcgtgtcctatgagaggaggagggtctcactggagagagcgtcaggcagacaagggaaagtctggctggaagctgcaaccccctcatgtcctcctttcccaggtgctgctcctgttccaggagggagggctgaagctggcgctcaatgggcaggggctgggggccaccagcatgaaccagcaggccctggagcagctgcgggagctccggatcagtggaagtgtccagctctactgtgtccactcctgaggatggttccagggaaataccgccagaaaacaagaaggtcagcccactcccagggccccactctcctcccctcattaaaccatccacctgacaccagcacatcaggcctggttcacctctggggtcacgagactgagtctacaggagctttgggcctgagggaaggcacaagagtgcaaaggttcctcgaactctgcaccttcctccaccaggagcctgggatatggctccatctgccttcagggcctggactgcactcacagaggcaagtgttgtagactaacaaagatactccaaaatacaatggcttaaagaatgtggtcatttattctttattatttatttatttgtggtcaaataaataaataaggttatttatttatttcgttctcatctagcaattctagagacaatggtccagcttagcagggcagctctgctccctggagacattcagggtctgtcctagccattgttccaccacccccagggcatcatcattgtctctgtggcccaagctcagctgccaccctatcttggcctcacccactgagaaggctagtagtggcagtggacaagacccacctgatatcataagccccagacatgggtccgacacacaccagctacagtcacatttcatctgcaggcactcagtctcggtcacactacctgcaagggaggctggaaatgttcttcagtgggacacataagaccagccacatgaaatagagtagtcataaaataacagaatagttttattctattactataaaaaacagggagaatggattttggtggatagccacagtctctgagacaagtagatgctgttaatatcctcattttataacataagaaactgacgcacagaaaggctaatttgccaagatcacacagtgagtaagtcatgggattagaacccagggattctgtctgcagagtttgcggctcttaaccataaaccattatctagagtacacaggcacactagagcttccagataaagatggacatcggagctggaggcttgagaggaatcaaagaaccttgcaagtcgaaaagtacagacaagacaaacgaaggaccaccaccaaggaaagagcaagattaaatgagaaataatttaagaattatatataactgtatataatatataccatatatacatatatatagcatagtatacattatacagtaatatatgtgccatggtctgaatgtttgtgtcctcccaactaaaatttatatgttgaaatcctagcacccaaggaaatggtgtttggaggtggggactttggagggtgattaggtcatgaaggtggagccttcatgaatgggattagtgcccttataaaagagactccaggccgggcgaggtggctcacgcctgtaatcccagcactttgggaggccaaggcaggcagatcacctgaagtcaggagttcgacaccagcctggccaacatggcaaaaccccgtttctactaaaaacacaaaaattagctgcgcatggtggcacacgcccgtaatcccagctactcaggaggctgaggcaggagaatcgcttgaacccgggaggcagagattgcattgagccaacatcataccactgcactccagcctgtgtgacagagccagactctgtctcaaaaaaaaaatatatatatataaataaaataaaagagactccagagagctccctcacccctaccaccatgtgagattacagcaagaaaacaggcgtttatgaaatgggaagcaggccttcaccagaaacaaaatctgccagtgctttgctcttgaattttccagcctccagaactgtcaacaataaatttgttgtttataagttacccagtctaacacattttaaagctggacctctaccattcaccatgtacaaaagttaacacaagatggattaaagatttaaagtaagaccttgaactataagaatcctagaagaaaacctaggaaacaccattctggaccctgatcttggaaaagaatttgtgactaagtcctcagaagcaatggcaacaaaaacaaaaattggcaagtgggacctaattaaagagcttctgggcagcaaaagaaactatccacagaataaacagacaccacacagaatgagagaaaaatagtatattcacaaagtgtacatcccacaaaggtctaatatcctgaatctataaggagcttaacaagaaaaaaccccatccaaaagtggacaaaaggcatgatagacaggtctcaaaagaagacatacaagtggccaataaacacatgaaaaaatgctcatcatcactaatcgtcagagaaatgcaactcaaaaccacaagaggatatcatctcataccagtcaggatgtttattattaaaaggtcaaaaacagcagatgctggtgagcctgcagagaaaagaaaatgcttatgcactgttggtgggaatgtacattagttcagtcactgtgagaagcactttggagatttctcaaagaacttaaaacagaactaccatttgatccagcaatcccattactgggtatacatccaaaagaaaatcattctaccaaaaagacacttggacttgcattttttttttttttttgagacggtgtcttgctctgtcacccaggctggagtgcagtggcacgatcttggctcactgcaagctccacctcccaggttcacgccattctcctgcctcagcctcccgagtagctgggactacaggcatccaccaccatgcccggctaattttttgtatttttttttttttagtagaacagggtttcaccatgttagccaggatggtcttgatctcctgacctcgtgatccgcccacctcggcctcccaaagtgctgggattacaggcgtgagccaccatgcccagccggacttgtatgttaattgcagcactattcacaatagcaaagacatggaatcaacctaggtgcctgtcaacagaggattggatgaagaaaatgtggtgcatatacaccatggattactacacagtcataaaaaagaatgaaactatgtcctttgcagcaacatagatgcagctggaggccattatccttagtgaattaacagaagaacagaaaaccaaataccatatattctcacttataagtaggagctaaacattgggtggtcatggacaaagagatggcaatagactctggggactactagactggagggagaaaagaaggaaggaatgggagaaagggttgaaaaaccattgggtattatgctcactacctgagtgacgggataattcacaccccaaacctcagctttacacaatatacaaacctgcacaggtactctctgaatctaaaataaaagttgaaattattttttaaaagaagataaacctcaatttccacaaatgttttataggatatttttattaaaatgtattctgtgtatagatttttaggggcacagaggagcttgcatctctacattgcttcttcccaatcatatatacagtatatccctcaatttattttggtcatcctttatttccttctgtcactgggaaaccaagttctttccttactttgtattgatagccaagaaagaatatccaattggaaaaaaaggcaagcagattttattgctggtcaggaacggaggagtgagctctttttctaaagaaccccttccgaaggtgatggaatccagggaactttaaggaattagatgtggggcggggaggtatgtatgtaagcatgtacagggaggaactccagatgtgcagttacagatcataaacatgcttcttcatatgaggtatgttcagaaaatggcagcaattttcttctaggggtggggatttgatatggtttggctatgtccccacccaaatctcatcttgaattcccatgtgttgtgggagggacgcagtgggaggtaattgaatcatgggggcaagcctttcccaggctgttctcgtgataatgaataagtctcctgagatctgatggttttaaaaagaggagtccccccctttttttaaaaaagtttttaaacttctatttgcatatttttgaaaattttgcattccaatacttaaaatcatttgaacaaaaaaaaaatggcactctgattaaacagtattacaggctgcatgacaccttgggccagcttggttttactctagatttcattgttgtcccaccccactttttccaccccacttcttccttcaccaacatgcacgttctttccttttctgccagccagaaagtcagatgggagtggcaggcttggccttcattgtcagtagttctttggtgtgaaaggggcagcagagtcatttaaacttgatccaacctctatgcatcttacaaagttaaacagctaaaataagtaaaataagaaagcaatgcttgtggaatgtacagtgcatattggcagcacatgcctcattacgattcaccagcttgcttctcctgttcaatcatttctttggaaggcagtggatttttctcttgcacttctgtcttcttcagtttcgacttatctctttgcctctgccatccatgtaagatgtgacttgttcctctttgccttccaccatgattgtgaggcttccccagccatgtggaactattagtccaattaaacctctttattttgtaaattgcctagtctcagatatgtctttatcagctgcgtggcctaatacaggactttagcattataatgatacgttaatgatctgaaggtaacaaggcatcaccagctcagtttgctggggtcttgctctgaccttatcttcctctagtaattgccaaagagtcctgaggctccagcagcctcctgggccatctgaagttctcttaagcaaacatacctgtaggtaaaatgatttaaaaacctgtttaaggaagaacaatgagctttcttagttatctactgtttaagaaaataacaagctttctcagctatgtctccagggttgctctggtaacataagatgtgtgtgtttgtttttactggggcatcgcacaacttttgttagatttatacttaggcactttatagctttgtgtgtgatttgtaaatgctatctttttaaaaaattgtacttacttgatactggtacaaaaatgcacctgatttatgtatattaatctcgttcctagcaaacttgctaaaattatatatattttattagttcaaatagacaatcttgccctggcacagtggcttacacctgtaatcccagcgcttggggaggccgaggcaggtggatcgcttgaggtcaggagtttgaaaccagccttgccaacatggcgaaactccgtctctactaaaaatacaaaaaattagctgggcatggtggcacatgcctgtaatcctgcctactcaggaagctgaggcacaaaaatctgttgaacccaggaggcagaggttgcagtgagccgagatcacaccactgcactccaggctgggggacagagcaagactctgtctcaataaataaacaaacaaacagataggtaatcttaccacttgcaaaaaataatgatttctgatttcttcctttccaatctccctctccctctctgtctctcactcttccccccactcccaaccacattccctcgcttccttcctctctccctcatgcttcctttattatatgacattggccaagaattcttgcacactgttgagtagcagtgtggttagcaggcatccttgacctgttcctgaccacagggaaatgcaattaagatttcactattaaatatgatgattatcataggttgggaatagatactatttttagggtaaagagattttcattttttcttagtttgttaagatacactttcatttttttcatgagtgagtgtcaagtctgtcttctgcgtttactgatatgatcatattttttctaatctgttaatgaggtaaattacattaataggctttctaatttcatgctataagtatctttaaattccttaaattcctggagtaaatgaatttttaatgaatacattgctgcatttcatttactgatactactgttcttgcattaagttcataaattagcttataattttacttatccatccatcaatactatcatagccttagattctggattgtctcttttctgtgcaaggtcatcaattgtttatatgtactctaggtctttaatccatagattccatcttcctttctttttttcttacattttattgttggggataaaactgataacttttccttatagagcttctcagagtctgaattctgctggttaatccctagggcattgtttaaaatactccactgtctcctgtacttcttttcatctagagttttgatcagattcagtttcaatttttcagcaagaaaaccaaaactactatcttattccctaaatgtttcttttttaatttaatttaattttatttatatatattttcttgagagagtctcaactctgtcacccaggctggaatgcagtggcgcaatctcagctcactgcagcctccacctcccaggttcaagtgattcttatgcctcagcctcctgagtagctggaattacaggtgtgctccaccactcctggctaatttttgtatttttagtagagatgaggtatcgctatgttagccaggctggtctcaaactcctgacctcaagtgatccacctgcctcaggctcccacagtgctaagattccagtcatgagccaccatgcccagctaaatatttctttttttatagcctcctgttcttgtttcctgaatatattttctcttctctcttccatgatataaattatagggagccgaagacccgtgggatgtgaccaactcagcattccactggaggctatatgatcaaacagcaaactgtttatcataaatgcaggatgtgagcaaactcacgactgctcctgccgacacaatgtttgctgagggcaatcgcttcctggcaccaagttccttgaggttatctactgggagatctagggaatgcagtcttgcaagcctactctgacccctttttccaccccccttttcactatctcttttgcctaataaatatggagggctgtgtaaagctcagcgcccttgtccactagaggcaagttgcccccgaccccttcttcctaatatactcttttgtctcttgtcttttattccacgttcgacccccccaccctttcttcagtccccctaggtccatacggtttacatagtggcaccccgaacagcaacagaatcgggtgctcaacaataaatgatgcttttgtaaattttcttctgcttgccatattttctttgttttcttgaagcttatttgttagttatttgtgtattttgctgtctatctttcaaattagaggatttcctcaaatgcctggcaatccttagttgtttgtgtttttgttgtttttgtttgtttgtttgagatggagtctcgctctgtcactcaggctagagtgcagtggcatgatctcagctcactgcaacctctgcctcctgggttcaagcaattctcctgcttcagcctcctgggtagctgggaatacaggcacatgccatcaagccaggctaatttttgtatttttgcaagagatgggttttcaccatgttgcccaggctggtcttgaactcctgacctcaggtgatctgcctgcctcagcctcccaaagtgctgggattacaggtgtgagccactgcacccagccaagtggtttgtttatattcaagagtgaggcactaaaatgctaattggaagctttgtgtacatgggttgggcttattgacttatatgactcctcacagtgaaacaggtcaatggtcaatggtctcattgtctgaagtgttatctgagttcattgtctcatgaccaagaaaattaaggagcatggctccaaagggtgaggttgaagtaaaagtttaataagcgaaagaagaaagctctccatagtgaagaggggagccagagtgggttgccattttacagttgaatgcaaaagctcttataagaaactcctctcatttctcatgtcacctggcacatttggaccatgcaagagggcttacaaaaaaaatcaaacttaattgatgtagaacaaattccatcccatacagaatataggtctatagtttttaattttcacaaagaaaagataaccagctcatcagaacatactattggtactggtttagcaaaggttcatacttctaaggtcaaggctgatattgaaacaaaaagatgtgttcttacctggagaagccacatgagccacaagggccatgtgtactacatgggtacaaggaggagctggtaccattccttctgaaactattccaatcaatagaaaaagaggaaatcctccctaattcattttatgaggccagcatcatcctgataccaaagcctggccaagaaacaacaaaaagaaaattttagaccaatatccctgatggacatcgatgcaaaaatcctcaataaaatactggcaaaccaaatccagcaacacatcaaaaagcttatccaccatgatcaagtgggcttcatccctgggatgcaaggctggttcaacatatgcaaatcaataaatgtaatccagcatataaacagaaccaaagacaaaaaccacatgattatctcaatagatgcagaagaggcctttgacaaaattcaacaaccttcatgctaaaaattctcaataaattaggtattgatgggacgtatctcaaaataataagagctatctatgacaaacgcatggccaatatcatcctgaatgggcaaaaactggaagcattccctttgaaaactggcacaagacagggatgccctctctcaccactcctattcaacatagcgttggaagttctggccagggcaattaggcaggagaaggaaataaagtgcattcaattaggaaaagaggaagtcaaattgtccatgtttgcagatgacatgattgtatatctagaaaaccccatcgtctcagcccaaaatctccttaagctgataagcaacttcagcaaagtctcaggatacaaaatcaatgtacaaaaatcacaagcattcttatacaccaataacagacacacagagagccaaatcatgagtgaactcccattcacaattgcttcaaagtgaataaaatacctaggaatccaacttacaagggatgtgaaggacctcttcaaggagaactacaaaccactgctcaatgaaataaaagaggatacaaacaaatggaagaacattccatgctcatgggtaggaagaatcaatatcgtgaaaatggccatacggcccaaggtaatttatagattcaatgccatccccatcatgctaccaatgactttcttcacagaattggaaaaaactactttaaagttcatacggaaccaaaaaggagcccacatcgccaagtcaatcctaagccaaaagaacaaagccggaggcatcatgctacctgacttcaaactatactacaagactacagtaaccaaaacagcatggtactggtaccaaaacagagatatagatcaatggaacagaacagagccctcagaaataatgccacgtatctacaactatctgatctttgacaaacctgacaaaaacaagcaatggggaaaggattccctatttaataaatggtgctgggaaaactggctagccatatgtagaaagctgaaactggatcccttccttacaccttatacaaaaattaattcaagatagagtaaagacttacatgttagacctaaaaccataaaaaccctagaagaaaacctaggcaataccattcaggacataggcatgggcaaggacttcatgtctaaaacaccaaaagcaatggcaacaaaagccaaaattgacaaatgggatctaattaaactaaagagcttctgcacagaaaaagaaactaccatcagagtgaacaggcaacctacaaaatgggagaaaattttcacaacctactcatctgacaaagggctaatatccagaatctacaatgaactcaaacaaatttacaagaaaaaaacaaacaatcccatcaaaaagtgggcaaaggatatgaacagacacttctcaaaagaagacatgtatgcagccaaaaaacacatgaaaaaatgctcatcatcactggccatcacagaaatgcaaatcaaaaccacaatgagataccatctcacaccagttagaatggcgatcattaaaaagtcaggtgctggactgactaatcattaaaacaacaggtgctggagaggatgtggagaaataggaacacttttacactgttggtgagactgcaaactagttcaaccattgtggaagtcagtgtggcgattcctcagggatgtagaactagaaataccatttgacccagccatcccattactgggtatatacccaaaggattataaatcatgctgctataaagacacatgcacatgtatgtttattgcggcactattcacaatagcaaagacttggaaccaacccaaatgtccaacaatgatagactggattaagaaaatgtggcacatatacaccatggaatactatgcagccataaaaaatgaagagttcatgtcctttgtagggacatggatgaaaccggaaaccatcattctcagcaaactattgcaaggacaaaaaaccaaacaccgcatgttctcactcataggtgggaattgaacaatgagaacacatggacacaggaaggggaacatcacactctggggactgctgtggggtggggagaaggggggagggatagcattaggagatatacctaatgctaagtgatgagttaatgggtgcagcacaccaacatggcacatgtatacatatgtaacaaacctgcactttgtgcacatgtaccctaaaacttaaagtataataataataaaataaaaagaaaaaaaaattagccaagcattgtggcacacgcctgtaatcctagctactcaggaggctgaggcaggagaatggcttgaacccaggagacagaggttgcagtgagccgagatcacaccattgatgggacagagtgagactgtctcaaaaacagaaaaaaaaatgtgcatccagtaatgtgatcataccctccctctttcccctccaacccacttaccctctttaaatttaggagctctcaaaatcacctttggaaaacagtatggaccacagattgttcctgtggattttatgatccttttctctgtccatgtccttaactttggcaaaaataaacttttaaattgagtgagacctgtctcagatactttttggtttacagtcatgagtcaataataaacagaaggaaaaacccaaatgacctataaatgtataaaataatacgcaggccaggtgcagtggctcatgcctgtaatcccaggccaggtgcagtggctcatgcctgtaatctggatacacaggatggagcacccagagaggccatggaacctctgcaccccttcctgcatgtcttaccccatgcatctctttgtttgtatcctttaaaatagcctttgtaataaactggtaagtgaaggggtgggttgcccctccacacctgtgggtgtttctcgtaaggtggaatgagagacttaggaaagaaaaagaaacagagacaaagtatagagaaagaaataagggggcccggggaaccagcgttcagcatatggaggatcccgccagcctctgagttcccttagtatttattgatcattcctgggtgtttctccgagagggggatgtgtcagggtcacaagacaattgtggggagagggtcagcagacaaacacgtgaacaaacgtctttgcatcatagacaaggtaaaggattaagtgctgtgcttttagatatgcatacacataaacatctcaatgctttacaaagcagtactgctgcccgcatgtcccacctccagccctaaggcggtttttccctatctcagtagatagaacgtacaatcaggttttataccgagacattccattgcccagggacgggcaggaaacagatgccttcctcttgtctcaactgcaagaggcatgccttcctcttatactaatcctcctcagcacagaccctttacgggtgtcgggctgggggacggtcaggtctttcccttcccacgaggccatatttcagactatcacatggggagaaaccttggacaatacctggctttcctaggcagaggtccctgcggccttccgcagtttttgtgtccctgggtacttgagattagggagtggtgatgactcttaaggagcgtgctgccttcaagcatctgtttaacaaagcacatcttgcaccgcccttaatccattcaactctgagttgacacagcacatgtttcagagagcacggggttgggggtaaggttatagattaacagaatctcaaggcagaagaatttttcttagtacagaacaaaatggagtctcctatgtctacttctttctacacagacacagtaacaatctgatctctcttgcttttccccacaggtaagtgtaagtaagtgtttgcctgagttctgtgagctgccctagcaaattaaccaaacccaatgaggaggtcctgggaaccccagtttatacacagctaatcagaaacacaagtaaaacaacctgaagctggcaattcacatcagaagttggggagaatcttgtgcaactgagccctcaacctgtgggatctgacattatctccaattagtgtcaaaattgaacagaatgagaggacacacagctgatgtctgctgcagaattgatgaatgagtagttggtggggacaaatcacacatttcttggtgagcagaggtcacagaagacgttttgttgattattgttgaatgagagaatagaaaaagcacgttgttttttttcatgcgcgtccgtgtgaagagaccaccaaacaggttttgtgtgagcaataaagcttttaatcacctgggtgcaggcgagctgagtccgaaaagagagtcagcaaagggagataggggtggggccgttttataagatttgggtaggtaaaggaaaattacagtcaaagggagtttgttctctggcaggcaggagtgggggttgcaaggtgctcagttggggaggtttttgagccaggatgaggccaggaaaacgactttcacaaggtaatgtcatcacttaaggtaaggaccggccattttcacttcttttgtggtggaatgtcatcagttaaggtggggcagggcatattcacttcttttgtgattcttcagttacttcaggccatctgggcatatacgtgcaagtcagaggggatgcaatgccttggcttgggctcagaggcctgacattttttattcctacagtctcagaggaatatagctaaaaatgtgtttacagagaagtttatagtattagcttatattagaaaagaagatatgtctcaaatcaatgatctaagcttttacctcaaggaagtaggggagccaggttttcagcaattggccagaaaagaaaaaaaaagaagggggaggaagcatatgaaaaccaaaacaagcaaagaaagaaaatgtaataaagatagaagaagtaataaataaagtagaaaaagaaaaaaatcaatcagtctaaagctggttctttgagaagatcaataaaattgataaacctctagcccagggggtcagcagagacccaagtaataaatatgttaggcctcgcatgccaggaggccacacaatctgccactgtagcacaaaagcagccatagacaatacaaaaataaatgagaatagctgtattcatgggtcttgtaagacaggcagtgggcccagtttggactggtttggatctgtgtcccatgccaaatctgtgtcccatgtttgggccccacattgtaggggtgggttgcccctacacacctgtgggtgtttctcataaggtgggacgagagatttggaaaagaaaaagacacagagacaaagtatagagaaagaaataagggggcccggggaaccagcgtttagcatatggaggatccccccagcctctgagttcccttagtatttattcatcatctgtgggtgtttctcaaagagggggatgtgtcagggtcacaagacaattgtggggagagggtcagcagacaaacacgtgaacaaaggtctttgcatcatagacaatgtaaaggattaagtgctgtgcttttagatatgcatacacataaacatctcaatgctttacaaagcagtattgctgcccgcaggtcccacctccagccctaaggcggtttttccctatctcagtagatggagcatacaatcgggttttataccgagacattccattgcccagggacgggcaggagacagatgccttcctcttgtctcaactgcaagaggcattccttcctcttttactaatcctcctcagcacagaccctttacaggtgtcgggctgggggacggtcaggtctttcccttcccacgaggccatatttcagactatcacatggggagaaaccttggacaatacctggctttcctaggcagaagtccctgcggccttccgcagtttttgtgtccctgggtacttgagattagggagtggtgatgactcttaaggagcgtgctgccttcaagcatctgtttaacaaagcacatcttgcaccgcccttaatccattcaactctgagttgacacagcacatgtttcagagagcacggggttgggggtaaggttatagattaacagaatctcaaggcagaagaatttttcttagtacataacaaaatggagtctcctatgtctacttcttcctacacagacacagtaacaatctgatctctcttgcttttccccacaccacattggagcttagcccatgaaagaattcaaggatgagcctatggtgagagaaggcaacttttttgaaccagtactgctccttgcagagcaggactaacccataggcagcgggctgagttggcaacatatgggctgttggcagctgtacttatacccacttttaattatatgctaattaagagacgggttattcagaactttctggaaaagggtggagagtttccagaaccatctaaggtaacttccaggccattaccatggcctattgcaatggtatttgtaaactgtcatggcactggtgggagtgtcttatgctaatgagcagtgagggcaaatagaggtcacttccatcaccctctgctagttttggctggcttcttcactgcatactgttctgaccacatcctgctccaatcaacatgatcaacagggctgcaacgagaaagcaagtcctgccagcctcctacctcgctactatagtaggttagtggagggggaacatttccttgtcccaaattccagccagagtctttctcaacatctaaatactgaatgctgccatggcttcaaataaatttgcaatgaaaaaacatatttttaaatggctttctattttgctgcaggaaaggaaaacaaaatctcgggacccaaactcactaagccaaagggaaaattcaagctaggaattgggtcacccaaacctgcctcccattttgttcctaaatagatagctacaaaaataaaaagctatataactccctaacaatttgctcacaagggaattctttgtgagccccaagatcttcaccctaaaacagttctgctgaatgacaccctgatgatgtaaattgacagcttatcatcacaggtatgggagaaaggacagaactataagtcatccctccattcacctgagacaaatgcatatttgactgcttatataaaaatccagattcactaagcatgaaatgaatgcataattaactattcctctaccccctcctttcacatgtaaaatgcagattcagtgaatgctgatcaaagactcaaaggaatgcaaccacttgcctcttttatctaccctccctttttttcccttttctctttcccctaatgcccacacttttccctttaaataatgatgtccccagacgcactttggaaaaagcacgaatcacagatgtttcctatggttttctgttccttttttcctggatgtgtcctaaaccttagctaaataaatctctaaatttttgactgaaagctgtctcaaatattttttgggttacagcagctattgcatctagatatacaatataaattaatgtaaaatatcatatgcttgtaatttcatacatgctagagatatcatcccaatcagggaaagctgcaagaagaaagtgttggtggtaaagcacaacttcctagatttttgctgtcagtgggctggttggaatttaaactctttgagtattaaaaacaaatcagtcttcataactgattatttctgctattattgttacctattggagcctctaggaaaaaaagaggcaatagagaaagagaggcagtctccgttgctaatgtgctcttgtgggattagatgtctgatcctttggagcagaccatccatcctgatgtgggtcagtttggactccaagtctgacaaagcagaacaggcttcagaaagccttgtttgtcacttggaatacagccgtcactcctgcagcatctaagctttggtgctgctgaagaaaggccactggctgttttggagtcctgcattcacagaccccagctgcctggaactgactctaagctaaaacctgacactatctaccacaagctgtttcaacctcagcacaagctgcaatgaactggaagtgtaagcagacagcaagggtttccagggattataggaatttaatcaactcagcaatcagccttttacagcctaccatcctgtagcctgtttcttcctaaaccttgcatagaatgcagtcatgtggttggttaaaaccagctcctaacagatcccagcaacctacagatgaatctgagtgaactttcctcattaccatgctaaagtctccaccccggaggagctacagcttcattaccatagcatgcaacctatgtgttggcacgatgactcactgcatctgtgcaactgggacccctcctctgcatgtgccgatgcaccctctcccctctccatcacccataaaaccctcctgtcacttttcgtagggaagactgctttggagaatcctcacagtgtcctccttacttgtgccaagtaataaaactgctattgatccacacctgtgttctcatgaaaagttgtttgttactaaacgaatgatccccgttttttttcgagtaacagaagtgggcatgtatggtttcttctgatagcaaccaaatacatgtcatttgtccacatcaatcagtcctgcaattctccaacactgaccgcatgttcaacaatccgactcaattccgacgctaactatccagagttaggctcagcctccacaggtaaagtctccaggctcagcaacaaatggagttccctggctactcacatttctacctggctgactacaaatggtggagaccccctaaatcccctttaaatttgataattccctagaacaacttccaaaatttagaaaactgctttacttatgattgtcagtttattataaaggatacaactcagcaacagctacatggaagaaactaagaagaaactaatatggggggcagtgattgtgcacagcttccattgttaaagaaaaaattatctaatgatacaagcttgatatccactgcactgggattttgcagcaagagagagagatggggctcaaacttgaacacagcacgggcaagtgggaattcataggcaaggagaagcatacaggtcagtggatgcaaaattacaaagaggaaacctcaggggcaagagagattctggttaaaccacactaacaggattcttgctgaagacaggccggggtgatcagacatcacctggaggacagtgagaaggatgaacccggtcagatattgagggtgggaagttcctgctaaactgacttggcagggtcctttgctaaaattagattttacaaggaagtacagatgtgcctaggaagaggtttgggaacctgactaaaatgtggtcacacagagaatctttgccaccatgccctctccagccaggccagtctcccaccacatctgtgttcacctgccccaaagctctcccaaccccgtcatgtaggggtttctacggaggctgcataatgtagacattactgattaaataatggtgatcagtccccaacctgaagttatccagctctccctcctcaaccaagagccacctcattagcataaactcagatttgtttgacagagactccttctgaataacatgacatcctatcactcaggaaattccaagggtcttaggacctctgtgtctggaactggggtcaaagaccaaaaatatatttttttatcatgccacataaggcataaataaacttttattatgctacaaggcataaatttatttaaaaataaaaatttttattatgccacaaggcaaaaacccagactctgggattgttgaatgcagactcttgtgggggcccccttaaagagttttgtgatcctaaatatttcaaaatggagtcacttacgacaagtgactcagcccacagtgaaactgctgaaccctcaaaatgataaacataggtataaaggactgaggtaataagataacatctgctgtggccagacacccccaagacctgatgagaaactgaaaccaaaaggtggctgagataatgaccatggacactcctgcagagggccataaaaacagcaaagaaactgaccacggcaagacacctgtagaagctctgcccgagaaagctctgaggcttcctcatgatatccacagcggtccctggaagctctgcccaaacacagcaacatcgttcaacagtgttttgagtgaaacccagaggcatgctaacctaaacaacagaaatgggggttttttgttttgttttgctttgagacatggtttcactccagttgcccaggctagactgcagtggagcaatctcagctgactgcagcctgacttctgggttcaggcgatcctcccatctccgcctcccaagtagctgagagtacaggcacatgccaccatgcccggctaatttttttttctgtatttttagcagagacggggtctcgccatgttggccaggctggtcttgaactcgtgggctcaagtgatccacctgtctaggcctctggttgggtgtgaaaatatggcccagttctggccaatggagaagggaacaggtcatctggggaactgtgggaaagacttaactccctgaaaaaaagacaaatgagaattatctttccctccatcttttgggcatagccaggtaaaaatgggccactcaaggctgctacagccatgggagtccctgcagggcaacagtgcagacccaggaccagtgcaatggagacagcctgctgagtccttggtgaccttggtgagccactaaacccaacctgagtcaccctcttcctgcctttctgttaccgagacaatgggtgtccaggctgttgaagcccttttgagtttagttctgcttcttgcacccaaatgcattttaatggggccatgagctcccaggctccacatggtctaaggtacccctcacctccagggcatccccatggaatgaaacaccccctctggccttctcccaagacttctggcccaatattttctgggtgtctttacaagacaatgtcctatggggtgcactggggattgacatctccctgcctccgaatgcctccccttcctggagtaggaagagctgcccagggttctttttagaagagacctttattttggccaggtgcggtggctcacacctgtaatcccagcattttgggagaccgacggggaggcagatcacaaggtcaagagatcgagaccatcctggccaacatggtgaaaccccgtctctactaaatatggaaaaatgagccaggcatggcagcaggtgcctgtaatcccagctacctgggaggctgaggcaggagaatcacttgaacccgggaggcagaggttgcaatgagccgagatcgcaccattgcactccagtctgggtgacaagagcgaaactctgtctcaaaaaaacaaacaaacaaacaaacaaacaaacaaaaaagaaaaaaaaagaaaagacctttatttctcaagcaagggcagaaattcagggctccccttcgactctggctgctcccaaggtggctttaaagcaccaatgagtccatggcttgtgtaagaaatgattagtccttccatctagagaaatagctcctttttaaacagttgtctcttttaaacagtgtttagtatttaagtgaggttgaaacagtgtcaaaaggaaagtgaaagtgaaattctctccttcagcataaaagctgatccacaaacaagaggagcaccagacctcctcttggcttcgagatggcttcggtaagtttcccagggctttgcattactgactctacagcagttgggcagctccccctaggaaaggcctcagtccaggctcctggccttgggcacacagctccagagctcgtctttagaaggctgtcatggaaaactgtatttgtcttttaaaagtgcatctgcccagctggacagggagtcctctgggcagagtccacctcctctgcgtaactggcacagtgcggggagcccgggactcccatgtagtagagagctgtggggtgccgggtgtcaaatctacctcagcctgaggagaagccagagtgtgggcaggtgggggactctgggttgtgggaagcaagcaaatcccaacatcgtctgcttctgctgtgactggggctcagtcccttctcggccccaaacgatgctttctctctcctcgttcctctgtggcatcatccagccttctaaggtgcattctaatctcagcagctttctgaaaactgaaatttctcctcctatcagcccagatgtaccgattggcagaagctctagggagagcaggctgagctcggtggtgtgtgactaaaaaggaacagcggggctcaggctattactagaaacaaaaccattccgggaaggagtcctgcaaattctggagggcagcccactccaacagcaccacctgatcctggggaagggctttactgctgccaaaacaaatcagggcttttaacagggagcccaggccaaagctcatatctcactggccaccagctgaggttgccagtaccttgactgtggttttagacattcagcattgcagttaaaagcccctctctctccccacatggaaaccatctcctgtggtgccctgacatacagaggaggagctgggagggagtcctggccctgctcctttctcctccctcttccttgtctatttccttgccccattctacgccaggcccttcactgggtcctggaggtgcagggagggaggagcacacaggatcctgcctgcctggagctcacagcccagaggggcacagggaggcacagggaattgcagctcaacttgacccctgcagagagcagcagaggcccccggggacccaggtcctaggagtggggtggcgggtcagctgagccaggctggggccatcagggcagcttctcaggtgagggggtttgagggaggggaagaggaagagtggctgcagggaagtgatggaggcagggagaaccagatgtgcagagcagcagagaccagagccagggcagtagtgaggggctgggatgtcactcagtgggcctgtgggtgcagagcccagggagggagaggagggtgaggaagggccagtcaggaagggcctgggagctgcccacagggtgtgtcctgggccctgaggtcagaggacggtcatggccagatgtgcccttgggaaggccaccatgggttctgaggagttggatatggagtggcagggacaggaggcaggggctggtcagggggttgtgggggtcacagaggcaggcatggggctgcctgaaccaagtcagtggatgggatattgacaagcacaccaacaaggagaagcttccggagtccacattgattggttttagtgactggatattggcatgaggaagagggcaaaggagagcagaccccaggtctatgatgggacatcctgggatgagggaggaggaggctgtcacccactgaggacagggacagagagggtgaaaatggaaaaatcctccagtcatgaggctgctatgccctggggcaggacatggagaagtgggaaggaggtgaggaaggggaagaaggtggccaagacaggaaccagggtgaggggtgtgcagggaagaaccagctcggcctccttccagctgagtgttctcaggaaagccctgccacctctctgatcctcagtttccccatctgtgcaatgggatgatcatgccttcccctggggctgtggagatggtgcagttattgtaggacaagttcccacagaggcctgttctgtgagtgcagagccccctcagtgctgggagctggggggccccacaagaccccactcaggtcccagcaggatgctgtgagctcctgtctcccagggtgtcatctccaagagataggtgtcctgaggctggatggggcaaggtctgaggaggaggtggctcttggggccatggagaggcacagggcaggagtgatgaggaactgagggtcagtctgcagagggcggagagctcaagactcaccttcccagccttgctcctggcctcagtgaaggtgctggttcatgcaggctcttgagtcggcctactgaggagcatgtgtacaatgcacacatgcacacacatctgcatcctcagcatgcacacacacagcacacacatgtcacacatgcgcccagacggtccttctgtctcccatcccacaagatcattctccaggcttccagcccccagtgcccccactgagaagagcctctgaaagtgacagcagggctgaggatctcatggggctagcagctgatgaacatcagcaaggcgtctccaggatgagctgcagctcccccagccagggtctctgctgttgcctagaaggccgggtactccatctctggcttttctgttgcagccacaccaagagcccaaacctggagacctgattgagattttccgccttggctatgagcactgggccctgtatataggagatggctacgtgatccatctggctcctccaagtaaggactgatgaatatataattttcaaaatatttgttaaaaggataatgagagggccgggcacggtggctcatgcctgtaatcccagcactttgagaggccgaggtgggcagattacctgaggtcaggagttcaagaccagactgaccaacatggagaaaccccatctctactaaaaatacaaaattagccaggtgtggtggcacacacctgtaatcccagctactcaggaggctgaggcaggagaatcacttgatccccggaggcagaggttgcagtgagccgagatcgtgccattgcactctagcctgggcaacaagagcaaaacttgatctcaaaaaataaaaaaataagtcaatgagagccactgaaagacagttaagcaagggaaacttgagttaggagacacattcttcttagaggatgcttgatgagattgcacacacatatgtcccatgaagtagacacagtgcattccataggtcctggcagaacggaagaagagaccgttgcctcccgcagcgaagctgggctgcttcagcattgggatctctccagctcaaagtcagttaccttggcatgcagaatctcatacgacttaaaccagccaggtttcttaggtcttaaagaagaaagtttctcaaaaggaacaatgtttctccgtgccagatcctttgcctcatatgttttcacacaacaaggtgtcttgatattatatacttaagattccttactgggagcaattctcacaggtttatacatttttttaaaattctcatacaaatacacagtaagcaataccaatgttttatttaactcattaataacagaagcagaaatatgacatacccagttaaaagcagaatgaaggaaacgtatgtatggatagccaatgaaaggggaaaaaacgaacacagaggccaggcacagtggctcactcctataatcccagcactttgggaggccaaggcggacggatcacttgaggtcaggagttcaagacgagcctggccaacatggtgaaaccccgtctctattaaaaatacaaaaattagctgggggtggtggcaggcatctgtaatcccagctactcaggaggctgaggcaggagaattgcttgaacctgggagacggaggttgcagtgagccgagatcctgagacagtgccactgcactccagcctaggagacagaggaagacattgtctcaaaaaacaacaacaaaaatgcagaaatgagacaatgagactgccaaattaggtaggtgcaggcaagttcatatcctctagggcagtgccactacataacttctcatgttctcttttcaccaagcatttacattgtcactggacaaaaaccattcccatcactatcagggcaagacatttgcatcttatcagttttctccaagccatcatctcccaggcaggattgtaaaaatgtctgaattgatggaaaatagtaaatcaagcccacttaatccagatgatcctcagggaccttgtaagacaaagcatggcaatgaagacacatggtcctttttgtgcctaacttgcagtgtgtaaagaggctttttttttttttttaagacagagtcttgctctgtcaccgggatggagtacagtggtgcaatctcagctcactgcaacctccgcctcccagtttcaagcgattcccctgcatcagcctcccgaatagctgaggctacaggcgcatgccaccacagccagctagttttttgtattttagtagacatggggtttcaccatgttggccaggatagtctcgatctcctgacctcgtgatccaccagcctcggcctcccaaagtgctgggattacaggcatgagccaccgcgctcagccgtaaagaggctttttaaagacaatttttctctctttcctttttttttttttttttcctctgagacagtgtcttactctgccatccaggctggtgtacagtgatgtgattacagctcactgcagtcttttttttttttttgcataaacattctgatttaataaatggtatgaatatatattttgcatactttacaataaagaaaattttgaaagaaaattgatctaaaactgtttccctccaatttccatggtaaagtcaactgcatacagttctttccatgtataagttttacatttgtattttctacaattaaataaatctaaatgttaaattttagcacatatatccaattatgtacaaaattacaatgtcaatttataagtcaagcttacttaaaaatcataaattacaaaaaacacattatgaataattttgttctggaagtatcataccaactcatacgatctaggtgaacccaaaagtaaaaaacaatgattataaattacagtagtgtctgtaaaaccctgttataaaggaggtattcttttaaaatatgtaccttatatataaaagctcctgactccttttaaggaccaaaattattttcagtttaaccattttcattaaaatgcttatttaaaagtatcgccttataaaactgagtatataaaatacaatgcagcccttgataactaagaatctttataaatgctaattatttagtgacctgtttatcaaactatttctgtggatggggtgattttttttcttcctctaaattaagtggccctagactaatatatttatatagttattctgttttcttccgtactgtcatttcacatctctatcagtgagttcctcaggatttgcctttattttacaactatgaaagtcttcaatccaattccctgcttccacacataggacacagaaagcctaaactttccttttttctgggctccaatgggaagcagcatttacaacgtgtctggcttggtaggaggaagattgtcaattgaggtatcatgtgtgttcacctgcctatcttgccctatttctttggttgctgtaaatttcctgcttctcaaatatctggatttttggctacctatttggcttccgtctttggtgtttatatctgtctggttttagcaggtctctctgattcctgactcacagctcctctccttcactaatattcaagtgtgctgcttgcctaactcctcattccttctccttgaatttcactttacaattgcactaggttctatcatcgttggccacagattaccacaaaacataatttcttaaattctgcacatttctaatgcttctaatcttggtttcctacaagatctaacactaagcttgtgttatcctgattacagtgtatgtaaaacaatgcttgtggaaaactaacctaggagaaagcttataggggaaacctgataatgaattttattaaattaataacccttataaaaatttcaaatgtaatactacctggatttgaacttcaatacttttcttaagtaaaattcttaaccacggtagaagttatgtttgttgatgttcactcatctataccctccatattctcagcaaagttggcataaatctgacctgaataaatagggttataacattatcaggcttgtaaaatactttatcaaatcaatgcatcagttaaagcaggggtccccaaccctgggctgtgtgtggcctgttaggaatcgggccacacaataggtgagctgagaggcaggtgagtgagcattctgcctgagctccgcctcttgtcagatcagtagtagcattagattctcataggagtgcaaaccccattgggaactgcacatgcaagggatcaggctcactgcagtcttgacctccccgagttcaggccaggtgatcctcccacatcagccttctgaatagctgagacgagatgataggcgtgtgccaccacgcgcagctaatttttgtattttttgtagagacaggtctcgccatgttgtccaggctggtctcgaactcctgagctcaagtggtccacctgtttaggcctcccaaagtgctgggattacaggcatgagccactgcgcccagccaacaggattttcttaagagggttctaaatgcaaacatcagccttgagattagaaacggggcaaaagaggtaacacacctaattattgtgtgcattaggtactatccattttaataaaaataagataacacctggagtcactatataatggaattggggctccattggttgacagctcttctgtgttcctctctatgtgcctagaactgtgccagattgtaggacagaagacactttacaaaggattccctcagggtcagcccagtgcagtggaaggagcctgccctttggggcttaagagaagcagtttcacatcctgattctaggacttttcatagcacagaaaagtctcatgatgtctctcagcccaatattggtttttaaattgagatgataatattttccttgaaagttaaaaaggagattaaattaggaagtatgtgtaacagcacagcatggtaactgaaacagtgggtactaaacgaattggatctttttccgaaacacaagtgtacaaagctgaacaggtaataaatatgctttaccatcattgtttataatgatgaaaatttttccaatacctaaatgacggataacaggggattggccacagaagtgatgtacatgcatagcatggaatatggcagcagccactggcaatcatgacattcactgacttgaacgaacattcacaccttattttattaaaaaaagagagcaaaatctattagcccggcgtggtggtgggtgcctgtagtcccagctactcgggagggtgaggcaggagaatggcgtgtacccaggagatggagcttgcagtgagctgagatcgcgtcactgcactccagcctgggcaacagagtgagactccatcaaaataaaaaaaaaaagcaaaatctgtgaatccttcaatcacatttgtgaaaggataaacaccagtagttccttagtggagatttcaagcccttctctccctacttcaccttcccctgccagtgagagtgcctctgattgcaggtgagtaccccggggctggctcctccagtgtcttctcagtcctgagcaacagtgcagaggtgaaacgggagcgcctggaagatgtggtgggaggctgttgctatcgggtcaacaacagcttggaccatgagtaccaaccacggcccgtggaggtgatcatcagttctgcgaaggagatggttggtcagaagatgaagtacagtattgtgagcaggaactgtgagcactttgtcacccagctgagatatggcaagtcccgctgtaaacaggtaaggacctctctggataatccatctccctctgcttggggctggactcacggggctgtgcagccaggcgatcactgtgaatgatgcaaatgcagcctcttagagacctgctggctgagagtcaggacctctgagctccaatgccagatctgcttctaatccacagagggtctttggacagttcccttccccccaggcctctccatgtgcagaggagggggtggatggaggagctctgaggatccttcccctctaaaacctatcctgaaaatggctcctgaagttctgggggtcatcaggagaatctgggccaacccaggacaatgacaggtcctgcaaccccccaaagagtactcaggcaagggacgctcagggtccgtggacctgtgtaagagctcaaggacatttgtgtgtaagatctgggcacagcctccatcccttgccccttcacagtctttcacatttgttgccccaaaacactcaactaataagtggcagaaccgggatttgaaccccagctgtccctttctagagtctctgcctgtgatgcctactcagggcccctggcctgcgtgactgaatggttgggggcccttgatgagagagggatggtggcaggagtagaggctttgcggagggaaatccagagtttggcgtggcatgtgatgtctgaggtgccccattagaggcccaggtggagataaggcatggagtttaggctgaagtacagctggagatggaagtttccaggctgcagttgggaatagtacacagtgaccccagggcacgcatatggccatggcctccctaagtctcccctcagcttctgccacagccctccctgtgcaaaggtgtagctcagggaggacccagactgcaaaatagtccccagtctggcccctggagctctgaccctaggaagcgaggcacaaaccttcttccttgccccaaatcagaacaaatgtcctcacttggaagctctctcaaaaggacctcatgggcccattctcaggacaagcccagacaagtcgaacaccaagaagtggtcacagcccagaaaatggagtccctggggatacaaccaacggcttctctgggagaggattctgagccagccagctgggagagaagagaggagatgccaggccttaggggaggcaggagagaggggagagggagaggagttccaggcccttgggagggagaaagtgccagcctggcttgccgtgaacgctcaacaaaagctgcttgctttgcaggtggaaaaggccaaggttgaagttggtgtggccacggcgcttggaatcctggttgttgctggatgctcttttgcgattaggagataccaaaaaaaagcgacagcctgaagcagccacaaaatcctgtgttagaagcagctgtgggggtcccagtggagatgagcctcccccatgcctccagcagcctgaccctcgtgccctgtctcaggcgttctctagatcctttcctctgtttccctctctcgctggcaaaagtatgatctaattgaaacaagactgaaggatcaataaacagccatctgccccttcagaaaggacttctaccatgtttttatagacttctgaatcacaaaggaggaaggtaacattgagtgaacactcactgggtagttccagcaatttctagccgggtgactttagagaaggctcttgattctcagaacctcagttcttccatgtcaggtgatgtcaggaggatcacctacgataatgcatacacgacacccagcactatgtctgatatgtaacagatgttcaaggaattgtcttcatcattctacacagacataacagcgacataattgcatgtcattaattttactctcagggaggcgaaaaaaacctaattaccttccggtatcgtctcatgtggtgcttaaatcccctcacaacacctacacatctaccagcatcttcccagttaccttcctcagttggccctctttttagaaagttttttttttttagctcaaaggtctgagttctcacccacctgtgactactagatggagtaatattctttccatgcccagattgccatggctcaagctggtcctgggtggaatgctgagaattagctacctctaaatctccctccactacttccagcatgccctgggtatggctccagaagtgcccaggtccccatgtttctgtgcttcctcactccagcctctgccaccagtgaccctactcagtggccacttccatggtggtcactgtggccaccaccactctggcttcaggactgaggacatcaccctcccctgggttgtactttttcatgcatgagcaagctggttggtcccttaattccccaacacagtggagaccaggctgtaatgattaacgacactcccctggaagctcaaggctattggaaggttgaagaacaaagagaataacttatcattgctacaattagagggggctctgctcagattcctggctgaaataccaggctccatttggggattgcagaagcatccatgcctgccttgctccagggctacctccacagcagagggcccagctgttctacccagagtccaggcctaaaaggcagaaggcccagcaagagaagaaggctttctcacttcttgtgatctaaggctcacctccccagacttcattacctgtccaggatcaattgttccagggtgctggacaatgggagcatccaggcccttccaaggtgtgtttgacctccatgactaggtcagatccccattaggagtctcaggtgtccatgtgtctgcacttcatgtgattctcacagttgcaatgaacactgatccatgtggttattttactaatgtgcctttccctgccagtattttggggacagtccaagtttggtaccattgggactctagcatcaagcacaatgcttaacttactataaccactcgatagatgatggattacaagcatgcacctgtaatcccagctacttgggaggctgtggcaggaggattacttgagcccaagagtttgagatcagcttgggcaacatagtgagaccccatctctcaaaaaggaaaaaaagatagtggtttacttaattaataaatctattaactgatatgtagaaaaacagggccaggcacaggggcacacacctgtaatcccagtactttgggagaccaaaggaggatctcttgagcccaggagttcaagaccagcctaggcaacatagtaagaccctgtctctacaaaaaaataaaaattaaaaataaaaaaagattagccaggtgtggtggtgcatgacagagcaggagcatcgccatcttggacaaataccaacattctgtgttcctcttgattaaaaactgcctaaatccagccccagaacgtcagtcccagaacatcagggcatttccctatgctgggaaaccaactcccagcataaccagaaacattccaaccctaagataaaaccctttccaaccagaaacatgccaaccccaagatagcctcccctctgacgagagacattctaaccctacaataaactttccctcacatagaaacattccgaacctacaatgatcttcccacttcctaaactcttaaatatccttagtctgttagaacactcctgaccaaaatcaaccagaagcccttctcaggtttattctctaaataaacctgtctttggctgttgagcccctttttgtgtttctttcctctttaattcttacagcgtgtgcctatagtccctgctactcaggaggctgaggcgggaggatcatttgagcccaggatttctgcagtgagctatgatcaaaaagagtacaagtaaaaaataaaaatataaaacatgaccactgttctcaaaaaaataaaaataaaaaacatgaccactcttctcaaaaaaatgttgtggccaccacagtaaaggttaatgcccaccagaattgtgttgctatgaagttgagaaatacactgaaccagttccagacctctctggactgacttccatgaactagatttcactaaatatggaatatatatatatgtatatatacacacacacacatacacacacacatatataatacatattttatatataattatatatatatgtaacaaaagcatacttcattttttcataagttcattaaatggttgtaccacctctggacagtccttggtctcagcaaatctttttgctaagattaaaagtagctgaaggctgggcacagtggctcacacctataatatcagcactttgggaggccgaggcaggggcatcacctaagatcaggagttcgagaccaccctggccaacgtggcaaaaccccatctctactaaaaacacaaaaattagccagacatggtggcgggcgcctgtagtcccagctactcaggaggctgagatacaataattacttgtacccagtgacggaggttgcagtgagccaagatcgtgccacagtactccagcctggacaacagagagagacgttgtctcaaaaaataaataaaagtggctgaagagagcatgcatatattccttccacaagctgtttttcagcttaagaaatttttaagaaaactgattggtgctggagaaacaggaatcctgggctgtgtgtggtagtactcgattgtcctttgtcgtttgtgtcactctcgaagacagcatccctctccccacccaggagtgacgggacagctggcaggacacagagaagccctagtgctgccctcctgcctcatggacaatgaaatgttttgcttatgtgcatccaccagaaagtgctctgaaggtgtttgggatctgagacaaccaggacacagaaggaacaggagcaggggagctctcagtgctgcctgccctattgtcctctttcctgggtggcttaaagtctccttttggggtaagagaaaataatttaagacattagtagggagggtcttagttcctgcaaagatctactcaaaccatcaggaggtcccatggttggacctggcccttcctgcagagccctgacccttggcactcaagacacaggagaagaaggaagccgtcatgatgggccagggatagggccctgggatctgtctctagcccatcaaagaaaggtgagaggtgacagcgtgctggcagtcctcacagccctcgctcgctctcggcgcctcctctgcctgggctcccactttggtggcacttgaggagcccttcagcccaccgctgcactgtgggagcccctttctgggctggccaaggccggagcccactccctcagcttgcagggaagtgtggagggagaggcacgagcgggaaccggggctgcgtgcggcacttgctggccagctggagttccgggtgggcgtgggcttggcgggccccgcactcggagcagccagccggccctgtcggccccgagcaatgagggacttagcacccgggccagcggctgcagagggtgtactgggtcccccagcagtgccagcccactggcgctgcactcgatttctcgctgggccttagctgccttcccagggggcaggcctcgggactgcagcctgccatgcctgagccttcccccacctccgtgggccccagtgcaccccgagcctccccgacgagcgctgccccctgctccacagcacccagtcccatcaatcacccaagggctgaggagtgtgggcgcacgcgcgggactggcaggcagttccacctgcagccccggtgcaggatccactgggtgaagccagctgggctcctgagtctggtggggacgtggagaacctttatgtctagctcagggattgtaaacacaccaatcagcaccctgtgtctagcttagggtttgtgagtgcacgaatcatcactctgtatctagctgctctgttggggccttgaagaacctttatttctagctcagggattgtaaatacaccaatcggcactctgtatctagcgcaaggtttgtaaacacaccaatcagcgccctgtgtttagctcaaggtttgtgaatgcaccaatcgacactctgtatctagctgctctggtggggccttggagaacctttgtgtccatactctgtatctaactaatctgatggggatgtggagaacctttatatgtagctcagggattgtaaacgcaccaatcagcaccctgtcaaaacagaccactctgctctaccaatcagcaggatgggggcgggaggggcgggaggggcgggggccagacaagagaataaaaggaggctgcccgagccaggagtggcaacctgctcgggtccccttccacattgtggaagctttgttcttttactctttgcaataactcttgctactgcgcgctttttgggtccacactgcttttatgagctgtaacactcaccgcgaagatctgcagtttctctcttgaagccagcaagaccaccagcccaccaggaggaaggaacaacttcagacgtgctgccttaagagctgtaacactcaccgcgaaggtctgcagtttcactcctgagccagcgagaccacgaacccaccagaaggaagaaactccgaacacatcctaacatcaaaaggaacaaactccagacgcgccaccttaagagctgtaatgctcaccgcgagggtccgcggcttcattcttgaagtcagtgagaccaagaacccagcaattccggacacaaagggatgttaaacacagcttctcctgccatctctgttttggaaagcgtgctcaaattgaccacaacagctgttctgtttacacactccgaagtcaaaatcactagccgcattctcaggctacatgatctccatagttcccgggaggtgggcagttttaatactgtgtggacggaaactagattcagagtctaagccactgacccaaggtcacacagccactaagcaaaagctctggattcccttccagtcaatttgacctaaaagtcagttttctgggccaggccactggaatgttctctgatgagacttgcatgggcagtctcactcgcagccttgcttgatgtcccaggacagctcctgtctgcccactgcagatttcgcaggctcaggccttggagcagcatcactcagtgcaagcttgaagctgtgggcagaaaggtcaggagctgctcagccccccattctctcacttcctgtgaagaaattggtgggaccaaagatggcggatgcaccccggaagcatcctccagggggagacctgtgcttccctggggcggtggagggagtaagtgttcagggcagccacttgtcagggtgagagctatgctgagagcacctggagaatcttcctggctagcagacagccaccttctcactagatcctcacgtggtggagagagtgccagctctggtctcttccttttctttttttcttttttttttttttttttctgaaacagggtctcattctgccgcccaggctggagtacaatggcatgatcttggctcactgcaacctctgcctcccgggttcaagcaattctcgtgcctcagcctcccgagtagctgagattacaggcacctgcctccacgcctggctaatttttgtatttttagtagagatggggtttcaccacgttggccaggctggtctcgaactcctgacctcaggtgatcctcccaccttggcctcccaaagtgctgggattacaggcatgagccactgtgcccggtctagtctcttccttttcatataagaacactaaatccatcctagaggctctaccctcacaacctaattacctcccagtgaccccacctccaataccatcccacaggtgggttagagttcaacatatgaatttggagtgtgagagaaacacaagcattcagtccatagcagagcccaattgtgtctttaatagaattcatactaagctgcatttccaaatacattttcctgtgcttttaactccattaaaataaagattcatgaacacaaaacagtaaaatcagtaaaccaaactccactcctgctggctaaataatattcctccgtaagaattggtggttgttgggacaatttcttggatttattgcctttcccgcttgcttctggccagcaggatccccacaaggcttgcggcagccagcaggcctgctgccacacctactgtcgtgactgcaccagtgacctgcagcagaagagaagggagagcacactcagcatcagggcgggaccacgatacatacaccaggaaactacagctcaggaaagactcatctggcccagtcctcttcatttgaatcacagagggaacaaatattggctgggagaggggatgccaagaggtcaggccacccaggaaagaggagtggagatgtctggtgggcacagaatgaatggaagaatgaagccataggcgtgatatacacagagtcaaaggaggaaaaccagatgcacctgtgggtattaaaagcataataggtcgggctcagtggttcacacctgcaatcctcacaccttgggaggctgagatgggccgattgcttgagcccaggagttcaagaccagcctaggcaacatggtgagacccccatctctacaaaaaaatacaaaaaaaaaaaaacagctgagtccaggtggtgcacacctgtagtcccagctactcaggaggctgaggcaggaagatgacttgagcccaggaggcggaggttgcagtgagccaagattgcaccactgcattccagcttgggtgacaaagtgagtccctgtcttaaa

SEQ ID NO: 1687 - DNA, 306505 bp, Homo sapiens; identical to SEQ ID NO: 1686

SEQ ID NO: 1688 - DNA, 9659 bp, Homo sapiens
aattctctccttcagcataaaagctgatccacaaacaagaggagcaccagacctcctcttggcttcgagatggcttcggtaagtttcccagggctttgcattactgactctacagcagttgggcagctccccctaggaaaggcctcagtccaggctcctggccttgggcacacagctccagagctcgtctttagaaggctgtcatggaaaactgtatttgtcttttaaaagtgcatctgcccagctggacagggagtcctctgggcagagtccacctcctctgcgtaactggcacagtgcggggagcccgggactcccatgtagtagagagctgtggggtgccgggtgtcaaatctacctcagcctgaggagaagccagagtgtgggcaggtgggggactctgggttgtgggaagcaagcaaatcccaacatcgtctgcttctgctgtgactggggctcagtcccttctcggccccaaacgatgctttctctctcctcgttcctctgtggcatcatccagccttctaaggtgcattctaatctcagcagctttctgaaaactgaaatttctcctcctatcagcccagatgtaccgattggcagaagctctagggagagcaggctgagctcggtggtgtgtgactaaaaaggaacagcggggctcaggctattactagaaacaaaaccattccgggaaggagtcctgcaaattctggagggcagcccactccaacagcaccacctgatcctggggaagggctttactgctgccaaaacaaatcagggcttttaacagggagcccaggccaaagctcatatctcactggccaccagctgaggttgccagtaccttgactgtggttttagacattcagcattgcagttaaaagcccctctctctccccacatggaaaccatctcctgtggtgccctgacatacagaggaggagctgggagggagtcctggccctgctcctttctcctccctcttccttgtctatttccttgccccattctacgccaggcccttcactgggtcctggaggtgcagggagggaggagcacacaggatcctgcctgcctggagctcacagcccagaggggcacagggaggcacagggaattgcagctcaacttgacccctgcagagagcagcagaggcccccggggacccaggtcctaggagtggggtggcgggtcagctgagccaggctggggccatcagggcagcttctcaggtgagggggtttgagggaggggaagaggaagagtggctgcagggaagtgatggaggcagggagaaccagatgtgcagagcagcagagaccagagccagggcagtagtgaggggctgggatgtcactcagtgggcctgtgggtgcagagcccagggagggagaggagggtgaggaagggccagtcaggaagggcctgggagctgcccacagggtgtgtcctgggccctgaggtcagaggacggtcatggccagatgtgcccttgggaaggccaccatgggttctgaggagttggatatggagtggcagggacaggaggcaggggctggtcagggggttgtgggggtcacagaggcaggcatggggctgcctgaaccaagtcagtggatgggatattgacaagcacaccaacaaggagaagcttccggagtccacattgattggttttagtgactggatattggcatgaggaagagggcaaaggagagcagaccccaggtctatgatgggacatcctgggatgagggaggaggaggctgtcacccactgaggacagggacagagagggtgaaaatggaaaaatcctccagtcatgaggctgctatgccctggggcaggacatggagaagtgggaaggaggtgaggaaggggaagaaggtggccaagacaggaaccagggtgaggggtgtgcagggaagaaccagctcggcctccttccagctgagtgttctcaggaaagccctgccacctctctgatcctcagtttccccatctgtgcaatgggatgatcatgccttcccctggggctgtggagatggtgcagttattgtaggacaagttcccacagaggcctgttctgtgagtgcagagccccctcagtgctgggagctggggggccccacaagaccccactcaggtcccagcaggatgctgtgagctcctgtctcccagggtgtcatctccaagagataggtgtcctgaggctggatggggcaaggtctgaggaggaggtggctcttggggccatggagaggcacagggcaggagtgatgaggaactgagggtcagtctgcagagggcggagagctcaagactcaccttcccagccttgctcctggcctcagtgaaggtgctggttcatgcaggctcttgagtcggcctactgaggagcatgtgtacaatgcacacatgcacacacatctgcatcctcagcatgcacacacacagcacacacatgtcacacatgcgcccagacggtccttctgtctcccatcccacaagatcattctccaggcttccagcccccagtgcccccactgagaagagcctctgaaagtgacagcagggctgaggatctcatggggctagcagctgatgaacatcagcaaggcgtctccaggatgagctgcagctcccccagccagggtctctgctgttgcctagaaggccgggtactccatctctggcttttctgttgcagccacaccaagagcccaaacctggagacctgattgagattttccgccttggctatgagcactgggccctgtatataggagatggctacgtgatccatctggctcctccaagtaaggactgatgaatatataattttcaaaatatttgttaaaaggataatgagagggccgggcacggtggctcatgcctgtaatcccagcactttgagaggccgaggtgggcagattacctgaggtcaggagttcaagaccagactgaccaacatggagaaaccccatctctactaaaaatacaaaattagccaggtgtggtggcacacacctgtaatcccagctactcaggaggctgaggcaggagaatcacttgatccccggaggcagaggttgcagtgagccgagatcgtgccattgcactctagcctgggcaacaagagcaaaacttgatctcaaaaaataaaaaaataagtcaatgagagccactgaaagacagttaagcaagggaaacttgagttaggagacacattcttcttagaggatgcttgatgagattgcacacacatatgtcccatgaagtagacacagtgcattccataggtcctggcagaacggaagaagagaccgttgcctcccgcagcgaagctgggctgcttcagcattgggatctctccagctcaaagtcagttaccttggcatgcagaatctcatacgacttaaaccagccaggtttcttaggtcttaaagaagaaagtttctcaaaaggaacaatgtttctccgtgccagatcctttgcctcatatgttttcacacaacaaggtgtcttgatattatatacttaagattccttactgggagcaattctcacaggtttatacatttttttaaaattctcatacaaatacacagtaagcaataccaatgttttatttaactcattaataacagaagcagaaatatgacatacccagttaaaagcagaatgaaggaaacgtatgtatggatagccaatgaaaggggaaaaaacgaacacagaggccaggcacagtggctcactcctataatcccagcactttgggaggccaaggcggacggatcacttgaggtcaggagttcaagacgagcctggccaacatggtgaaaccccgtctctattaaaaatacaaaaattagctgggggtggtggcaggcatctgtaatcccagctactcaggaggctgaggcaggagaattgcttgaacctgggagacggaggttgcagtgagccgagatcctgagacagtgccactgcactccagcctaggagacagaggaagacattgtctcaaaaaacaacaacaaaaatgcagaaatgagacaatgagactgccaaattaggtaggtgcaggcaagttcatatcctctagggcagtgccactacataacttctcatgttctcttttcaccaagcatttacattgtcactggacaaaaaccattcccatcactatcagggcaagacatttgcatcttatcagttttctccaagccatcatctcccaggcaggattgtaaaaatgtctgaattgatggaaaatagtaaatcaagcccacttaatccagatgatcctcagggaccttgtaagacaaagcatggcaatgaagacacatggtcctttttgtgcctaacttgcagtgtgtaaagaggctttttttttttttttaagacagagtcttgctctgtcaccgggatggagtacagtggtgcaatctcagctcactgcaacctccgcctcccagtttcaagcgattcccctgcatcagcctcccgaatagctgaggctacaggcgcatgccaccacagccagctagttttttgtattttagtagacatggggtttcaccatgttggccaggatagtctcgatctcctgacctcgtgatccaccagcctcggcctcccaaagtgctgggattacaggcatgagccaccgcgctcagccgtaaagaggctttttaaagacaatttttctctctttcctttttttttttttttttcctctgagacagtgtcttactctgccatccaggctggtgtacagtgatgtgattacagctcactgcagtcttttttttttttttgcataaacattctgatttaataaatggtatgaatatatattttgcatactttacaataaagaaaattttgaaagaaaattgatctaaaactgtttccctccaatttccatggtaaagtcaactgcatacagttctttccatgtataagttttacatttgtattttctacaattaaataaatctaaatgttaaattttagcacatatatccaattatgtacaaaattacaatgtcaatttataagtcaagcttacttaaaaatcataaattacaaaaaacacattatgaataattttgttctggaagtatcataccaactcatacgatctaggtgaacccaaaagtaaaaaacaatgattataaattacagtagtgtctgtaaaaccctgttataaaggaggtattcttttaaaatatgtaccttatatataaaagctcctgactccttttaaggaccaaaattattttcagtttaaccattttcattaaaatgcttatttaaaagtatcgccttataaaactgagtatataaaatacaatgcagcccttgataactaagaatctttataaatgctaattatttagtgacctgtttatcaaactatttctgtggatggggtgattttttttcttcctctaaattaagtggccctagactaatatatttatatagttattctgttttcttccgtactgtcatttcacatctctatcagtgagttcctcaggatttgcctttattttacaactatgaaagtcttcaatccaattccctgcttccacacataggacacagaaagcctaaactttccttttttctgggctccaatgggaagcagcatttacaacgtgtctggcttggtaggaggaagattgtcaattgaggtatcatgtgtgttcacctgcctatcttgccctatttctttggttgctgtaaatttcctgcttctcaaatatctggatttttggctacctatttggcttccgtctttggtgtttatatctgtctggttttagcaggtctctctgattcctgactcacagctcctctccttcactaatattcaagtgtgctgcttgcctaactcctcattccttctccttgaatttcactttacaattgcactaggttctatcatcgttggccacagattaccacaaaacataatttcttaaattctgcacatttctaatgcttctaatcttggtttcctacaagatctaacactaagcttgtgttatcctgattacagtgtatgtaaaacaatgcttgtggaaaactaacctaggagaaagcttataggggaaacctgataatgaattttattaaattaataacccttataaaaatttcaaatgtaatactacctggatttgaacttcaatacttttcttaagtaaaattcttaaccacggtagaagttatgtttgttgatgttcactcatctataccctccatattctcagcaaagttggcataaatctgacctgaataaatagggttataacattatcaggcttgtaaaatactttatcaaatcaatgcatcagttaaagcaggggtccccaaccctgggctgtgtgtggcctgttaggaatcgggccacacaataggtgagctgagaggcaggtgagtgagcattctgcctgagctccgcctcttgtcagatcagtagtagcattagattctcataggagtgcaaaccccattgggaactgcacatgcaagggatcaggctcactgcagtcttgacctccccgagttcaggccaggtgatcctcccacatcagccttctgaatagctgagacgagatgataggcgtgtgccaccacgcgcagctaatttttgtattttttgtagagacaggtctcgccatgttgtccaggctggtctcgaactcctgagctcaagtggtccacctgtttaggcctcccaaagtgctgggattacaggcatgagccactgcgcccagccaacaggattttcttaagagggttctaaatgcaaacatcagccttgagattagaaacggggcaaaagaggtaacacacctaattattgtgtgcattaggtactatccattttaataaaaataagataacacctggagtcactatataatggaattggggctccattggttgacagctcttctgtgttcctctctatgtgcctagaactgtgccagattgtaggacagaagacactttacaaaggattccctcagggtcagcccagtgcagtggaaggagcctgccctttggggcttaagagaagcagtttcacatcctgattctaggacttttcatagcacagaaaagtctcatgatgtctctcagcccaatattggtttttaaattgagatgataatattttccttgaaagttaaaaaggagattaaattaggaagtatgtgtaacagcacagcatggtaactgaaacagtgggtactaaacgaattggatctttttccgaaacacaagtgtacaaagctgaacaggtaataaatatgctttaccatcattgtttataatgatgaaaatttttccaatacctaaatgacggataacaggggattggccacagaagtgatgtacatgcatagcatggaatatggcagcagccactggcaatcatgacattcactgacttgaacgaacattcacaccttattttattaaaaaaagagagcaaaatctattagcccggcgtggtggtgggtgcctgtagtcccagctactcgggagggtgaggcaggagaatggcgtgtacccaggagatggagcttgcagtgagctgagatcgcgtcactgcactccagcctgggcaacagagtgagactccatcaaaataaaaaaaaaaagcaaaatctgtgaatccttcaatcacatttgtgaaaggataaacaccagtagttccttagtggagatttcaagcccttctctccctacttcaccttcccctgccagtgagagtgcctctgattgcaggtgagtaccccggggctggctcctccagtgtcttctcagtcctgagcaacagtgcagaggtgaaacgggagcgcctggaagatgtggtgggaggctgttgctatcgggtcaacaacagcttggaccatgagtaccaaccacggcccgtggaggtgatcatcagttctgcgaaggagatggttggtcagaagatgaagtacagtattgtgagcaggaactgtgagcactttgtcacccagctgagatatggcaagtcccgctgtaaacaggtaaggacctctctggataatccatctccctctgcttggggctggactcacggggctgtgcagccaggcgatcactgtgaatgatgcaaatgcagcctcttagagacctgctggctgagagtcaggacctctgagctccaatgccagatctgcttctaatccacagagggtctttggacagttcccttccccccaggcctctccatgtgcagaggagggggtggatggaggagctctgaggatccttcccctctaaaacctatcctgaaaatggctcctgaagttctgggggtcatcaggagaatctgggccaacccaggacaatgacaggtcctgcaaccccccaaagagtactcaggcaagggacgctcagggtccgtggacctgtgtaagagctcaaggacatttgtgtgtaagatctgggcacagcctccatcccttgccccttcacagtctttcacatttgttgccccaaaacactcaactaataagtggcagaaccgggatttgaaccccagctgtccctttctagagtctctgcctgtgatgcctactcagggcccctggcctgcgtgactgaatggttgggggcccttgatgagagagggatggtggcaggagtagaggctttgcggagggaaatccagagtttggcgtggcatgtgatgtctgaggtgccccattagaggcccaggtggagataaggcatggagtttaggctgaagtacagctggagatggaagtttccaggctgcagttgggaatagtacacagtgaccccagggcacgcatatggccatggcctccctaagtctcccctcagcttctgccacagccctccctgtgcaaaggtgtagctcagggaggacccagactgcaaaatagtccccagtctggcccctggagctctgaccctaggaagcgaggcacaaaccttcttccttgccccaaatcagaacaaatgtcctcacttggaagctctctcaaaaggacctcatgggcccattctcaggacaagcccagacaagtcgaacaccaagaagtggtcacagcccagaaaatggagtccctggggatacaaccaacggcttctctgggagaggattctgagccagccagctgggagagaagagaggagatgccaggccttaggggaggcaggagagaggggagagggagaggagttccaggcccttgggagggagaaagtgccagcctggcttgccgtgaacgctcaacaaaagctgcttgctttgcaggtggaaaaggccaaggttgaagttggtgtggccacggcgcttggaatcctggttgttgctggatgctcttttgcgattaggagataccaaaaaaaagcgacagcctgaagcagccacaaaatcctgtgttagaagcagctgtgggggtcccagtggagatgagcctcccccatgcctccagcagcctgaccctcgtgccctgtctcaggcgttctctagatcctttcctctgtttccctctctcgctggcaaaagtatgatctaattgaaacaagactgaaggatcaataaacagccatctgccccttca

SEQ ID NO: 1689 - DNA, 305425 bp, Homo sapiens
cggcggagcgcgggtccctctcctgagcatcagtgagcgcccggagccgtggccgctgggggttgcggcggcgctgagccagcggggccggtgagtactagccgcgccgccagcccgcccgccggccggctctttgcgcctcagccgcgtggtctgaagggatgggcgggcgagcgcgggggtccggcagtccgtcgtgggggcacgggactgcctttctgggaaggcgtgctgcgtcttcgccgcgggggccccggtcccctcgtcgcgtgtcctgtccccagcccaggagggacgtcctggcctgtcctgcccggcccggagcggtgggaccggtgccgcaggtggcagcggcaggtggccgcctcctcccctccgggcccgagggttgtcgcagggacccgggactgagagccaggtggctcccgacagctgcggccctggaggcgaccccagccctcgccgcagtgggacaggtgcgcgggcacgcccggccccggctcctgggtctcgggagcctcccgcaccctccctgttgtgccttgggggtgctgcgtggtgcagaggaccgagaagcccttcgccctcggcgtccgccgcgctcccgccccttcctggccggggtgacaggggaagggctagggctgcgcatcccgggtcagctggggcgccgcggcgcagtgcacctggaaggcccgggggcagcgcgcggtgcccgtgggtttcccggtggtgcggacctgcgggcgtgcggaagtaacgacctccttccccagtgcccatgcaaggaaattagtgttatgtgcttgctttttttttttttttttcctaaggaagtttgactctgaatatcttattttgctggagctccatttgccagcacgtaagtttatgtaataagcggcatacagttcggaaaaaaattttcctgtgaaagtgctcttccttgccctctgcaggaagaattacgccgagctggttggcaggcttatccaccagcaactgtaggagctgcaggcagcagataaagtgttttttgagtaagggcacaagtcagcccttcaggacaatttttgtttttggaagattctgttatccagttccaaacaccgtgttatttcagtgttgaagatgggggaggagggaggagcacaggcttgtcaatcctaatacctcaacagaaattagctttgcaggattaactctccaagcaagcgagttgaatttggtagcccaaactacagctgaagctgagcctccatactaaagcctgtctcagttttaatagtttttcgcttgattcgtttgcctcttccaagtaggtgatcttattgtctgttaaacaacagatgtctctcatgtttttacttttttccttgtcttccatagattactctcgctgcagtgttgactattgaggttaaataggaatctttgtcttgggcttggttttagggagcattccctctgtatcttcaccgagtgtattctatcacattaagtacatttctgtttatgcctaattactaagagtttaaaaagtcaagggtgggtgttgggttttttgcccaaatgcttttgtgtagcatgcattgatatgatcatgtagattttcgtcttaaaattgttaacataagtggtggtcacattgctagattttctttctctaaaaccctgggctaatttaaaatgcacttttggattgttcacatcaataagctagcatcttatttagggttttggtatctgagtttggcatatagtttaccccatttttatctgtgttcataacaaggatcaggctgtcctctctgattaaattgggaaactttccatcattttctatgctctggaatagaagaattatctgttccctcaagtttggcagaacttgactgcagactgcctgggctgctgctggtgttgtttaggcagttaatatcagtatttaattaccttttcatttttttcatgatcatttatttttctcagtttttctgtttcttcaaagtaaatttaatattttctgttttcctagaaaatcattaacattattgaaatttaatatatgctagcataatgttgtatatagtattctggtgtaagaaaacagactcttacatatctgtatgtatctgtatgttctctttctgatacagtactttttttggtaccttttctctttttttttgatcagacttgcttaatgattattttattaatcctttcaaagaaccagcttttattaaccaggatttattgattaattctattgattttttatttttctatgacattaatttctgttttttatctttctacttaatttgagtttattttgttcaagttttaactgtttgaatggaaaacctggctcatttatttaatcagtcctgtgaacaaggcaaggacttctaattctttcattccacttacctcacatttggccttaattgtatttttacttcaacccttccaacgagacattattgctattgtttttgttattttctaggtcaacatttattagctttatctacctgtttaccatttcttcactttccattccttcttgtatcacagatacttttctttggaacatttttcttctccctcaagtacattctttagaaattacttcagcaatgatcaattttctgtttttgtaatatctgaaaatgcctttattctccctgtattctagaattttggtttcaccatgtgtcttctattgatttcagagttatttttgtatttttttatatttttaaaaagatgttttgtagctggaaggtttttaggatctctattctgccacagtgctgaaagaaaaacaaagattaagaacagattaatttgcagtccactgtcagtcacgactgttccctgaactcttagtatattgggtatacagttctatattaatctcaagtttattgatggtaattcaggttttctgcatccttaacttattttttttctctgtttgacctgttgatatggagagttgtattgaagactcccattatgattcttgtaggggtttttgtactatttctatgtttaatatatatttttctttaaatgttgtatttttgaagctgttttatgtgcttaaaggttcacaattcttgtatcttcttggtgaattgtaccttttgggaataaacgagccatcttatttaattttttttttgttcattctctttatattgctgtacttgctttttgttagcatttatatggaatatctttttctagtcactgattttcaattttctgtgtcttctttaattgttactcttaccattagcttatggctggattttgtttaattagttaatctttgtcttttaataaatattgtggtaaaataacataaaatttattatttattatttttatttttaccatttactacttttaagtttacagttccccagtgttaagtgtgtgcacattgttatgcaaccaatctccagaattttttcatcttacaaaattgaagctctgtatccattaccgcagcccctggcaaccaccattctgctttttgtctctatgaatttgcctattttaggtaccttgcatgagtatctaatatagtacctcatatagtatttgtctttttataactggcttatttcatttaatgtaatgccctcaaggttcatccatgttgtagcatgtgtcagaattttcttcatttttattgctaattaatattccattgaatgtatacaccacattttgcttatccatatatttatcaaaggatatttatgttggttccacatcatagctattatgaataatgctgccatgatcatgggtgtacaaatatctcttcaagaccctgctttcagttatttgggtatatacccagaagtagaattgttggatcaagtagtacttctatttttaattttttgatgacccagcatagtgttttccgcagaggctgaaccattttatattctcaccagcaatgcgtgagaatttcagtttccatacatccttgctaacatctgttattctctctctttttttgatagtagctatccttatgggtgtgaaatctttgtcttttaataggtagctttagcccatttatatttattttgattactgatcttttgcggattattcctgtcatcttattttatatttttgatttccttttttgagacggagtcttgctctatcgtccaggctggagtgcagtggcacgatctccgctcactgcgacctccggctttcgggttcaaacgattctcccaacccagcctcccgagtagctggaattacaggcctgcaaccactatgcccggctaatttttgtgtttttagtggggacaggttttaaccgtgttggccaggctagtctcaaatttctgacctcaagtgatctgcctgccttacccgcccaaagtgctgagattacaggcatgaaccactgtgccgagctggttcatttcattctcattgctgtgtatatgccattgtatatatccctaatatagatatacatttgactttgattggcagttggttgtttgcatttttggactattatgaatagtaagtacatgaacactctagtacacgtcttttgttgagtgagtgtgtgcatttctgttgagtgtgtatctgggagtggaactgcttggttgtagtctgtgcatgtgctcggttttagtagatactagcaaacagttttcagtaccggttgcaccaacttatttaccccagaagtatatgtggttgctccacattcttgccaactcttggtaatttctgtcttttaccttttagttattctggtggatactgtggttttaatttggattttcctgatgataaatgaatttgcactgttttggtacccttagtttttcacacatatctaaacatttttttctcttgctattaaaagataatctgtttatgtgaactctccatgagtaaagcaaaaaagaatcttatcatgattttaattctgtcccatattaaatttttgggttttcatacattatgcataaacagttatttaggtaaactgtaaatttttctgattatttactcatcattggtgcttttatttcatttgttttcttaatgagtccttaagtgattatttggttttgttttcagggattctgtgaatggtaaactttctgaacccttgcatgtttaaacaatgttttttatttcacttttccatgtgaatattcttgactgggtataggattctacgttaaaaccttctgaattttggagatattgctttatctgctggtatctaggaagaagtgcacgcgtctgactctcgtttctttgtagttaatgtttattttctctgaagctttacaattttttttctttctccttggtgttctaaaatttaactattatttgtctaggagtggattttttttttgagatggaatcttgctctgtcacccaggctgggagtgtggcatgatctcggctcactacaacctccacctcctggtttcaagtgattctcctgccttagcctcccaagtagttgggattacagatgtgcaccaccatacccagctaatgtttgtatttttagtacagacagggtttcaccatgttggcctgactgatctcaaactcctgacctcaggtgatccacctgcctcggcctcccaaagtgctgggattacaggcatgagccactgcgcttgggcaccacactggcttaagagtggatctcttttgttcttcctgctcagcatttggtagtccgtttcattctaaagattaatacacatttctatggcactggagaagttttgagtgtttccttgcctctattctattttctgcttctggaattattcttacttgggaattagaatatcttgatttatctttcatgtttcttgaaataagcatttttttctctcaaatattctgtcttttttaatttaattttttttttttttgagacagagtattgctgtgttgcccaggcctggagtgcaatggtgtggttcaatgtgacctgcaactcttggactcaggcaattcccctgccataccactgtgcccagcggaaatgctctctttatctttatgggctgcattctgggatgttccttgggctggttttgcaggtcaccaatctaatatttagatttgttccgtcaactctttagcccatctcttgagtgtttttaaatattgattatcatatttttaactttccgggtctctattttttttttttttttttgaggtggagtctcgctctgtcgcccaggctggaaggcaatggcactatctcggctcactgcaagctctgcctcccaggttcacgccattctcctgcctcagcctccccagtagcgaggactgccggtgcccaccaccacgcccggctaattttttgtatttttagtagcgacggggtttcactgtgttaaccaggatgatctcgatctcctgacctcgtgatccgcccgcctcggcctcccaaagtgctggggttacaggcgtgagccaccacgcctggccacgggtttctacttcttaaagtttaacttttgaaataggtaagataggcagggcgcagtggctcacgtctgtaatcccagcactttgggaggccgaggcggatggatcacgaggtcaggagattgagaccatctggctaacatggtgaaactccgcttctactaaaaaaaaaataaaataaaaaattagctgggcgtggtggcgattgcctgtagtcccagctactcaggaggttgaggcaggagaatggtgtgaacccgggaggcggagcttgcagtgagccaggatggcaccactgcactccagtctgggcgacagagagcgactccatctcaaaaaaaaaaaaaaaaaataggtaagataatcagtgttcaaaaccagactgtattaaaaaggcataaatgaaagtgagaggtgacagcgtgctggcagtcctcgctcgctctcggtgcctcctcagccttagtgcccactctggccgcgcttgaggagcccttcagcccaccgctgcactgtgggagcccctttctgggctggccaaggctggagccagctccctcagctttgcagggaggtgtggagggagaggcgcgggcgggaaccggggctgtacgcggtgcttgcgggccagcgtgagttcccggtgggcgtgggcttggcgggccccgcactgggagcggccggccagccggccccaacggccccaggcagtgaggggcttagcacctgggccagcagctgctgtgcccgatttctcgctgggccttagctgcctccctgcggggcagcgctcatgacctgcggcccgccatgcctgagccacccccacctcctgggctcctgtgcggcccgagcctccctgacagcaccaccccctgctccacggcgcccagtcccatcgaccaccagagggctgaggagtgcgggcgcagggcgcgggactggcaggcagctccacctgtggcactgatgccggatccactgggtgaagccagctgggctcctgagtctggtggggacttgagaacctttatgtctagctaagggattgtaaatacaccagtcagcaccctgtgtctagctcagggattgtaaacgcaccaatcagcactctgtcaaaatggaccaatcagctctctgaaaaatggaccaatcggttctctgtaaaatggagcagtcggctctctgtaaaatggaccaatcagcaggatatgggtgtggccagataagagaataaaagcaggctgcccgagccaagagtggtaacgtgctgcggtcgcattccgcgctgctgaaggtttgtccttttgatgtttggaatgcgttcttattactgctcactctttgggtctgcactgtctatatgagctgcaacacacacctcgaaggtctgcagcttcactcctgaagctagcgagaccacgaactcaccaggaggaacgaacaactctagatgcgcccccttaagagctgtaacactcgccgcgaaggtctgcagcttcactcctgagtcagcgagactacgaacccaccagaaggaagaaactccgaacacatccaaacatcagaaggaacaaactccagacacaccgcctttaagaactgttacgctcaccgcgagggtccacggcttcattctccaagtcagaccaagaacccaccaattccggacacaaaaggtgttcccaccattcctgtcctcttacttctctcgccttacaagtaggtaaccattgttgttagttacttatgtaccttccaaagtttcttcatgcaaatacaagcaaatatgaatcagattctccatttctccttttttgcacaaatagtagcattattctctatctggtcttcatcctgtgtttttatttcttggtatatcacaaagatcgtcacataccaactgcttgctctttataatgtccccttaggtcttcccaagaatatctaataatttcttctatgtgctctagtaattatctttgcttgggtttgtgttctgttgattcagtgtccctgtttcatcatactgaataaaaacttggtgattctttatgtgttcatcttcgaagtttgagaattccttttttcctgtcttactaggcgtagcgtgcctcctgtgattgttgaagagctgtggtgtgctgctgagtggcgtgtgtattccatgtgaggggaagggtccaacagtcctggtcattcagactgcagttccccaggtaatcaccttgtcaggttctacctctgctgttctatctgctgttacaagtctgttcctggaaacctgttaccatttccttctgcataacagcctcctcccaagcttgtattgggctatggtttgctcaggtaatctggttctgagtactttttacttttcagaaatttcctagacattttagttggccatcggcactcttgttttccaggtttcttttgatttagtgttttaaaaatgtttctaccattccattgaattttaagacacttggaaggcagaagtatgtgtttagtttattgttttggggacagggtcttgctctgtctcccaggttagagtgcattggcgcagtcataggtcactgtaactttgaacttttgggcttaactggtcctcctgcctcggcctcccaaagcgctgagattaccggcatgggccaccatgcccagtccttggtcttttataatttatttctgtgttgggggcccccaggaccatgctcagatctggtggttcacttggaagactcagcatgtggtgtactcacggctgtaatttattacagtgaaaggatacaaagcacaatcagcaaagggaaaggtgcatggggccaagtccaaaggaagccaggcacaagcttccaagcatcctctcccagtgcagtcacacaggatgtatgtgcttaactccccgaggaaggagctgtgacaacgcatgtgaaatgctgtctaccagggaaactcactagagacccaacacccagggtttttattgggggctggtcatgcaggccccctttgcccagcacataccacattccacgctacctgaagaaaagcaggagttcagcataaaccacacaataatttaggcacagtgagtccctctttccaggttggatggtgggaacccttctgaaatctaagttcccaggtgccagccaaggattaaccatgctttttatgagactttttaagaataacagtcttgggccaagcacaatggctcatgtctataatcccaacactgtgggagaccaaggtgggaggatctcttgaagccaggaatttgagactagcctggccaatacagaagaccctatcattcatttatttatttatttatttatttatttatttatttatttatttatttatttattttaaaaagcagtcttaggcctgctgtgttaactcttttctgtaagattttcctcctgtgttcctcagaaaaagatggacactttacctagaaatgacttctcccagtcagatggtcatgaatttttttgccttctctgaagagagaacacatttgtattaaggtgaaactgagtggagaacatttcctgatgttggagaaagccatagcatggcacgtgctcagcagccttgagagggtgtcagtgagagagcacagagggactactcaaccattcaaaattattttgaaaaggcaaggatccttttgaactttatctgcaaattccatgaggtgagaagtttagctcaatatagctggaaagttgagattgggttctgtgctgatagcaggaatgacacgaaagagctgaataaaaaatccacacatggtctttaattagccatatacagatggtagtggcccatcatccagctcagagatctgccacttctcttccagctttcccacggagccaccctgatcacccccatccatgttggtctttcttccccaaatggccatcagctctgctcacagggcctttcatcactggcttctttgtcactggcttcttttccgtggttttattggatagtttttgttgcctcattgtgtataatcttccacaagattgggaattccttgaggaatgaacagtaagtcatagttatataccccatgtctccctgcagggtgacatgcatagagctggtgcctattaatgttttcggaaagaaccactagaaggaagtaagaagcagccttttcttcattctagtcactgcttcacatgcagctgatttttattctgtgttgagggtggtgatataaaacaccacgctgacattacctgtttgagttgtctgagttctgtctgcagcagatggtgtaattaaatgttttagtttgaaaggcttttcaatttcattcaatctgagtgtgggcttagattgtcaaatcatcttttctaactctaaaggctgtatctagtcagcctggatctagtttcctccctttctctgtttttttattttttttatttttttgagacagagtcttactctgtcacccaggctggagtgcaatggtgtgatctcggctccctgcaacctccgcctcctgggttcaagtgattctcctgcctcagcctccagagtagctaactacaggcatgtgccaccacacctgggtaattcttgtattttttgtagagatgggctttcactgtgttggccaggctgatctcaaactcctaatcttgtgatccgcccgcctcagcctcccaaagtgctgggattacaggcgtgagcctccacgcctggccctccctttccttggttttagacctcaggtgtgaggaattgaattaattatattctcattcttagccctttatcatcactggcccatgcaagcccctctgttgttttgcttgttaatgcatttgttggtttatttgttcattccgttttatcccactctcattctcttctccctatagacagctattctaatgaggttcatataatacttttgtgtatatacagttgacccgtgaacaatgagggggtcaggggaactgattgcctgcacagttgaaaatctgtgtataacttttgactcccaaaacttaactactgacagcctactgttgagtggaagccttacccataatataaacagtcaattaacatttattttgcgtgtgatgtgtattatgtaccatattcttagaataatgtaagctagagataaagaaaatcataaggaagagaaaatatacttttcattagttccttggaattggattatcataaaagtcttcatccttgtcatcttcatgttgagtaggctgagggggaggaggaagaagaggggttggtcttgctgtcttgggggtagcagaagtggaagaaaatccacatgtaagtggacacaggcagttcaaacctgtgctattcaagggtcacgcgtatactgctttgtgtgcatctatttttaatttacatgaatggcatcatgttctagcctttattctgtatcttaggattgtcactcaccacccatctctgttacttggtgattctggtcttaatatccaccacattttgtccatctcgtctcctgtagatggacacccaggttgattcccactcccagtaatgctgaatgagcctcgtacatgtctccttatggacttgtgtgagaattctttgggatttagacccaggagtaggactgcctggtcgtggtgtgtgcctatacttaatataaccaagtactgccagattgctgtcaagggtggctgcaccactaccttccccagcagcacacaaggattcccaaggctctgatatatatatatataatataataatatatatatatatatatatttttttgtacttttagtagagaccgggtttcactgtgtcggccaggatggtcttgatctcttgacctcatgatccgcccgccttggcctcccaaagtggtgggattacaggcgtgagccactgcacccggccatcccaaggccctgatctttgcatgcgcttggcatcattcaactttctagactttagcagtctctctctttttatttatttactatttattattattataattataattattattatattttttgagatggagtttcactcagtcgcccaggctggagtgcagtggcatggtctcggctcactgcaatctccgcctcctgggttcatgccattctcctgcctcaacctcctgagtagctgggactactggtgcccaccactacgcctggctaattttttgtgttttcagtagagacggggtttcaccatgttagccaggatggtctcgatctcctgacttcatgatccgcccgcctcggcctcccaaagtgctgggattacaggtgtgagccactgtgcccggcagcagtttccctctttttatttgcatctgtctgtttactactgaatttgagaatgcttttatatatgcttgttatctttttgagtttccattgacataagttgcctgttcatgtcctttccccatgtttcaactggaatccaatatagactattttagacattagccccttgttgatgtttcgacagtgcacatagtttctcctaatatgttatacgtcagctttttggttggtatctgtgttggataagaatccttaattctataacctgaatagtcaatctgccccatgaacttacttagttttaccttttgacatgtctgttgacaacatttagtaatcaagatatttcacataaaaatccagattcctagtctctcttgaaagggtgaaaagtatttcagtcctggctagagtgactgaggggtgagctcctgctgttgctagggcctgggctgcctacccacctgtcctcactcattctcttgacctcctggccactagtgtcatttgactttatgaccagccactgctgtatgtgaggcaataccttaaggataaacaagcatggtgatgatgttcccaagattgcttggacatggttatggagtgggtggactcggcattgagaacacagtagtagctgctgcatctcatgacactattggatgggtgtcagcatggcagcagaatactgacggactgtgtgcacattctttcagcagtaatgattcattcttttcaaccttttctggatcggctcattcctttttgccaaaaaaaaccaaacaaacccaaaaaactatggtttagtgaaattgcatatgaacaagagttctaaacgagggatctgaaaactttttctgtgaagagctatagagtaaatattttaggctttgcagggccgtgtgttcccttggaactacttagctctgctcctgtagtgtgaaagctgctataggttgtatgtaaatgaacatggtctcttcatttggtctggatttgggctgcagactgtagtttctgatccatgttctaaaccatagtcttaagacttaattttgtcttccttctcttgtttttaaggtgcaaggttatacataacattttgctaatgaatacatggtaagtacctactaggtactaggtgctgagattatagtgatggacaagacacaaatccagtctattcagcttaatgtctgggtggggagacagatgagggagcaggcaattactaaagaggatggcaggccaggacacgggagagcacacaattgggcagcaggggttgggagcagggcatgtcaggtaagacgttctagaagaaggtgatgtctaaatgaagggggaagagggcgaggcaggataatgcaaaggtccttttgaacttcatctgcaaattccatggggtgagagtatagctggaaagctgagattgggttctgtgctgatagcaggaatgacaagaaagactctgaataaaaaatccacacgtggaatcgtgaatgcttaaataatccaaggttgatggtggtaactcctatgctattcaaatgtggcagaaaataaaaaaaaaaaacatggaaagcatctcagctgattttacaaagttaaaataaccctgatagagagcagtatatggatactgggggttggaaattttaaaaaaatgaaaaaaagaacagtataagcccgtagatgtaaactatagaccaaatttacgtgtgatgtgtatacaaatatcctaaatagcaaaaggaggtcagcagaatattaaaagagcaatacactttgacgaaatatattttactctaggaattccagaatcgtttgctattaggacatatgttagtttaatacaaggggaaagtttagtaagtttccattttatttaataaaatggggtagctatataatcgtcttgagagattctggaaaagcacttagaatttgacttcaaatcttgtcatttcttgaaacgttttcatgcattgtgccttcaggttgtacagcgtggctgagtttaccactttttaatttctctggcaaatctttgctgattatagcttttcattcatcacgtcctttgtgaatccattcttgtttactctatgcggaataaatttttctcttctcttctagtccagtaattctccattctttcatttcaattggagttttcagtttctctcaattgctttccttttttgagagacagattaggcactggagatacaaagataaataagatagtactcagggttttttctctttatcctctgattcattttctacccttccatatttctctgtctcagagggagatgattcctacaaacttcattttgcagtgttccttgtcactgtctctggccaagtatggctagtaggaagcactagtgggagattgaaaggtgggaggaagggagaagtcagggtttttcccccttgttttctgctttgcacagtgtctctagggtggtcccagctccagccaaggactctgacactggcttgtggactctgataatagcccctcctttatccttccagcttcatgggtggtaggtagatggggtcccactgttgctaatctctgggttggctcaccatcccaactggctttttagtcctgccctaaaccttgtaattagttcccatattaaattcctgctattgaactgcttctcttgaattctatttttcttattaaactttgcacaatgtagataaaaaccctacttctgtgtgttcacaatctcataggaaaagcggacattaaaatgactataagtttagcctagtcagtgttccctcttcccttcttttggaagtagacttcactttgtgcatagcaattggccatgacccagaatgagccaatcaaaatttggacatgggcacacacagagaaaagatgatgtgaagacgcagggagaagatggccacctgccagccaaggagagaggcctgggacagagccttgcctcagggccctcagaaagaaccagctctgctgacaccttgatctcagagtcctagtctccagaactgtgaggaaatcaatttctatgtttaagctccccagtttgtggtactttgttccagtagttctgggaaagtagtgtactacctgtcctcccagccccacccaaccactaatctactttctgtctctatagatttccctattctggtcatttccgatgcatggaatcataatctgtggtcatttgtgactggcttctttcacttagcataaggtttccgagattcatccttgtagcatgtagctggatgtcactccttgtatgggcagataatattctagtgtatggataataccgcatgttatttacctgttcatcagatgatgggcatatgggttcttaccacctttgctgttatgaataatgttgctataaatgcccatgtacaagtttttatgtggatatatgttttcatttttttggttatagacccaggaggaatattcctgggtcatacggtaactctgtatttaataatttgaggagctgccagactgttttccaaagtggctgcatcactttacattcccaacagcagcgaatgaggtttctgattttttcacatccttaccaacatttgttattacctttttattctagccatcctagtgcatatgaagtggtgtctacattctacattgtggttttgatttatatttccctgatgactagtgatgttgagcatcttttcgtgtctttattggccaattgtatatagtctttagataagtgtatattcaaggcttttacccatttttgaattgggttgttttgttgttgttcttgagttgtaggagttctttatatattataaatattaaatatttatcagatatatataatttgcagatattttatttcttccattatgtgggttgtcttaattttcttttttttcctttttttgttgacgtaataattatacatatttatgaggtacagagtgataatttgatacatgtatgcaatgtgtaatgattgaatcagggtaattaggatatccatcatcacaaacatttatcattcctttgtgctgggaacatccaaaatctcttctagctttttgaacatgtacaataagttattggtaactatactcgccctacagttctatagaacactaaaacttattcttcttacatagctgtaaatttttatccattaacttttcccaagcctccccttctaattctgtgaccccattttctttttagcacccatgtctgagtgagaacatgtactgtttatctttttgtgctttacttatttcattaaatataatgtcctccaggttcatccatgttgctgggatgacaggatttcattcttctttaatggctgaatagtattctattgagtgtatatgccacattttctttatccattcatctgttgatgcacatttagatttattccctgtcttggctgttgtgaacagtgttgcaattaacatgagagtgcatatatttcttcagtatactgacttctttcctttggataaatacccagtagtagggttgctggatcatatggtagttctattttcagttttttgaaaaacctcagtattattttccataatggccattaccaatttgcatccctacccacagtgtataggagttcccctttctccaaatctttgccagcatccattatattttgtctttttgatagtagccattctaactggagtgagaggatatctcatagtggtcttgatttttatttctctgatgattagtgatggtgagcattttttcatacttgttggctattttatacttgcaaggctcccagaatagccaaaacaaacttgaaaaacaagaacaaagtgtaggatgactcacacttcccaatttaaaaatttatacactaacaagtaatcaagacagtgtggtactggcagaatgatagtgacatttgtatgtcttcctttgagaatgtttattcagatcttttgcccatataaaaaccagattatttgcttttttgctgttgagttgttttagtcacttgtgtgttctggatactagtcccttgatggatggatagtttgcaaatattttctcccattctacaggttgtcttttcattctgttgtttcctttgctgtgcaggagctttttagtttaataaagtgctatttttccatttttgtttttgttgcctgtgtttttgaggttttagccataagatctttgcctggaccaatgtcctgaagcgtttttccttatgttttctaccagtagttttatagttttgggtcttacattcaagtctttaattcagtctgagttgatttttctatatggtgagagataggggtctagttttattcttctgcatatcgatatccagttttcctagtatcatttattgaaggggtgtcattgtcaaaaatcagttgactataaatatgtggatttatttttgggttctttattctgttccattggtctatgtgtctgtttttctactagtaccatgctgttttggttactgttgctttgaagtcaggtagtatgatgcctccagctttgttctttttgcttaatattgccttggctattttggctttccatttcttgatggtgtcctttccagcacaaaggtttttcattttggtaggtacaatttaccctattttaccttagttggtcatgcttttggtgtcatgtctaagaattctttgtcaaacctaacgtctttaagatttacccgtatgtttccttctaagagttttacagtcgtaactcttacgtttaagtcatcaattcatttttgaattaatttttgcatatggtgtgatggagggtccaacttcattttttttttcatgtgactatctgattatcccagacctatttgttgaaaagaatggtcttgttgacctttttgaaaatcatttgggctggatgtggtggctgatgcctataatcgcagcactttagtgtgatggagggtccaacttcattttttttttcatgtgactatctgatcatcccagacctatttgttgaaaagaatggtcttgttgacttttttgaaaatcatctgggctggatgtggtggctcatgccagttatcccagcactttgggaggccacagtgggaggattgcttgagcccagaagttgaagaccagcctgggcaacatggtgagattctatctctacaaaaaagaaaaaaaaaaagaaaaaaatagaaaagcacttaccatagatgtttaggcttgtttctgtactctcaattatattccattgatatgtatgtatgtatgtgtcttttgccagtaccacacagtcttgattactgttgctgtgtcgtaacatttgcaattggcaagtgagtcatcctatattttgttcgtgtttttcaagtttgttttggctattctcaaggtcttgcaattccatgtgaattttagaataatcttttcaatttcaacagtgaagtcatctgggatttttttttttttttttttgagatggaattttgctcttgttgcccaggctggagtgcaatggcacgatcttggctcactgcaacctctgcctcctgggttcaagcgattctcctgcctcagcttcccgagtagctgggattataggcatgtgccaccacgcctgactaattttgtatttttagaagagatagggtttctccatgttggtcaggctgatctcgagctcccgacctcaggtaatctgcgtgcctcagcctcccaaagtgctgggattacaggcatgaaccgccacccccagcctcatctgggattttgataaggattttgttgaatttatagatcaatttggagagcattgccagtaataagtcttttgatccatgaacatgggatagtttttcatttatgtaaacctttaatttcttttaacagtgttttgtagcttctagagtataagttttgcacttacttgaataaatttatttttgagtgtttttattctttttgatgttattgtaaattgaattattttcttaatctcatttttgggttgttcactgcaagtgtatagaaatataatagatttttgtatattggttttctatcctgcagccttgctgaacttgtttatcagttatcatagtgtcttagtagttcccttaggattttctaaagatcgtatcgcctgtaaatagagatctgttcttttttttggaggagtttgtgaagaactgatgttaatttatatttataagtttgaaagaatttcacagtgaaatcttctgggcctgggattttctttgtggatagtttcttggttgtcaattcagtctcttcccttgttatagctcattcaaattgtctctttcttcttgagtaaattttggtagttgatgttgtcctaggaacctgtccatttcatctaagttttctaatttgttggcacacatttgttcgtagtattcttttctaatccctcattagtaatgtcccctcttttatttctgattctagtaatttgagtcttacctcctttttgtcagtctagttaaaaggtttgttaacttggttgatcttttcaaagaactagcttttggttttatttatttttttccatttttctccttttgatttcattattttttgccataatctttattattttcttctttctggttgctaggaatgatatagctacaagccaaggagcacttagggttactgagaaccactggaagctggaagagacaagggaggattctttcctagagccttcacagggagcatggccctgtactcaccttgattgcaggtgtttagcctccagaactgggagaaaatacatttaagttgtgttaagccactcaatttgtggtagtttgttactgtaccctgaggaaactaatacaaacattttaattattttatttatttttttactgtatttatgtgagttactttttagtatctagggtttaacatgtgtgtcttaacttaccagaatatacttcatatttataatttaattctagttagataccaaaatgttattcctatgtagttctattgtcttcttccctttttgtggtatttttgtattatgtctattaatattacaaacccaaccatattattgttgtaattattatttttaaattttttaaaattttatttttaagttccctgttatattactttactatctgtagtaatttctttagcctagtaacagctttgttccaactctcttttgtgcagttatttgcaaatatattacaagtatatttctatatatgttataggttcaacaataggctttatatataatattttatgcaattgctttttaaatcatttcagagaagaaaggaaaaaatatgcattgttagtgtcatagttacagaataacctttactgctatgcttcaattttctgtgagaattcagattaccctctggggtcacttgttttcagcctgaagaacttcctgtggtgtttcttctaaggcaacaaattctctacttttgtttctctgggatgtctttatttcaccttcatttcctgccccccagcccttttttttgtggtaagatacatataaaatttaccattttaatcattaaacattttttgaaaagttttgtgctctcatgagccttggtcctgcacatctttctcctcctcagcagcaatctcgtttcctgcttaattattttttggttttgctttttgtttttgtttttgttttttcgagacagaatcttgctctgtcgcccaggctggaattcagtggcgcgatctcgactcactgcaatctctgcctcctgggttcaagcaattctcgtgtctcagtctcaccagtagctgggattataagtatatgccaccatgcctggctaatttttgtatttttagcagagacagggttttgccatgttggccaggctggtctcaaactcctggtctcaagtgatcgcctgcctcggcctcccaaagtgctggcattataggtgtgagccaccgtgcctggcctcctgcttaatcatttttaaattttttttattttttattttttgagacggagttttgctcttattgcccaggctagagtgcggtggcgcaatctcagctcactgcaacctccgccttctggtttcaagcaattctgctgcctcagcctcccaagtagctgggattacaggtgcccgccaccacacccagctaatttttttgtatttttagtagagacggggtttcaccatgttaatcatttttaagtatactgttcagtagtataaagtatatttgtattgttgtaccaccctcaccaccatctgtctccagaactctttttatcttgcaaaactgaaattctgtacccattcaacaataactccacgttactccctccctcagcccttggcaaccactgttttactttctatctctgaatttgactaccctaggtatttcatacaagtgaagtaatatggtatttgtccttttgtggctggcttatttcacttagcatagtgttctcaaggtttagccatgttgtagcatgtgtcagaatttcattcctttttaatactgaataaattccattgtgtatacatataccacattttatttatttgtcgatggacccttgggttgcttctaccttttggctattgtgaataatgctgctatgaacatggatgtacaaataactcttcaagaccctggtttcaatccttttggatgtatatttttgaaagacagctttgtcgtatataggaatctttattttttttctttgagcacttcaaatatgttatcattcattgtttctgatgagaggtcaactgtttctattattgtggttcttttataagtgatgttcttttgtaagtgaggttctcttataagttttcctctagctgctttcaatattttctctgtttttgacttacagcatttttaccatggtgtatctgtttgtggttctttttgtatttatcctacttggaattcattgagtttcttgattgtataggttattgctttaaaacaaaaatctaggaagttactggccatcatttgaatattttttcttcctctttctcatctgcttccggtactctcagtatgcatatgttaatgtgattaatggtgtgccacattttgctgagattctgtttatttttcttcattcttttttctttttatttttcatttgaataatgtctattgaagtatatttgtctcactaaatttttcttctgccagttcaaatatagtgttgaaccttctctagtgaattttaaattttagttattctacctttcaactccggaatttccattgtattatattttataatttctatgcctttattgatattctctatttggagtaatattgttatgatactttcctttccttttttaatcacgcttttctttaattctgtggacatatttataatggttactccaaagtctttttctgttaaatctgataactgtttgctctcacttgcagtttcccttgtctacttcccccgtgataccccatcctatcataaccacagaaagtatggttcatacttccttgtttcttttcatgcttcatatatatatgtgtgtctgtatatatgtatatatgtgtatgtgtatatacacacacgcgcgcacacacacacacacacatatatatatgtatattttttttttttttgaggtggagtctcactttgttgcccaggctggagttcagtggcgtgatctcggctcactgcaacctctgcctcctgggttcaagtgattccctgcctcagcctcccgagtagctgggattacaggcatccaccaccatgcctggctaatttttgtatttttagtagagacggggttttgccatattggccaggctggtctcgaactcctgacctagggtgatctgcccgcctcagcatcccaaagtgctgggattacagacataagctaccatgtccggcctgtatatatatattttttggttggaaactggacttttcagatactgtattgtaggaactctgggtattggcttcccacttctggagcctcttgttcttatttgtttagtgactgcatagattattttaatgaagttgatttccccctgtcttggttcatttgtcttgctataaaggaatacctgaggctggataatttataaagaaaaaaggtttattgggctcatggttttgtaggctgtacaagaagcatggcatcactatctgcttctggcgagggcttcaggctgcttccactcattgcataaagggaaggggaaccagtgagatcacatggtgagagaggaagcgagagatgggggaaagtgccaggctgtttttaataaccagttgttgtgggaactaagagtaagaactcactcattcctgcaagaatggcaccaaaccattcaggagggatatgccacccccatgactcagacaccttccaataaggccccacctccagtactggggaacaaatttcaacatgagactcggtggggccaaacaaaccatatccaaaccattaacaccctaacagggttaaaccccttatgttgctcctcaaggaggtacagctttgggtgtgcttattgtcagcctcaaatgacagtgatattgatagggctctcttcctaaacagttagcaaatttaacagctgttgaactccactaattgttagctggttgctctatttaacaatgccatggagcataaaaattgctctaaatactaatacaattaaattctggctcctttaaatagtttctaaagtaagcgtttgatattcttttttttttttttcttttgagacggagtctcgctctgtcacccaaggctggagtgcagtggcacaatctcggctcactgcaacttccacctcccaggttcaagtgattctcctgcctcagcctcctcagtagctgggattacaggcatgcaccatgacacccggctaattttttatatttttggtagagacggggtttcaccatgttggccaggctggtctcgaactcctgaccgtgtgatccacctgccccggcctcccaaagtgctgggattacaggtgtgagccactgcgtcaggtctttcccccaattttttactaaaaaaatgtcaaacctacagaaaagttgaaagaataatacagtgaattcccatatacctttcatctagttgaccaaagtgctggaattacaggcatgagccaccacgactggccttatagatcttagtttggcatcaagtgtaagaattctttacctcgccttacatcccaaagattttctatttttcctttttttttttttttttgagttggagttttgctcttgttgcccaggctggagtgcaatggtgtgatcttggctcaccgcaacctctgccccccgggttcaagcgattctcatgcctcagcctcccaagtagctgggattacaggcatgtgccaccacgtccagctaattttgtatttttagtagagatggggcttctccatgttgatccggctggtctcaaactcctgaccttaggtgatccacctgccttggcctcccaaagtgctgggattacgagcgtgagccaccgtgcgtggcctttttctaaatgttttatagatgtatatcttatgtttagtccttgagtcattttgagttaatttttctgtagggtgtgaggttcaggttcatctttttgcctatagatgtgcaatgactctacaccctttaatgagagacatatcttcccccgttgaagtgttttaacacctttgtcagaaatcatttgggcatatttgtgtgtgcttctttcttagttctctatttggttgcattgatctatagctgtccctctgtcaatatcacagtcttgattactgtagctatgtaagtcttgaaactggatagactgattcttcccactttatttttctttttcaaatttgttttagctactctagttcctttgcatatttccgtatacatttttgtatgatcttgtctatatctatgtaaaatttttctgggattttggtagtaataatgttatcctgtgtaataatttggataaaattggcatctttactatattaagttttccaacctataagcatggtatatttcacgctatttaagtcttctttgatttcttttatcagcgttttgtagttttcagcacacaagtcctgcacattttgttagatttatatgtaagtatttcatttttttcaggcaattaaaaacagtatttattatgtttttaattttagtacccatgtgcttattgctagtacatagagatacaatttttttttttttaaatagagatgtggtctcattatgctgctcaggctggagcacagcagctattcacaggcacaatcattgtgcattacagcctcaaactactgacctaaaacaatcctcctttgtccagctcaattgatttttgtatgttcatcatatatcctgaatcctaaagacttactgaattcacttagtagttttagtgtttttaaaattaggttattttgctttttttttttgagacggagtctcgttctctcacccaggctggagtgcggtggctcaacactgcaacctctgcctccgggttcaagtgattctcctgcctcagcctcctgagtagctgagactacacatgcctggctaatttatatattttttagtagagatggggtttcaccatgttggtcaggctggtctcaaactcctgaccttgtgatctgcctgcctcggcctcccaaagtggtgggattacaggcatgagccactgcgcttggctgctttgcatttaagaaaagtcatgctttattttattttttttgagatggagtctcactctgtcaccaggctggaatgcagtggcacccagctcactgcaacctctgcctcccttgttcaagcaattctcgtgcctcagcctcccaagtagctgggtctacaggtgcacgccaccacatcctgctaatttttgtattattagtggagacgggatttcactatgttgaccattctggtctcaaactcccgacctcaagttttctgctcgcctcagcctcctaaaatgctgggattacaggtatgagccactgtgcctggccaaaatcatgtgtttttaaactgacagataaaattgtgtgtatttatcatgtacaacatgatgttttggagtaatatacgttgtgctaattaacgtatgcattacttcacatagttatcatttttgtggtgagaacgcttaacacccactcttttagtattttcaagaatacaatatattaagtatagttaccatgttgtgcaataggtatcttgaacttactcctcctaactgaaatttggtatcctttgaccagcgtgtctccactgcccccctacccctagttgctttacattttctatgagacaatcatgtcatctgcaaacaggaacagttttatttcttctttgccaatctgcaggtctttcatttccctttcttatcgttttgcacaagttagaacttcagggctatgttaaataagagcaatgagagtgaacatccttgctttgttcctgatcgtaggggaaagcatttagtttttcaccattaagtataggttagctgtaagcttttgtagtcttttgtaagctttatcaagtcaaggaatttcccctttattcttatttttcttattagagtatcatgaatggatattggattttggcaaatgcttttttctgcattgattgatgtgattatgtagttttcctctttagtacgttcatatagtgggttaccttgttttcaaatgttgaaccagacttgcgtttctggaataagtcccacttgatcatggtgtataattatttttatatattgcttctacttgctaatattttgttaaggagtttaaggagttttgtgtctatactcatgaaggatattggtctgcagtttatttttgtttttttttcctttttattttccccaccaccctgcctggctaatttttgtattttagtagagacagggttttaccatgttggccaggctagtctcaaactcctgacctcaggtgatccaccagcgtcagcctcccaaagtgctgagattacaggtgtgagccactgcacctggcccagttttctttttttatactgcccttgtccagtgcttcttttttttttttttctgactgttcctgcagagcagagctacccataggcagtgtgtcaagagtagctgtccttatacagttctagtatcagagtaacacccacttcataaaatgaactgggagatgttcccttctcttcagttttctcaaagatgctatgtagagttggtggtaattcttcattaaacatttggtagaattcttcagtgaaaccatctgggcccagatatttgcttcttgagagttaaaaacattttttaaatccttattcttcaaacaaagttctatttttctgaagatatttttcacagtacatacatctctttagctgcaaaataatttgtcgtttttatttgttaaggaagggtataattaccttatctaatatttataaaatattaagtttaatgtttctgttttaagagtgttaaaattacaaattcaattttctcagtagttatcaggctatcccaattatctatttcatattgggtgagttgtggtaatttgtgttttttcagtaattagtccatttcatctacattgtcaaatttataatgtgtagagttgtttctaattatgctttcattctaataactggtaatccgtgtcttctttcttttttgtttgttagccttgctagaggtttgtcaattttattaatctttcgaagaatcagtactttgtttcactgattttctttattgtgtttctgttttcaattttactgatttatttttatattttctttcttttgcttgctttgggtttattttgctcttcatcttctgtgttcttgagatgggagtggagactattgatttgaaactttttctcttttctaatgtaaacatttagtgttataaatttccctctcagcattgctttaactatgtcccacaaattttgatattcttttttttttttttttttttgaggcagtctctgtcgcccaggctggcgtgcagtggcacaatcttggctcactgcaacctctgctgcctgtgttcaagcgattctcctacctcagcctcccaagtagctgggaccacaggctcccgccactgcgcttggctactttttgtagttttttagttgagacggggtttcaccatcttggccaggctggtctcgaactcctgatcttgtgatccaccagcctcggcctcccaaagtgctgggatcacaggcgtgagccaccgcacccagccatattcatttttagtcagtttatttcccttaagaaatttttaaaaatacattaaacaataaaaatgaatatcagaaatgaatatctttgacccacggatgattttagaaatgtgctgtccagttttcaagtatttggaggcttttctcgttatcctccagttacctctttctagtttgattccagtagagcacactctgtatgacttctattctttgaaatgtgttaagtttttaaaaagcgttagatataatccacataccatatgtttcacccacttaaaacgtacaattcaatggccttttttatatttgtagagttgcgccaacatcaccacaatcaattttggaacattttcattatcccaaaaagaaatcctacactctttaactgtcaccttctccctccccatgcagctcttccactgtccatccaagccttcggcaatcactagtgagctttgttttatggcccagggtagggtctaaggatatgttcagtgaatacttgaaaagaatgtttattttgctattgttgggtagagtgttccgtaaatgtctattagatcctgttgttcagtggtgttaagttcttctcaactccatgctgatttttttgtctagttgttctatcagttgttaagagagggtgttgaatctccaagcagaatgattgatttgcctgcttttctttcaggatcttttcttgatccttttattcctgtctcttgaaattttcttttctctgaagtctattttatgttattaatatagccactcctttcttttgattaatgttttcatgatatattttattcttttaatttcaaccaacatatgttggtatatttaaagcaggtttcttttttgtttttcaactgaggtggagtctcactctgtcgttcaggctggagtggcgcaatcttggcccactgctacctctgctgcccgggttcaagcagttcttgtgtcgcagcctcctgagtagttgggactacaggcgtgtgccaccatgcctggctaatttttttgtatttttagtagagatggggtattaccatgttgtccaggctggtctggaactcctgacctcaggtgatccacccgccttggcctcccgaagtgctgggattacaagtgtgagtcactgcactcagcccaaagcaggtttcttatagctatgtttttaaattaactctgctatctctgtcttttaattgatataattagatcatttacatttatgtaattattgataagttagggcttaagtctaccattttatttatgtttttaaaaaatttagtttgtcctcctctttttttctctttttgtcttgtcttcctgtagagtatttgaatattttttagaattccatttcaatttatctaaattgtttttggttattatctctttgtatagtgttgttagtggttgctgtattacattatatgtatatatatatatacacacacatatacacacatatatttatatatacttacgtgtgtgtgtgtatgtaacttttcacagtgttgtcattttaccacttcaatgaggtatagaaacctatactttccccatttataattctctgcatacatttagtagaagcacttcagacagggttataatttttgcttcaaccatcaatataatttagaagtcttaagaggagatagaaattttattgtaattacatgtatttttgcttactatgttatttctttcttcttgatgtttctggattccttctttcatcattttttggtctgttgcatgatcttccttttgccattcctttaggggagatctgctggcaacatattctcttattttgctttatctgagactgtcttgatttcccattgattcttgaaggatatttttactgaatctagaattttgtgttgacacttcttttctttcagcacttgaaaaccattgtgtcatttccttctggcttccttaatttctgtaagaaatctgttacttgaattgtttttcccttatacatgaagtgttgtttcactcactgctttcaagacgttttctcttttcgtcttttcagaagtttgactatgatgtattttggtgtggattttattgggctttttatttggggttcagcatttcgaatctataggtttatgtctcttgccaaatttgggaagttttcagctattattttttgaatacgtttccagctgtgccatctttgtctctttcctggaccctgatgacaagtgttagatcttttattttagtctcagaggtctttgagactttctccctcactccttccctccctccttcccttccttccttcctttctctttttccatcattcctcctgctgctcctcttttttcttctttattttttggccagtctattttctttctgttcttcatattgggtaatttctattattttctgttgaagttcactgattattttgtctgccccctccattctatgttgtctttccattcaatttggttactgtatttttcaattctaaaatttccattaaaatatgtatctatttttttgagatggagttttgctcttgttgcccaggctggagtgcaatgtgcaatggcgggatctcggctcaccgcaacctccacctcctgagttcaagcgattctcctgcctcggcctcctgagtagctaggattacaggcatgtgccaccatgactggctaattttgtatttttagtagagacggggtttctccatgttggtcaggctggtctcaaactcctgacctcaggtgatccgcctgcctcagcctcccaaagtgcagggattacaggctgtgagccactgcacctggccaaaatatatatcttttatttctttgccaagatttttttttcatttgtttcaagcacgtttgtagttgtttgttgaggctttttttttttttttttttttttttgggacgaagtcttgctctgttgcccaggctggagtgcggtggtgcgatctcggctcactgctcctcttcccaggttcatgccattctcctgcctcaggctcccgagtagctgggactacaggtgcccaccaccatgccttgctatttttttttgtatttttagtagagacggggtttcaccgtgttagccaggatggtctcgatctcctgatcttgtgatccacctgcctcggcctcccaaagtgctggggttacaggcgtgagccaccgcgcccagcctgttgaggcttatgatatgtgctttaacatcctttcaggtagttctaatatctgtgctctcttagtgctagtgtctgtcaattgtcttttctctctttcagtttgggatcttcctgactcttggtataaatgatcctcaatgaaaacttcaacgatttgggtattacgttatcagactctagaccttatttaaacctgttttgaacaccattgtagtagaagaagggggacatcagcttgttacttctagatgggggtaaatatccaggctttccgctctgcttccattgacacccaatggggtgggggacccctgttgctgctgggtggttgtgggtattctggttccctacttggcctccctgatacctccctggctaggaggggtaggagtgcctactgcttgccacagtgctttcactgtcaccatgggggaagagggaggaaaggtggcctcattatctctgggaaaaggttaagtcactgaatctccactaggcctcctctgacatgaccccagcagggagggcctcatcactcctgggtgggagtggaagtccaggttcccctgacactgctggcgggtgagggatgggctccttactactgccatgcagggataaaagtcgcagtccttactcagccttggtgggggtgttgggtaccttggtacgtcctcacaagactggaagtctaggctccctgctcagttattgctggtaaatgggcagttactgtctaaatgtgttccatctcattagactgtctccttcctggtcctttggctagagagggcaggcttttcttggggcttttcaatctgtgccccttggtgttttgaagttgcctgctgcttcagctccaagtctgagataatgaagcaaaaagaagacccagtgaacccatcactgggttgttctgtgggcctcaaggcacctggatagtctgcctcctcttccccttccagaaccttcttatatttgttttatatctagtgttgagggtttttattaccacttactgggaagaacagggaaaagtatgtctgctctgtccctggagctcaagtccacaacttgcttttcgtttgtttttaaataattagttttgtttttaaatgaaactgagttttctttggagaggccaagcaagtttctttggagaggccaagcaagttgtctggtggagcgtctcatggtcagaagctgtccagttcttcccttgtgattagcttcaaacagttttggcgagaagctgtgtgggcgatgctgtgtagctcccacatcacaaggaggcacatagtgttgtggggcctggctgggggtcacaggaagcttgatcacatcttccttcctgtatctaataaattatctgtggtgtgaaactctgagatcatgtgagcatcctcttcccaagcagccttttactcagtggttttagcatgtctaggtgaatatattaaggtttacaaaatgataatttttctaattctctcatttcctttacatttattagctggtattcttccatgaagaagagctttatccaaagccacatccttttgttctctttttagtaccaatatgtattttaattcatgttttataattcattactgtcatgtttttcttgaaattgttccacgcggggcaaagtgagctccttctggttcactcttaggtccatttaacatgactctgttaatctttgggcagttccttgatttctgggcaacatgggatgtcccagactcaccattttcatttcatagtccacacctagaatcagctatttccccaaggagccctgcttccttttagtaaggaatggtatttagaaatgcaaataaatttccaagggagaagagttttctaagggaagataaagtattgaattatagtagttactcgtagtcacaactgctactgtattcttggtgacttaggccctcgtttgaagttagggaggtagagcttcatgtgacagtgatttgtgtgcctgtgtctcctctatctggctgactttcttgggagccaggagagtatcttttcaatttttatattcacagtatttagcactgtttctggaacagaggaggatttaataactatttggacttaaattgtgctaaacagactcctaagctgtgcatcatagaatccaagaatttttctaatgttctgcctgtgtggagaagagtaaggatcttctccacacagtggagaacatttctcacagtggaaatgttcataggccctgggcagattattcagtgtttcagaacttgtttctcttgctgaatgggaagcattttattggcttcagcatgctaaaaaaaaggctataacaagatctgaggctgttcttacgaggtagtggtaaagtatgggtatgggattcagtttgaacatttagagaaggtgactttgtaatctgtatatagctcaccctggaggtgaatggtactggttttcagcctctacttgggagatgtgtgtttcttcttttgctgactctgctactatatagttttatgacctttaagtcagtcagttgctcaatttcttttccttattttcatctggaaaagagcgtgatggtgttttgaattaagatataataagaaaaacatataaaacccttggatatgtagcaataaaatgaaagaagatgtattataagcacagaacttggccattatgagtagcaacaaaggaagcctagtgtcaggtcctagggtttgtttttatttgaaggagctgtatgtggcattttaataagggttccaaatgaaagggtagtttcaggctgagtctagctttgagactataatgataatgggactgtaaagttatattaaagtgggtttaggcagaaggcacatgaaaagtacatttatttataaccgcattttgagtgaagggatagaacctaaaaggaaagactaaaatattcaacatggtatttatcaagtaaagggtgtgctcacgcacatgcgtgcatgtgtgctgtgtgtgtttatgatgaataagaactcttttattccatcaccatttgtttaaacatgaagtttaaagaaatgctttatttcctgaattttctttttccaaaaagtaattcttgcttggggtaaaaattacaagcagtatagatatacaacttagtaaaacatctcaatattctgctgatagttttgtttctgttctttcagatgttttctgtgcacacactagatttttttttccagaaattagctcatactgactatcataagcccatcctgctgctgcttgagtttgttttcacgtaacacacagctttttatgtccatctgtggacatccatatcactctttttgatggttgaatgatgggtacataccctcatgtacccagtatcctattgagacatatggattatttcttgttttttgctattataaacaatgctgcagtaaataccattttgtgtgtgtatctgctgtctcatgtactttggattgatatctaagagtggaattactgaaacaaaagttgtggatatttatgttttgccagttgttctaaagagttggttaatttgcagggctgaggattcctcatctcagatgacataaggttcttgttatactctctaagtgccctgagtttctctctcacatatggtggctgtaatcagtgggcattacaggtgcctttgagatggtgtgacccttccagggacatctgtatcccacagaatgtctaagttggtacatcctagctctcagcacgttcctcctactgagcccagacttggcagggttggccaggtgtgtgcttatagtttgtggtttgagactgtggcagtttttcctgctttatctgagatgatgcttttctaccctgtttatcagtagtgttttttgggctgggggaggtcacaggtgaggtgatgcaaaataactcctactcttgttttcaactggaaactaatttatatcttattttgttgtatctggcttttcctccccctctgttaattggaagatatgcttatctttctcagtttatcgacttgagaaagaaatcttttggttatacctttctaaaaaaaaaaaaaaccattagcatagtaatattacttcacacttcctgtaccttaatctccagtttttgtgacgctttgagaattcttttttaaaaatttaagttttaatttttttagagacagtttcttgccgtgttgcctaggctgagtcttgaactctggtctcaagtgatccttccacctcagcctcctgagtagctgggattgcagatttgagccacagtgcctggcagagtttttgttattattatcaaattaatattatttttacattattaattttttctttctaggcttcttaaaattatatctaattttctatccatagttaacccagaccatgagatttaattctatttagatttaattctgtgcctaactggaactggtactactgctagttcattcattgataacattgaatactctgaactatgccctgttctatgtcctagggataaagaaatgaataaatagacagaaatccctgcccctctggagtttatgtactagagggggtggcaaacaatgtaataaatgagtaagtcttagaatacgttagaagagaacaagtgctaaattgtaagaataaaagtggaatagggtgagtgaggtccatggggtcaaggggagtatgtagaatttaaatagggtagtcagggagggccccattgagatgctgacatttgagcaatgacctagagtaggtaagggagttaactcactgcaggtggaggaggcggccagagccaagactcaaggagtcgccttcctgatgtacaggaggggcagtgaggaggccagggctgctagggtatgcaggagacacgtcacaaggatccggagggcacgtggggtggggggtgggaagggctttgtagaccagtgcgcactggagggctctgacttgggtgttgatgtggtcactctgctatgctgagagcagactccaggggacaagactgggaggagggaaaggtgctgactattgcaggaaagccgggcgagagatgttggtagatgggaccagactgatttgaagctatgaagttcccattaatgagcacattaagtacatttaactttcagtgggctggattaggactacatttttcttaaggattcttgagtatgagaatgcttgtgttctttcatgttgtaaatgcttgtgttctttcatgtctttcatggcttttgcagcctttaaataatgcgtgacattctaacttggtaaagatgtgttgggtcactttctctcccttctggctcagtaggcagcattcttttgtcttcagactccagtgttctggagaagactgcagatggtctgcctttttccgcattatgggtcacccacttctttctctgtgttggtagaatcaccagccttgctagatgtgtcttgtgctggttggactctactgatttttcttggcatatgctaaaccctttcaagctatagattcagttactcaatttcaggaaagttttccggtgttatatcttaaattttcttttcctgtgccatttgttttgttctgttcagaattagcagttgtgtgtctgttggatctttatctctcgtatctaacttttttttttgagatggagtctcactctgtcacccaggctggagtgcagtggcgtgatctcggctcactgcaagctccgtctcccaggttcatgccattctcctgcctcagtctcccgagtagttgggactacaggtgcctgccaccacgcctggctaattttttgtatttttagtagagatggggtttcaccgtgttagccaggatggtctcgatctcctgaccctgtggtccccccgcctcagcctctaacatctttttaatcacttttatggatttcctatattccatttccccaaatgaatgtccgctttcactgacttcttcagcaattccacttcacttcttacccttcttcacgtaatgttcatcagataatggtgttagtgcttttctccattggtgtccttgactcatccgttaccttccttcagtaaggagcagggcccacagggaaggatattccttgctttaacctctcactaagctgagataaatttgaatacggctcaagatctagagaaatgagtctttttttttttttttgagacagagtcttgctctgtcacccaggctggagtgcagtggcgtgatctcggctcactgcaagctccgcttcctgggttcacgccattctcctgcctcagcttcccaagtagctgggactacaggcacctgccaccacgcccggctaattttttgtatttttagtagagactgggtttcactgtgttagccagtatggtctcaatctcctgacctcgtgatctgtccgcctcggcctcccaaagtgctgggattacaggtgtgagccactgcgcccagccgagaagtgagtcttgattcttgtcatcttccctcgattttgttcagcaaattcctgtctcagaaatagcctttgtgtttgttgctcagggttgaggcccttctctactttcattataggttgaatttccttctctgttttgactttaatagaaggggagagtagatattttttcttttgtaagaattcccagggccaggcgcggtggctcacgcctgtaatcccagcactttggagcctgaggtgggtggattgcttgagcctaggagtttgacattagcctgggcaacatagtgagaccctgtatatacaaaaattagcatgatggcacgtgcctgtagtcccagctactcaggaggctgaggtgggaggattgcttgaacccaggaggtcgaggctgcagtcagctgagatcataccatggcattccagcctggatgacagagtgagaccctgtctcagaaaagaaaaaaaaaaattcccagacatatcgcttaaaaattatcttttgtgaaaaataatatattacagtatataaaattcaacatgtttaacggggaaggagggaaaagaagattatcttctgcccctgtcccttagctcccagttcccagccccaggaagcacaaccatatagaacacattcctagagtggaattgctttgtcaaaggatatatgcacttgtacatttgatagacgctgccagattgctttccatagaagccatcagtatatatatgctatcagcaaaaaatgagagtgccagtctcctcacattctcaccaacatgatgatgtttgaagtttttcaaatttttgccattctaataggtaaaatagatttgaaagttttattttgcatttcctgttaatacaggtggttgaggagccaggtgcggtggggcacacctgtagtcctggtactatcatttgagcccaggagtttgagcctaacctgggcaacatcgtgagaccctgtctctcaaaaaataaataagtaaaagtcagtctgagcatcttatgtgccgaagagccatttgtattctctgtgaactacctgttcattacctgtcacatttttattttgggttagtggtggtttttttgttgggtttatataggtactctttatgtgtaggaaaattaactctgtctggatatgagtcaagttttgttttcccagttcattcagctatgattatttagctgtgtttgtgctatgttttaggcatgtagaaagatttggtttgtatgtaggtgattttctcttttataacttcagggtttttatattataggcattccccatcctaagagtccgaggattctacggtgttttcttctgctaattatactattttcatttttttcttttctttctttatttttatttatttattaatttttttgagttgaagttttgctcttgttgcccaggctggagtgcaatatctcagctcaccgcaacctgtgcctcccagattaaagctattctcctgcctcagcctcccaagtagctgggattacaggcatgtgccaccatgcctggctaattttgtatttttagtagagatggggtttctccatgttgctcaggctggtctcgaactcccgacctcaggtgatctgcccaccttggcctcccaaagtgctgggattacaggtgtgagccaccgcccctggccaatttttttcttttaaatatttggtgctcctcaccaacatggcacatgtatacctatgtaataaacctgcatgttgtgcacacgtaccctagaacttaaaactataattaaaataaataaatatttggtgctccttcagttactcctggtgttaggagtaaggtagggtgcccaactgtgtttttcctgatgcctatcctgctgtctgaacaccatttgttggttcctttggaatactagatttatcgtatattaaattcctgtatatgtttgaacctaattcttggtctagtccatgtctgtttgtctattcatgtaccaatatcaaaccttttaaaatttaggcttaaaatattttttaaaatgcaaattcaataaaatcattttggagagaagtcttattggaatatttcagtagttccttcacagtaagatgttgtagatcattcttctgagcacaatctgctattcattgttagggcatgtgtttagttacctactttgaattgattttgctgaaagaagtaaggattcttgggtggtctttctatattctcctaccctggctccttggtaatgtggaaaatgaattttcaggtaaaattgtcagaggacagtaggatggtttttgttctggagtatattaacatgaactggcccaacttaggctcacatttgataacttcatgttagtaagcatcctcctttggttaaataaactggctgtggatattctccagggaaaaagttactagtaactcttagaaaactaatgcatacatgagctggtaaagaggaacttcttaaagcacaattttagagttatagaagcatatatttgttgttatgatcttgcaagtttgctaactgctttactgaaaatagcgtgcatggaaaaacatagcatagtaggtcccaaataagcacttggttctttctttctttctttctttttctttctttctttctttctttctttctttctttctttctttctttctttctttctttctttctttctttccttctttccttctttccttctttccttctttccttctttctttccttctccttcagacagagtcttgctttgttactcaggctggagtgcagtggtgcaatcttggcccactgcaacctctgcctcctgggttcaagcaattctcctgactcagcctcctgagtagctggggttacagggacctgccaccatgcctggataatttctgtatttttagtagagacaggtttcaccatgttggccaggctggtcttgaactcttgacctcaagtgatctgcctgcctcggcctcccagagtgctaggattacaggtgtgagccactgtgcccagctagcacttggttatttctttaaaaaatcaaatttaaattctgtcctgaatttgttatatgctttcttttaaaatgtatgtttaggtaaacatctgttttagggctttttcttcctttgaatttttttcctttatttgttcattcaacaaatattaattacttgctctgtgctagacagcgttttaggtactgatattcagcagacaaggatcttgcttttattgagtttataatctagtgggggagatcagcaataaataagttgtcaggatgtgattagttttatggagaaaatcaagtagggtggggtgaaagtgactcactttgggggcagcatccagtagcattagttaccttttattagaaaggcagcatgggaaaatagaagcatggacttcagagtttgatacgttcctgtacaaatctcagattttctacatgcaggttgtgtggccctgagcaaattacctaacctctctgacccccatttccccaactgtccaaaggggagagaagaatacctgactcatagtgggttattaaggattaaatgtgacaacttcaacaaaaaaaccctagaagaatgtttgacctgtaatagtcactttataaatagcagctaaaatattatcacttcatcactttattcattaaaagtttttaagaagtttctccattatttcattagtttcaatatcatgtgcctagtaagatggtaggttttaacaaaagcacccttaaatagccatttgtgccaaatgtcaccatagtgactgctaaaatgggggaaccgcaggtattactgtattcatttccatgaattgtcatagtttaatgttcatctacagttggtcatgttttgttgaggtcctaacagaaaaggaactacatttgtattgaacattgtattagaacaaattttaatacctctgaaaggtcatacatcaaagaatctagaccaaaaaccagagttctagctcagaaacaccagcactaccactgttttatctgtcccacattgaggaatatgacagactctggttcaaagataccttaacgccttatccatactactagaggcccaggctgagattctcctagaccacaggctgggagcagtgacatctccaagataccaagtctgtcagggtcactgatggagatttccatagaggaggttctcaggcctaactgaaggcatcacttcttagatacgtggcccaatcaaacactatccaaggaaggagcatggactctagagaggtttgggaacagggtagcagatatgccagaatgctgaaacctggaacaggccaggaagacaaaacagcagtctgcatgtagcaaaaagagaaggtaggaaggtacaggtaacaacaaaatggatttgaggtgagaatctcaatgtgaggtcacatctatattcctaacacacacagtttgttacctatgcgtttgccctagagacaggaccacactaaatagcacccattctttcttattttccttatccctcaaacaaagaagtgtccctctcttggccccaagtcaatgggtaagggattctgccaagacctttgtcaactatcccctatcatttatgttttttacctctccctgtctactgatttattctccctctacctcaaaacatgcttatatggttcctttctttaaaaaagaattccaccgaaatttcctactctgacctctaactcaatagttaaagttcctttcatggctcacttttcagggggaatctgactccacttcttttacctttcaattcctccttaattctgtgatcttcctctattcttgctaaagtcatgaccatctatgggtatgttcattgcctgttggacatttgaatgtctcaggcatttcaagttcagcattaattgaaccccctatccacttccacagtgtgatgatttttaaatatatccacaaattctttgacacttcttatttcaagaggtggagcttagttccctttctaactaatggaataaggcagaagtgagagtgttaggagtaggtccatagtgttaggagtaggagtaggaagaacactgtggcttcctccttgctctctctctcagatcactcatgctgagagaagccaactgccagatggggaggatgttccagcaatgctatagagaggctcacttggcaatgaattgagatctcctgccaacaaccagcactgccttgtcaggcaggtgagtgaactccttggaagtggaccctccggccccagttgagccttcagatgatgcaaccccagctgacatcttgattgcaacctcttgagaaactctgagccagaaccagccagctaagcctatcttagattcctggcccacagaaactgggagataagcctttgtgttttaagctgctaaatggttgtcagtgattggctacacaccagtatataaccaatacacacggcaaaccttccgtattcccagtcgtagggaaagcaaggaaacaactccttcctctccaagatacaactggtgatcaagtcctgttattttcatctaggtatctgttgattcagcctgttctgatttttctagtcactctgtcagtttattatttatcatctagactgtttcagttgcctcttaacaagtttcttgcctccagcttcactctcttttaatctattccccatactgccataaaaaatcattctaaaatgtgaatttgagcatctttcttctttgattgaattgtccccattgactagagttaatcaagcccagtcatcttaagcaatgcaggcaaagctgtttgaggtttcatcccaccatgctttccagctcctgtctctcctgcagcagggtgttcagccatcaaaaatagccggtgggtcccagaatctcccacggcttttcttctttctgtgatttggtgtgtgcagttctctctagttttggaaggctttcaccaactgtttgacgctttctctattttctgaaagttaggcattcctcctttcttctgcagtccccaggggatacctgtgtaattgctgtgatcacatcactgtcattgtttgtctctcaatgtctgtttttcagttagaccaagaatcccactagatgagggtcgatgctctgttcatctcttttttgttgttgttcttgcgtatctgatcttttaaaatgtttgatattctttttctttttttggggggggtggtgtcttgctctgtcatctgggctggagtacagtggtgcaatcatggctcactgcagccttgacctcctgggctcaagcaagcctcccacctcagcctccctaggagtgcacctccacagctggctaatttttgtattttctgtagagacagggtttcaccatgttacccaggctagtctcgaactcctgggcttgatattctttttttattttactgtggtaagaacacttaaccacatttgtggatctactacatttgttaatctacccttaacaaatttttaagtgtacaatacattattgttgactctaggtacagtgttgtacagctgatcttgagagcttattcatcttacttaactgcaacgttatgttcgttgattagtaactcctcgtttcccgccctgcagctccaggtaacctccattgtactctttgattctatgaatttgtctatttttggtatctcatataagtggagtcgtgcagtatttgtctttctatgactgccttatttcattagcaaaatgtcctcaagattcatccatgctgttgcatgttatagaatttccttttttttttttagaggctgaatagtactccatggtatgtatataccacatattgtctaccccttcatccactgatgggcatttagttgtttccacatcttggttttactctttgaggaacctgcatactcttttccacagcagctgctccattttacattctcataaacagtgcacaaaagttccagtttctctacatcctcaccaatacttgctgtcttttgattttttggtaatagtcatcctgacaatgtgcgttctgttcattttaagtctctagcaactaatgggatatttgaacagggtgtctgaaacttttagtctagcagatagggaatttcacattagcagagtcagaatataaaaatgtaactttacctctctatacatgatcataacttcactctctagccattgtttttcactaaaggcagtgaagagtctttggggatgagggttctggccccgtcactgatgctttcattggccatgaaggctttgctggttgttggtgccatccatttctctgtgttcccttttctctttatgttagtcccactgggccccctccgttctgactgtgagagttctccaggcttgcaggcttgtgctcagctgtttcagtgcctctctggagcatgcaccttgggaagtgctatgtgggtctcagacccaccctcctggtgcaggggcctgcttagggctgagcctctttaggaggactgcactctgggaagaaccaatgatgtgtctgggatttctgttagctagatctctcataaattccaagtcttagtttgggatggaaagaggtagaggatctggacttttcagagacttagtagcatctttaaaagaaaaatacttagttcttccagtggaaagctgtgggttccaagagatatctgctgtgcatttatgggcctattttagagcagaataccaaaatattcaccataattttaaaaataaatattaaataattaaaaaattggtacagcctgccaggagctcagtgtgcaatggtgacatccagcctgtgaggccacctggtgcggcttgggaacccgcagaagcctgcactgaagcccagcaaacccctcatcctagctaaccgcagcaaggactggcgtccggagaagggcgaggccgcttgtatcatggagtgtcagcttgctggaagccgaatgaattccgcgatgatatgtgcagaaaagagatccagggctttttcgattgtgcttcaagggattaggaagcctaaaaaatgagatcaatacaggagaccctgggagagtctgggagtttacctcccaataaatagagtaagttgtcatagaggtttcctaagacacctcacctaagcttaaaatggaaaagcattttcaatgatttctggactatagcttctgacaattatgcagaggcattttatagatgtttgcattgctgtgacctctttgaaggataagatgaggaaaaacactttttctaacctttggaatcaatagtatgggtagaagttatgttttatcttgaaataaaatcctctgaagagaaaaaaataattaaaaaattaattatacttgttttatatttataggagagatcttattgttggtgatctttgatagtatctatagcccaggacaaatttccagagcccttccatttctttccttattctgtttccattgaaatagaaagccgaaaccagaattagaggtcatcaggaatgatgatgagtgtttttgctctaactgatcaatctggatatgcattcagattaaatatggatgtagagattctagtgaaatttttttactgaaggccactttcagcattctttcagctgctgagttaacaagcatatcaaactaaaaaacagaaaggttggccgggtgcggtggctcatgcctgtaatcccagcactttgggaggccgaggcaggtggatcacgaggtcaggagatcaagaccatcctggctaacacggtgaaaccccatctctactaaaaatgcaaaaaagtagccgggcgtggtggcgggcgcctatagtcccagctactcgggaggctgaggcaggagaatggcgtgaacccgggaggcagagcttgcagtgagccaagatcacgccactgcactccagcctgggcaacagagtgagactccatctcaaaacaaacaaacaacaacaacaacagcaaaaaacaggaaggttaagtgttttttgtttgtttttgtttttgagacagggtctctctctgtcactcaggctgtggcgcagcatgaccacggctcactgcagtcttgatctcctgggctcaagcagtcctcctacttcagcttccagagtagctgggattacaagcatctgccaccatgcctggttaatttttttttttttttgtagagacagagttttgctatgttgctcaggctggtcttgagctcctggcctcaagcaatccacctgccttggcctcccaaagtgctgagattacagatgtgagccaccacacccagtccaagtgtttctatttagttgataatggtgagtagattcctaatccactctttgattgcatttgattctggaaaatgtttctttatatcattttgcagcatttcagtgtagtttttaaatatgccaatcatgtatcaaaaaatatatttctttaatttgtgaagaaaactgtcaactctcggggaagtcaaactcgtggagatttagctgcctacattgcagtttggtcatatcatcaaggtatcataacagcattaaaaaatcatggtattttggttaagattcaggctgttccagataatgattactgaaatatactacttgagtgaatcacctgagatcacagaaatggtctttatcagccttatcaaagtcatgaagaaacagttttttcctcattttaaatattcttcattttaaatatccttgcgagcacctttctccttagtatcacatgtatttcagtatggaaaagcagaccctgggactcactgtccatactgcatgttgaaaagcctgattgtccatgactgtagtgcgacttaaaatgtttatccagctgggtacagtggctcatgcttgtaatcccagcactttgggaggccaaggaaggaggatcacttgagtccaggagtttgagggaggatcacttgagcccagggtttgagaccagtctgggcaacatggtgagacccccatctctataaaaaatttaaaaattagctgggcatggtggtgcgtgcctgtagtcccagctactcaggaagtttaggtgggaggatcgctggggcctgggtgattgaggctacagtgagctgtgatcatgccaccgtactccagcctgggcaacaaagtgagaccgtgtatttaaaaaaaagtttattcattttttagcattgaatgaagattagattatttagattagcggtccccaacctttttggcaccagggactggttttgtgggagaatttttccgtgaactggggtggggggattgttttggaatgattcagccacattacatttattgttcactttatttcttttttttttttttttttttttgagacagagtatcgctctgtcgcccaggctggagtgcagtggcgtgatctcggcttacctcaagctctgcctcccaggttcacaccattctcctgcctcagcctctcgagtagctgggactacaggtgcccaccaccacacccggctaatttttttttgaatttttagtagacggggtttcaccgttttagccaggatggtctcgatctcctgacctcgtgatccgcctgccttggcctcccgaagtgctgggattacaggtgtgagccaccacgcctggcctattgtgcctttatttctattattattacattgtaatatagaatgaaataatgatacaactcactgtaatatagaatcaatgggagccctgaggttgttttcctgcaactagatgttcccatctcagggtgatggaagacagtgacagatcttccggcattagagtctcataaagagcggaaaacctacatcccttgcatgctcagttcacaatagggttcatggtcctatgagaatctaatgacatcactgatctgacgggaggtgaagcccaggtggtaatgctcgcttgcctattgctcacctcctgctgtgtggcccggttcctaacaggctatgaactgggggttggggacccctgatttagatcatcaactctgctctgaggaaaacagcagtgttgtagactggcatgaagtgcaacttcttctactctatgtagcaaccccttttctttctggtcctccttcactttagatccctgagacccttttccacattgtaccttggtcgttgtatatgaacatcaaacatgaaaggtgctagtgagatcccatctctatagaaaatttaaaaaattagctgggcatggtgggcctgtagtcccagctacttgggaggctaaggcaggaggatcccttgagcccaggagtttcaggttgcagtgagctctgatcgtgccactgcactccagcctgtgtgacagagcaagggcctgtctctaaaaacaaaacaaaacaaagcaaaacaaacatgagaagtgctgattcataccttgcaaagaggtttcattcggcagcaagttgaaattatctactggtttgtacatgagctagcacttcctcttccacatggcatgccattgatgttccttgatgtttagtgttatttgatagaggaatttgctaacaccttgttctcttttctctttgatgaaaatgtttatcattaactttggggctcttctaaagaatgttccattagtatgtgtttgtacctttttttttggcctctgaagagtgcagctttcaatgacgcctctatagttgtggtcttttccttttggtaatgaagtgcatcagttttgcactgagaaatgttattttgcccttgaggaataacttggttggtttactaaagagaccatcaaactttgaaagtgacatggaaagcttatgcggtttctacaactatttcagaagcttcataaatgctaaagcgtctgggctgggctcagtggctcatgtctgtaatcccaatgctttgggaagctgaggcaggaggtttgtttgaggccaggagttctagaccagcccgggtaacacagtgagactccgactctacaaaaaataaaaaaatttaaaaagaaacccacaaaaacaaaaaaacaatagaggactctgactttaggagcaaatgaatccagtgtctgataaattccaattttttaattattcaccattgtgctttctatgtgtacttcccttctttaactgcctgggtggtacatctcttgacatataggatatgtgtctttctggcttgcagtttagttccagtcaatagtgagcctcctaattgttcagagttgtatttatgccactcaccatgtgacttttatacttcatcaaatcattttgctctgtcaatccttctgaactgatgtgatggtacaaaatagaaaaagatggaaactgctaattttaacagatataaacataaacacgtacataaacaccagtgcatacatattacgaaaatatattgtgtaaaagcagtaacttgtaggactaagattaactactgtgttagtagtgcaagtatacatttcaaacttaatgattatataaagaatgaaacaggatatcagtgaccataatacctttaacatttcaaatttgtgaaatatatgtgaacaaaattgtttcatttatttctttgtttctttttgagacagagtctcactctgccacccaggctggagagcagtggcgcgatctcggctcactgcaacctccatctcccaggttcaagcaattctcctgcctcagcctcctgagtagctgggattacaggtgcccgccaccacgcccggctaatttttgtatttttagtagagacagtgtttcaccatgttggccagactggcctggaactcctgacctcaagtgacccactcacctcggcctcccaaagtgctgggattacaggtatgagccaccatacttggcccatttgtttcttttgaaataggaattcccagtgtagcttttgttgaacttccatgggcctctacatgtcctccatctgcaggttgtatgtacattgggctgtagccatttggtggcaaggaccatggtagaggccagtctgagagtgcacctggtagatccttaaagatgcaacctttgggaaccttgaacctttgattgctataaacaagtaaatcccctagttgatcatcactcaggaatcttggctaagcaaggcctatgaggaaattgatttcttgacagatacatttggaaggtctttaagttattctccttaccaatcacataaattttttaatgttttctataacttactgacttcagtcccatttttctttcatttattcaacaaatatgtattaagggcttgctgtgtgctaggcactctgaaagacaagacagcatttttgccctcttggaactaatgctttgtatatattattttctcctgtatcatatccagtttacactttgctacttacttttctatttttcctttttcttacctattatgtttcagatccataaactattttgtctatgtctttatttcaaattattttgtggccgggcacggtggctcacgtctgtaatcccagcagtttgggaggccgaggcgggtggattaggagatcaagaccatcctggctagcacggtgaaaccccgtctctgctaaaaaaatacaaaaaattagccaggcatggcggtgggcacctgtagtcccagctactcgagaggctgaggcaggagaatggcgtgaacctgggaggcagagcttgaggtaagccgagatcacgccactgcactccagcctgggtgacagagcaagactctgtcgtcaaaaaaaaaaaaaaaaaaattttgttctccagtctaaacataccgtaacagtcgtagcattaacctttgtgcattaaaacgcttaacatttccatccaaaaaatttcaggtatttttattttaaaattaaacaggttctccctctttcatccaggctgaagtgcagtggtgtgatcacggctcaccacagccttgaactcctgtgctcacgtgatcctcccacctcagcctcccaagtagttgggactacaggcatgtgccactgtgcctggctaatttttaaaaactttttttagagatggggccttgctatgatgcccaggctagtttcaaactcctgagctcaagtgatcctcctgcctcagcttcccaaagtgcttccccactggcatgagccaccataccaggtcaaaatttcacgtataacacaagaaatacattttttttttttttgagatgtagtctcaatctgtcacccaggctggagtgcactggtgggatctcggctcactgcaacctctgccacctgggttcaagtgagtctcctgcctcagcctcccgagtagcaaggattacaggtgcacgctaccatctcggctaatttttgtatttttagtggagacagggtttcgtcatgttggccaggctggtctcgaactcctgacctcaagtgatctgcccaccacagcctcctaaagtgctggaattacaggcataagccaccgtgcccagccaagaaacgcattcttataaaaagccaaatatatagatatagagtaaatatgaagtcactccttataattcccatcccaactgcctctcaagagccatgaaagagactattttctatatttttgctaatagtcttatctcttcttaaaatgttagtctgcaagatgggtttaaaaatacctcattgctttagctcatattggttgctattagatgggttaagcatcttttcttatgtttagcagtcatttggatttttgtgaattgccttttcatatcctttgccttttttctgttggactgtttgtttcttcttgagttaattttggtattctatgttttcctagaaaatgatctgctttgcctagtttacaaatccttatatgtaattacgttctctttcttgttcctaatttgggtaccttccttttttctttcttgattagatttgccagaggttctatcttgttagtcctttcaaagcatcagcttttcattttattaatcttcaaggtcatttaaaaaatgttttctgtttaattaattgccgtttttatctttattcattcttcatcctgctttctgtggactcagagaagacccgttcatgtagaggaaggtgggaacaaaggttcaaagatagttgtcgagggtcaggaaaacaattgttggcatcattctccttcacctcctcactcccaactgccatcacaaacacaggcagttcagaatccatcaagaaatgagtcaggaatcaggcagactgaatcagactatcagctttgttaataaggctgaagtagagagtagtgcttgacctaagatcacagtcaggctagtaacccttccctctgagttaaacttagccaacagaataaggcatttagaataaacgctttgagaggtttgaaaagaagacagttggaaatgaataaaacaatcacttagaggtgctgagggccaaatggcctcagggcagttcggtttttcagttctgtttggagacctagatcaggaacaaagaaaaatgagttggcagtctctggctggtggctgagtaagcagggccagagttggcagaaggaggtgatcttggggtttcagactagtcagtgaggcaagtgagaccagcagggcatggaaaaaaccacgaagagacaggagtcggggcttcagcttcttgtgagcatgcaaacccagctcggagggagtgtgatgctgggacagccaaaagaggagcagctgggggccagagaagggcattgcacatccagaaccctgatggcaggagagtcagagaacgggcacaccaccaagtgtgatgaaacttgtgggggattgacgatgagtcattcttcagactctctgggactcttgttctttccccaaattagtttaacatctgctttggaatcaaaagggtaactgcttttctctttctggctaattaaacaaatgcaaatgtatgcatagccttattgtatcctcacacagcctgggagggaagcacagtgtgggtggcaggtacatgacgctagaagcagagggtgtttagtgctggggtgggaggacagcaggaggatctgtcccagcgccagacgtcttccatccctacgggacctctcaaggtcatgctacatgaccttcggcatatgaattcacctggcaccacagtattgttcttaaaactgaaaatgtaccagcgtattgtaacttgtaagcccacaaacttcttgtttctagccatgtacttacagaaagcccttgcctttatgttttcacagggagggcatgatgaaccttgtcttatagctcatgagaaggccaacttcactaaccactccttgccgggtgtggtatgtttccctctgtaattacttctccctgtgtactttcttatggtaaaatgtcatgcttcagaacaaaattaaaaagtcatctaaagagatggtttggttatcatggaagtcaagttcctcttagtagaaatgagcagttatagtcagactttatagatactagaaagaagagcaatgtatttctaaactacatgcttgtgtcaaatttcagattttgtttaacaatttgtatattaatcatgatctaacccacctgttttggaagaaccctctcaaactgggtttttcctctgctctcacaccacaacaacagtcatcaacacggaaaaagacttctgtgaccaaatgtatgggggtttctctatagaagtagtggacaccagctaggtgttctccagttcaactctgacgctgtctacctggagagagcatcagatcccacagggcaaaactcaggccccaaggctgcctccttctccagtcaccagtctcaagtctgggcctctggaacttctgaccaactggcttcaagttggggttcccatgactcctctgggttcaactaatttgctggagcagctcacaaaactcagggcaacactaacttacattgatcagtttattataaaggatatcgcaaaggatacagatgaagagaagtgtaggacaaaggatggggaagggcatagagcttccacgccttccctgggtgcactaccctccagaaacttccaggtgttcagctgtccagacgctctctgaactgtgaccttttgggtttttatggaggcttcattgcataggcaccacaaccatgtagaaatgtgattggacaaaaagtacatgatctaaacctagcatgcctgtctcttcaagacttttcttggtctctctgtgtaacattccttcctttagggtatagttaggactctctctagtttgagggactcctgacccataattagagaagggtcctgtcttgggcacgtgaaaggacaggagaagttcagagagagagagagattctgtttcctgaggcctaaagtgccctgaaattataagaaggactataggcatcaggagccaggaaccggttctaatgcccatagtccttgttataatttgttatctatatctatctatctatatgtatatctatatctgtatctatatctatctatcagtcaatcataacaacataccatcagataaacaatttctatccatacccattttctgataataaaaactggatctgttgctggctaggtgaaactcggaaactcatgaagctttttaccttttttacaaatgggagtgtgccctttcatcctgaatcattagagtctcctaggtacccctctctgaggactcttattctaacagcctttgcaaaaattagccaaacatctgtttgaaactcactcagagtcattttcatctttgcctttctcctagttatttttagggttgataaatttgttttccaagagcaaacagagcatttttaagctttgatttttggctagcatttaggaattcttgttctgtgcagagctggctggatgcccacttaggaacttagcctgcacggagattccttcagtggaagagcattggtctggagtcatccatccggctcctggagcttggctaccctgatacttcccggtctccctgcaaatgaacacctcagcatgccattatagttggtcatcttactctgtttttacagaatccaggaggagagttcctgcaaaggatgtcttgggcagggtttaattatttctacgaataagaaagctttcctcaggtggaattgtatttactttctgcaatataagccatgaatttacaaatagagtctgatactgtcaggatacataattgttgttatgcttaagtagttttttttttcttgagatagagttttgcccaggctggaatgcagtggcacagtcactgctcactgtaccttcaacctcctgggctcaagcagttctcccatctcagcctcccaagtagctgggtctataggtgccataccaccacacctggctaatcaaattttttttttttttttttttggtagagataagggcttttatgttgcccaggcgggtcttgaactcttggatgcaagtaatcttcccgccttggcctgccaaagtgctgagattctaggtgtgagccactatgcccagccttaaatagattttaaaaaattacaaaactgttacatgttcatagtagacagtgtagaaaaatgtaaaaagcataaagaaaattaaaatttcctatcattccaccacctagataaccattctttcttttttcttttttttggagatgtagattccaatgatgtcatctcactgaaacctccgcctcccaggttcaagtgatcctcctgcctcagcctcccaagtagctgggactacaggtgcacaccaccacgcccagctgatttttgtatttagtagagacaggatttcaccatgttagccagactggtcttgaactcctgacctaaggtgatccatgcgcctcggcctcccaaagtgctgggatttcaggcgtgaactaccacgcccaacctaaccattcttaatatatagatttttttttcagtctttttatatgcctaaatgtaaatatgagctcctactgcatacactttacaatttgtattttccaccaaaatatattgtcgtcattgttccatatcactggatattttgtagtatcactttctctattgagatgccataaattcacatatatttacatttatataaatgtttacatatttataatatttttaacatttatagtatatatcatatttctatagagataacatgtattcacttatattcactgccataaaattcatacttttaaaagtgaacaatatggtgatttgtttgtatcttcacaaagttatacaatagttggcactgtcaaattctagaacattacccccccgccccgaaaacccagggcagttaccacccttccatcgctccttccctcatcctgtggcagccactcaagtactttctgtttgtgtgaattcccctcttctggacattgcgtagaagtggaattatacaatagatggtcttctgtgtgtggcttctcttttttttttgagacaggttcttgctctgtcacccaggctggagtgcagtgctgcaatctcagctcactgcaacctctgccatcctcccacctcagcctcccaagtagctgggaccacagatgtacaccaccacccctggtttgtatttttggtagagacaggatttcgccatgttggcccaggctggtttcaaacttctgggctcaagtgacctgcctgcttcagcctcccaaagtgctgggattataggtatgagctaccatgcccagcctgtgtggctccttttgttcaacataaggttttcagggttcatccatgtatcggtacattattcctttttactgatggataatatttcactgtgtggatgtacactttatatttatccattcaacagctgatggccactgggttttttctactttatggctactgtgattagtgctattgtgaacatttgtctgcaggttcttgtttgaacttctgttttcaattcttttggatatataccaaggactggagttactgggtcataatggtaactgggtgtaactttttgagggactccccaaactgtttttcacagtggctgtactttttcacatttacgtaggcaatgtatgagggttccagtgtcaccacatcctcaccagcacttgttaatgtctgttcttttggctagagccatcccagtcgatgtggagtggcatctcccagtggctttggtttgcataatgcctaatgattgatttttctaatgtggagcttcttttcacgtgcttgttggccacttgtattgtatagtctatttggagaaatacctgttcagatcctttacccacttttcagttgggttatttgtctttttattattgagttttcagagatctttacacattctagatactagacacttatcatatataggatttgcaaatgatttctcccattctgtgggttatcttttcattttcttttttttaacttattttaggttcaggggtacatgtgaaggtttatcacataggtaaactcatgtcacaggggtttgttatacagattatttcatcacccaggaagtaagcccagtacccaacagttaccttttctgctccctcctccaagcctccaccctcaagtgtctgttgtttcctcctttgtgtttatgagttctcatcatttagctctcgctaataagtgagaacatgcagtattcggttttctgttcctgcattagctggaggctgaggataatgacctccagctccatccatgtccctataaaggacgtgatcttgttcttttttatggctgcatgtcctttcattttcttgatagtatcttttgaagcaaaaggtttttaatttttatgaagtccactttatctagtttgtctttgcttacttctgcttttgatgtcatctctaagaaaatactgtctaatatagtcatgaagttttacagctatattttcttccaagaattacaaagttttagctcttgtactttgaggtgatttttgtgtatagtatgaggtaggagtctaactttgttcttttatatgtggatatccagttattccagcataatttgttgaaaagactgtctcccattgaattgtcctagcatccttgttgaaaatcaactgcccataaatttatgggttcatttctggactgtcaattctattccattggtctatatgactgtcttacatggacatgggatgtctgtttatttacttgacttctttagttttttcaatgacattttgtagttttcagtgtgtagactttccacttactcatacatattgataaatattttataattaacatttataaatattttatagttaaacataaatattttattctttttgatactactataaatgtaattggtttctgagtatatttggattattcactgcaagtatatagcaatacaattgatttttgtaagatcttgtattctgcagccttcctgaactcctttattagccctaagaggtttttttgttgtaaattccttatgattttatacatataagagcatgtcatctgtgattagagatagttttactttcttaccaatctggatgcattttctttctttttcttgcctaattgtccagactaaaacctctggtataatgttgacaagaagtggtgagagcagagagacacccttgtctagtttctgatcttaggagaaagctatcagattttcacgtaaagtacaatgttagtttgtgagtgttttgaacttgccctttatcaagttgaggaagttcccttttatgtctagttgttcagtgtttatattatgaaaatctgttggattttgtctactgctttttctgcatctatcgagatgatcatgtggttttgtcctttattctattactagggcaaattatactgattgattttgaccaactttgaatttctgggagaaattccatttggtcatggtatataatcctttatatatgtttttaggtttggtttgctagtattttgttgaggatttttctatatcttatctatatattttatctatatgacatctattatcacttttaatggctgcataaggcttaattatgtggatataccataatctaaccaattagactttaaattatttcttttcttgccattgttgttgttataatcaaggataagctcatcactgttgctcagatagctttgtattcattcatgattatttttgtaggatacattcctacaaatggaataatggaaccaaaggttatgcacagatgtttgtctcatcttgtcattgacattttcaagttgtttatagtggggtttttttttcagaggtttttaattttcaggtaagtcacatctgttttttctttatgtattctgcctttgcctataggctcagagaggcctctcctaccttattcaggataatctcctatattttctttcttttttctcttttaatttttcaagacaaaatttcactacgttgcccaggttgacgtgtggtctttcttctttttcagttttttgagacagggtctcactgtgttgcccaggctggagttcggtggctatttgcaagcacaatcatagtgcgctacagccttgatctcccgggctcaagcaatcctccctcctcagcctcccaagtagctgagactacaagctcacaccaactactgtgctcagctaaaacaatccattctttatcctagattagtcatgccatctttgtcataatctgaattcttatttctgggctttgccatgatccagtgctcatctttctattcctgaaccatgccattgtaattttttatttttctgatctattttactatctggtagtacaagtggtttgtgtttgtgtgtgtttgtgtgtgtgtgtgtgtgtaattttctcctttagagaagaatcaagttacttgatagcttctgtagagaataatcaattattctaccagatgaatttcaggacaattttataaataattttcttcatatttctaatctgattagaatttttattggaattacaacacatttataaaattgtttgcagagaatgaatatccgttgggagagcatggtatgcttttcatccagtcttcttttttgtcattcagtaaagcatgaatttggggggcgactgtaactttcttaccaggtttatttatagatgctattgtaagtaggattttttttaacgtgataacttatttaggtatattattttattatacagttgaatacatacttattttagaaaatttagaagctacaatgtgaatttaaaaagtaaatgacactcagtctgagagataagcactgttaacattttgtgtgtatctttctattaatagatttacagtctaatgagggaagtaagacatgatcacatgaaaggcttaataatctgagacactattgagtgactagcttgtactttttttctgcctagccttttttctccttttggaaactgcttttcccataactagtggagctgccaatcatccaggtccctctccacggccaatgggttggacagtgtatcacctcaggctcttttctgggagagactctctaatctggaatctcaaatgctaaagacctctagtcttgcagtgctgctgggcaaggccttcctatcctcagagcacctgtgtttgaatgataccagcttaggagagtgaagctacgaggtgattcaaaaccattcctgatgacatcattggacctcatggtctagagctggcttaaagccagcctgaattcatcctagactttcctaaatcagtaaagccaacaaactcaccattttgcttaagcaaaattgagttaggtgtctgtcatttgcagagtcccaaccactaccacctcctgtgtctgtgccatggtgccacatggggagtcacccagatgagttaggaccctgtatgccccttgccccccaggagagtgggtgttcctcagtaagagcaggttcagtgcattgtgcctgttgtctccttcaaggcaaagctggatggccatgagaggcagcagccttggccaggtggggcatggggctgccgtgccaggccaggccggctctgaactccttactgcactctgtccattagaatgacagagtctgagtatggaggttagaattatagtgaacatgggggattctatgtcacagaggctctgcaaacccatgccacctgctatataagagctctctgccatgcaagagcagactggctgccttccacacctattatccagtaaaatagcaattaaaatgcagcttgtggcaatgactaagcttagcccaggcccgctgatagagttcttggtgcctgtggatataacacatgttgcttgtttaccttcacaacatttcttcggtgtttttttctgggcagtgtatttggtccctgttgcagtagatcccattgtcactggggcttactctaggccatccgtagtagcagggaacgtggaccccaggctttgtgaggatgcccatatcattttggagctccctgaattcaaaattaagtatgaaaagatttatttagaacgaaaaaaaattgcaacaaattattggagcctaggagtttccgatgcctacctttgagatccctttagttggctcaccagaagcccctgctgtgatatgcttcctggttgtagcccgacttccccttcccacctagaactcacagtgttcacagggtcatggcaaggtggtggggcgtggctgaagcttcagggtaaatccatttgtgaagagcagactgagtttttgtttttgtttttaaatctgtttgatatctcagggagcagtcagcagctagccagcctacatcttgaaacccttacattttggagaggtacaaattaagcattgaggaccaagtaggatggaaatatgattttgcactttgtgcatgtatgcatgtaagaaagagaagagagagagagattgtgagaggcaggagagagacggggagaggccatcagaacttggggagagcagagcccgcctgcttcctgagtgaagcattgctcaagcgctctctgcccggccccctccgagtgtggttttcctcccaggccagcaccaaacccagaatagagtggctgacttgctgattgaggtcggcagctcccgagaagcaggagaagcagagtttttgcagtaagtacatcgttggttattatttaagacagagatggaaaatcttaggatagctggggaagaggtgcttctgctttaggtacaatgtcttacagacccagtggatcttggtgtgactaaggcagtgtgaatacattctcccgtggtgcatggactggataagttaatgccacatgcatgattttggggggctgaaaaaggatttgaaacccaccttttgacgtgttgaaagaaaatgatcttttctcacttgttttatcttgcaaggaaaggatgattaatgccaacttcaagttaatatatgaagttctttagaaaagaagccctgtgggtactaattagtagcagcgtggagattattttcccatccagggtgaatagggctgcttctgtgcattccttttgccaagtgtgggatgtctaaggtcctgtggagagaaccgcccactcgactagtgcttagcccctggaacgttctcgagtcatctccccttggaggagatcagcactgtagtgtgccctgtcgtctggcagagggtctgataatgtcgcaatgctcaacatctgggcaatacatacattgtgttagggtctgaaatgagatgtttgtgaagcccagatggcagagtttcaagcaataatatgataaagttggtggcttttctgggaagttatttattatatggttacttgagattgtttttcccccacatcccatcacagggctgaagataccttaaaatctctcttacccactctattttctagaaattaagtttttgctttttatttccttgtcccactgactctaatttcctataggtataaaatgtttagctcagcggtgcagaaggtccacactaagttttcttgggaaatgtggcttccaccccttctcgatagaatgctaaggtgctgctctagctgcagaactcactggtgtggctgcttctgctcctttacagctcagctccatggactctgtgtctctgtggttctgttttagagtagccgtgtttcacttcctttaacctttcctttaccaagtgagttaacatggaagcctgtctaaacagaggagcccccaaggcaggagagggggtgcaaaataagcaatactaaactttcatttgaaaacctggaatttgaaataaaccaccacctgtgaagtatcattcctcattccaattttatttttccaatatgttattttttttttagacagagccttgctgttgtcacccaggctggagtgcagtgtcttgatctcggcttactgcaacctctgcctcccaggttcaagtgattctcctgtcatagcctcccgagtagctgagactacaggcgcatgccatcacacccagctaatttttgtatttttagtaaagacaacatttcagcatgttgtccaggctggcctcaaactcctgaccttaggcgatccacctgccttggcctcccaaagtgctgggattataggcgtgagcccccacacctggccccaatacattaacatttttttaaatgatctaagtaattttgagctctcactgtacaacatcatctcatttgattctcccagcagccccatgaggtagctacctttttggtcttcacttaatagctgaggatgtggaggcctagagaggtcagagagatgggtgggcaggtaggtgagtggtgcagccaggatgggaactcaagtctgtctcaatccagagctcatgctctgatacggcatttcagtaaattcagaaattggagaaaatagtgacttaatcccacactttaaagcaactgttaaaatttctggattttttgctgggtgcagtggcttgcacctgaaatcccagctactcaggaggagaagaaggaggattgcttgagaccaggagttcgagaacagcctgggaaacatagcaaggccactgtctccaaaattttgtaaaaaaatttagccaggtctgggcgtcgtaggtcatgcctctaatcccagcattttgggaggctgaaacaggtagatcgcttgagctcaggagttcaagaccagcctgggcagcatagtgatacctcatctttacaaaaaaatcaaaacacaagctaagtgtggcgatgtgcacctgtagcaccagctactcaggaggctgatgtaagaagatcgcttgaaatcaggaggttgaggctacagtgagctgtgatcatgccactacatttcaccttgggcaacatagcaagaccctgtctcaaaaaactaaaaattaaaataagtaaataaataattagccaggtgtggtgttgcatgcctgcagtcccagctactccagaggatcactcgtacctaggaattcaaggttacaatgaactatgatctcactactgcatttcattctgagtgacagagtatgaccctgttctaaaaaaattatatatttctttctacctgtacaactagatattatagcataaggctttaaaattgttacatagtttcacaattattactatattattcttttgagacagagtctcactctgtcgcctaggctggagtgcagtagcgtgatctcagctcactgtgacttctgcctcccagcctcaaactatcctcccacctcagcctcccaggtagctgggattacaggcgtgtgccaacatgcccagctaagttttgtatttttggtagagatggagtttcactatggttcccaggctggtcttgaactcctgagctgaagtgatctgcctgccttggcctcctaaagtgctgggattacagggatgagccactgcacccagcctggtttgacaaatatttaatggcataaaatattttcttaagtgattggtccataagttatttaactattccctgttttttaaaattaggttgcttttccttttttgtgttttgctattataagtaatagattagtaaccgtctttgtccatggaactttccttatgtttttgggttgtatctgtagggtagattttcagatgtgggattactgggtaaaagggcatgaccattttaatggtgcttggtgtgtgttgctaaattactttatatcaacacagtgtgggggagcacttgtttaatttcatccattccaccagctgacagtatcatggggaaaaaagagtaagaaaaacagaaccagccgacagtatcacagggaaaaaagagtaagaaaaacagaacctctttatggtattttgcatttcttttaatacagctaggctgaacattttttacatgcttgtttacaagttgtactttctcttttgatcattttatgggatcgtaatgctggctttttggggccaatttatatgggtaagatttatttgccatatttttgtcagttattttccccagtctattgtttacctctttaaaatttttaaaaaacatgcagtcatttaacatttttatgtagtcaaattggtttcatttttttcgtaagtcttctatgttagagatctaagttctctgcttttaaggcatttatgttcttctagtattttctttcatggatgatgtgaaagtaaatttaaactggctttaaaaaatgctaaccagtttttccaatatcatttatgagcaactcttatgttttctaatattttatgattttctctttttatacctccagcttttctattatatgatttttctggattatttgattatttataggagcaatctgtttctacgccattatcgcactgtgatagcttttgtggcttttttttgtttgtttgttttgtttttttgtttttgagatggagttttgctctgtggcccaggctgaagtgcagtggtacaatctcgtctcaccacaacctctgcctcccaggttcaagcgattctcctgcctcagcctctcgagtagttgggattataggcacccgccaccacgcctggctaagttttgtatttttagtagaggtggggttttgcaatgttggccaggctggtctcggactcctgacctcaggtgatgcacctgttttggcctcccaaagtgctggggttacaagcgtgagccaccgcacctagcctgttgcttttatgatatgtagagagaatgagttgtgtggagtaatactgaggcaacataagattctggttaagcccataggcactggaggcagattgctcagccttaacttctctgtccctcagtcttattatctgtaaaatggggataaaattaataatagtttctattccatagggttgttggagtgaggaaacaaaagctaaattaaaacacacacacacactgaaaaagtatttgatgtaggtagatgtgtagagaaagtatttgaagcatatatagatgactctatatacatgagtatggattatattacatatatacataaaaagacatatgtatttttatagagtcaaacatgtcattctttccctctatggcttaagacaacctttcatgtaatcttgggagacaggaaaggttgtcttagccacagagggaaagaatgacacgtttgagttgcatatgcaaaaaacttggtacattgaaagacaagcgtgtggctgagagaaatacatgcagcacacataccacaaagagtactactcataataaatgatcccagcaatcaactagaaaaaacagacaccaaagaaaaatgggcaaaggttataaaaaagcaattcctagaaaaaggaatatagaaggccaataaacatgcaatgttcaacctcaataatagtcatagaaatgcaaattcaaatactcatgacgtgtcatttcccatgcaacacattggcaaaaatggaaaatatgaataatgttccagcatagagagaatcataggaagatgggaactggcaatcataaccaatgggaacaaaaattagtaaagcttttttgtatggcaaatttataaaatctatcaaaaggtaaaatatgcatacctttgatttgtcttagaaaaacactgtacatgtttttaagtaagcataaacaatacaaacatatttatgttaaaaattgtatgttaaaaatataagctatatatttttatttgtatgtatataaaaattcatttaataaaaagcactggatgtgtgatatcaaactgttgtttcctgtgtcacctctggagagagaagtagactaagggccaggttgctttttcctcttgctagatatacttctgtgtttgaatatttcatgagtctgaatttgtgcatttgtataaagtaaataaacaggcatttttccgggcccacaggcaagaagattcttgggagcaggatgctagctgtagaagctcaaggttgggaaagtgagtgacagattttgggaagaacaagaatttggtggcagtatttaaagatgcttaaaggtcttaacttatgttttagaaaaggaagcaacccaagaggcatggaggaaaagttgctttattgatgggcgccgacctcttccatctcctgtgcctgttttcaggctttgtgcagttgcgtccccacacacggctcgtagacgcccccgaggcactgtgctcctcactttcttttccaacatgtgttccttatctctggtttattgatttattatttatgtatgtatttttagagacagggtctcttctgtcacccaggctggagtgcagtgatgagattatagctcactgcagcctcaacctcctgtgctcaagagatcttcccacttcagcctcctgagtagctgggactacaggtgtgcaccaccgtgcctggctaatttatttatttgtaggtatagaggcttactacaggctgttcttgaacttgtgggttcaagtgatcctcccaccttggcctctcaaagtgctgggattacaagcgtgaaccactgtgcctggcctctctagtttaaaagattgtcatctgaggttcaaaataagcccttcatccattatccacccagcagacatccagcacccagtctgagctggcagtgtgctaggccctagggagacaagggtgagcaaaagagaacgtgccagcctccagggacctacgcatgggttggggaggagggacagtaaacactgatgaattatatcactgtgatggtggctgcgaagctgccattgggggctgtggtggagagtcacagagggagggatcctttccctgggtgggcaggaggcgcaaggaaactagggtcctctgaggagagcctgcatcgctgcagtctctcccattccatccctttctccgcacccctaccgccatgtcttcattcctttcactgggaccactgtttcccagattttagttctttaatgcctcttttcacagttgttgccattgtcaactaccattacttattacagttcctaaaactgacttaacattattaatgtatcttgaaaggacttaaccgcaagtgagaaacaatgaaaatgaaatgatgctaaatttaaaagttaggatgataggtaatgaaggcagaactcttgaatgtggtctagaaggcatgcatggggttgctctgatcacaaagggatgctatttatatgggagaaagggaatgtattaggattagatatttagctggcagggggactctcttgtcagtgaactcagggaggacactgtaggaaagagatgacagaaagagggagagactgcagagcatttatttattttgtttaattacaagcgtgagataagccagcaacacattacaacccgggggatcagagggtccctctgagacagactgcgggagccacatctggttgctacagtaacgggcctccttataacgagaagagccacaagtgcccgacataaatggcttggggcagaggagcaacaagcggcctaccttgctgcctcttggggaaggcagtctcggggaggtttcgcagtgggtaaagaatgagactctcgtggggagggtctcgggttgtcttgagtctaggagcttgagggcctctccgggtcttactgatgaggtcgaacatagggaaaggaagtcctcctggcttcacctgtgctgcctgcgagcccttactgcatgggaggagccccaggacaagaaggcggtacagcagcttttttgaactggcttgggatgctgagagatttgggcatcccttggccatcctgaggagggccaggcccacatgatgggatcagtgcaggggggggtggtcactggggccctcctgtggtccttcttgccggcgtcacccctgtagctgcaggaacttgaaacccctgccccaaacttgcattctccttcctgccccagtatgcctcctccttgctttgctgttccctgtgcctgtgagtttctctccctcttgtcatctagttcatgcttcttatcctggaagggtcaccaaagggtcttttccttcctgctgggtcatgtgccccttgaataagctcttctgtcactgtgtgactttttagtagcattttcccaattgatatctggtattttcaaggccatttgatagttccctacactggatggtgagccccaggtggggaggggtggtgtttggttttgtccatcctgtgtcctggtgcctactgcagtgcctagatacaggaggtgcttccagaatgattcttgagcaaacaaatgaatgagacagtccccagctgtttgtgtaaacgagtgaattcccacgactcgttttgggcctggttttttttcccagtgcagcagagcacagggaatgaaggggagaggagggcctggggagcggggatgtggggtgtgcgtgtgaaccatgggaggaagcctgcgttttattccaagggacacagggaccgactggagggctttgagcagaggagtgatgggatctgacctacattgctaaaggatcattgtggttagtgtggaaagattagccaggtggagggagagggctgaggagaggatggaggtgaattagaggggtggtggcatctggaagattgggctggactgggatctgtccggaatgtagagcccacgggtgcagcgttctgggcgtcaggatcccgtgatgtgtttgttgctctgatccgtgctgtaacttttcacaggtgagctatgctggggccctgagtttcccacattacaacacacacacaacttttcaatcaacaaacctttgctgcccccaaagccaccccaggagcccctggggcccatgtgtgccagttgaggccacggtggccccacctgcagctggctggccgttcagactcctgctgctgctcccgctgcctccttccatcacagatgatactgagttgttaccagtcaagacagggaaaaggcaccctcaaagcctcagctcttcaacctgccgttctgggcctccgccatccaccgccactcttgttttccagtgccattttgcacaacttccaccgtgctcgcgcgctgtggccaaacagcactactccttgcctgcttttgggggtgctcctcttctcacctggaatgccctctcctccagttttcacatgtcaacctcctacccatccttcagagttgtattagtctgcttggtcgctcacaacaaagtaacacagactgtaggtcttaaacaaaagacattaattttctcacagtactggaagcagacattggagtcaaaatcaaggtgttattttgggaggttgaggcaggagaattgcttcatcccaggagtttgagaccagcctgggcaacacagtgagaccccatttctcaaaaaagaaaaaaattagccaggcgtggtggtgcgcaccttgtcccagctactgaagaggctgaggtgggagggttgcttgagtgttgagtttgaggcttcagtgaggtatgatcatgccactgctctccagccttggcaacagagcaagaccctgtctcaaactatatgtgtgtatatatatatatattcaccttgtatcttcacatggttatccctctgtgtgtgcctgtgtcctaatcttttcttatatggacatcagtcatactggattagggctcaaccatatgacctcattgcaccttaattaccacttgaaagaccctctctccaaatacagttacattctgagacattaggggttagggcttcaacataggaagggagtggcggggagggacacagttcagcccatgactagagtctcagtgagatgccactttcccctccagcacccactgtgctcacacaccatagcctgttagtgggcttctttctagcactggttgctgtgtcctttggtgttcgttcgttcgttcgttcgttcgttcgttcgttcgttcgttcgttcattcatccatctaaaaatagtactaagagacatctagtccagactcctggactgtattattctttgagtcctgaccacaccaactatatctgacacaggtcacctgggacatttaattttttgttaattcatcaaacaaaatttctgaacacttctcatatgtaaggcattgatccagatgctaggcagcaggcacagcagaaggggtctgaatgccagccagctgctggtggggccactgatttgcctttccttttaaatgcaaaggcgaatcagagttggcacttccagttagttggagagacataactggcatatacagtcatacaagagaggacatagacaaaatgcttggaatttagagcaacaccaaatcacatttgtctttgtaggtgtggggagatggcagataagactacaagggtgaactgacatttgatctgggacttaaagatgggtaagatttgtgtagataggtggccttttgagtttaggcttttttcacttagcatagtgcatttgaaatacatcctttttgtgtgtgtgctattcattcacttttattgctgagttcattctttctattgctgagtactagtctaatgtggggatgcatcagtttatgtatccactcactgttgagggagagttaggttgcttgacttttgctgttacgaaatcaagctgccatgaacattagtgttacagatgtttgtgtgaatacaaattttatttctcttggataaatactgaagagtgggattaatggattgtatatgtttaatttttaagaaacttcagcactgcaaagtggctgtaccattttgcatttccgccagcaatgtattagagttccagttgctccatatccttgccagcacttgatactgttttgttttgtttttaaatttttagccattctagtaggtgtgtagtgatagctcttatggtttcaatttgcattttcttaatgactaatgatgtcaagcattttttcatgtgcttatttgccatccaaatatcttgtgtggtgaagtttttatttaaatatttggtcattttttattgccttgtgcagtttattattattatttgttattaatatggacatcatttgttatttttaacaaaaataacaaagaggctgggcactgtgactcacgcctgtaatcccagcactttgggaggcgaggcgggcagatcacctgaggtcaggagtttgagaccaacctgaccaacatggtgaaaccctgtctctactaaaaatataaaaattagtcgggcacagtggagggcacttgtaattccagctactcgggaggctgaggcaggagaattgcttgaacctgggaggcagaggttgcagtgagccgagactgtgccgttgccattgcactccagcctgggcgacaaggggaagactccgtctcaataaataaaaaataaaagtaacaaataataacaaaaatggttattattcaagaattcaagattcaagtcctttatcagttttgtgttttgcagatatttcccttccagttgatggcttgtcttttcattttgttgacaatgtcttttgaagaccataagttttaaattttgacagtatcccattaatcaggtgggtttttttgtttttttatcttagttattttattgctcatatttttggtgttgtaactaagaaatctttgccttactcgaggtcacaacagttttctcctgttttcttctagaggttttctagtttcaggtttcacctttaggtcaatgggctgtctttaatgtggaccagacactgggcccacaggtgtggaaccacagaggaatgagacagagcccttcactcagggaccatctgggcaagggaggtgggggtgggagtcacacagggaaacagtctttgtctggtgtaaggcctgctgataagcctgggtccagggtgctgtggacacactgtggtgtggaagcaggtctgtgcccagacaaggggctgtgaactgaggtttaccagacagtagagggtaagtgaaaagcaggagttcaggctgggaagcctgttctgggcttagagtggccttgggcaggcctggaggctggatgatagaactcagcatccctgcagctgctggtcatttgctgtgcctggggtcaaagtgcaagacagctggcaggagtgggcagaagggagcaggggcctgagcacttggtgtgccttatcctccaacaaagaggaggtggaggtggcttcatggcatggctcaggctgtgctctttgagggtcgggggtaactgtccctctttattttgaaagtcagatgtgtctgtgtcataaagggcacatccatagggggcagcggaagtgctgttacataaccgtttctgtccctcacgctggaaacagatcgcacagcagttgctgtacttgctgttccttgtagacttactcctgtgcaaggaacgtgtaatgacaaggtaatcccaggagcagcctgcaaaattatccgtcgtatttgtggttcctgtgtatatttaaaacacaatgctagaagcgattgatgctgacgaaggatagggcatattccaggcactgaataaattaaccctgcaaagcacagcagttgctttcattagccagctggcactgcaggaatattgctaaagcctgtgggttagaaaagaaaatctcaggaatgcgagaacaaaaaagaaatcagccacattcagtgatttaacttaatctggcaacaataaggaaatccagaactcacggtgctctgagcaatggcggactcccgctgcatgtgcgagtggatggatattccctgttcagtggaggggatatccaccacgactctgggtacccacggcgggatgcagatgtgagttagggccatgcggcgatgatccaggttttgttcctgcatcctctgcaactagagaagctccagcaaagttctgtgttcccctcttttcttcctgatgtccccaaggagtgaagcaaatgaataggcctagctaatgtgccatctctctctcccttctctacctggccaggcactttctgggatggctgctgccatcatgtccatgacactgaaggcctctgctgcctgcagtcccactgctgcctccgccaccctgggcaccactgctgccttgttgccctgtggctgtgaggtgccatagtgccaagtcttcagcacgccccagaagccatgatgagtatggtggaggcctcagaattttcctggggaagtagctctttccatgttgccttgatggccctgttcccacctcctgtctctccccctaggccaagtgttatcccaggagacccttcacttccacagacagacagacagactgccagggaccctcctcagccagcctcttcacatgccgaggccacagcactcagtgtggttgggtccagttgagaccctgctgctcatgacttaaggcttctgtgcattgaattaagccactaggggacttatgagatcaccctctggcttctcttgttgggtcccatacagccagtatgtgtcaccaggggcatgtggcatgtgtagcctgcctctcctgagtttgcagagctgggctggctcctccttgattttatcttcctctggaccagagtggctgaagtatagtgagcagagggaggggcagtggacgtggtgaggggccagacctctccatccatgggtgggggctctcgttatggagggtcccttttttgcgtctgtgctcagcagtgcgggggaagagggtttgtccccttcctcccaggtcctcatcgttcaaatgcacggaagcatgttggtagagcacacagaggttttgctgggtgggtggggcagcatgccctgcagttcttgcattgtttccagaggaaatagaatagaatgcaacagaactggcctgcctgttgcctgggaagctgttctcctgacatcacagggctgtgcccatatccccgcttggcttaggggcccctaagttaggaacaaagaagcagaaaaggttggataaaagataaggtactcagacttgatactttaaattatcaagttcctaagtctatggttaccatcagttcatactttacaaagcatttattaacataaattcatttattatgtttctgtgaagatgcctggttaaatctgaaaccatagaaatgtaaagtattgtttactatttctgtgaaactagggtgtaaaccaaaagttttaaaagccatccctcaggaataaatttaggaattatttctcaagcatgactgtgagttaagaatattaagttttataacactgatgcttacacatcagcatgaatgttttcaaggtagtagtgctggaaggctctatattcacatccatggggctctcatcctgaaagcagtctggggactttattattttttttcaaccatttagagatatttataagtattatgggagaaggattgtcattgccttccagttctcttttgtgcttgcccgttaattcagcacctatttagtgagtggctcctgcctgctgggactgtgtacctttgtagaagctccctggctggtggggcagggccagggaggcacccatatgcatgttttcagtgaaagccagaatctaagtattcattaactaatatttgttgaacacttattatgtgccaggaacacaatggtgaacaagggaggtaaaggccctgctatcacggaccttccctagtagcacaggaaggcagataacccatgacagaaaatcaatggcagataatcgatggcagtgagagtcttcatttggtgataaaggctctgaagaaataaaccaggggctgtttggtggggtgggagagctactctagagagtataagaaagacgcctcctagaggaagcaccttggagcagagactgacctaggagaaaggagcccactgtgtgaggagctggggggacattctggacagagggaacagcagggtcagagctcttccttgggaactagctgcacatgctcagggagctgggagcggcccacatgaagcacagtgagcaggggagagtgatcagagctaggcgaggaggtgggcagggccaggaagcctaggagcttggggctgggacaaagaccttgggctttcactcccaatgcagtgagaagccactggggggttctgtgtagggagtgatgtgatctgatttttgtgtacgtgtcttaattttgaaactttaattttagtgaaaaaaagtcacataacatgaaatttaccatcttaaccatttttaagtggacagttcatgatttgtgttttgaaaagactcctgtggctgctgaatgggcattaagtggtaggcaagaaggggcaagagcagaagccaagagccagtgaggggaggctgcagcacccgggtgagaggcagggctggcccaaggggtgggcagtggtcacagacctaggagttccagaagagagacgattttctggaggtttagagctgggagtatctcatcagaaaggtttttgcaagaaagtcttgattggcataagcctaaaaggaggggataaaacattcatacagggaggccctcagattggtgaataccccaagatgagaaccgcaagtttcattggaagtgcagagaagagtcctgtttggctacgctgcagggtaaggggtcagcgtggctcagccgagctcaggcaagccgtcatttaatttggtggatgctattgtctgaatgttgatgtaccccccaaaatttatctgttggaacctaaaaccccatgtgataggattaagaggtggggcctttgggaagtcggccatgagggcttcaccctcatgaatgggattgtgcttgtgcaaaacaggcttgaggagctcccttgccccttctgccatgtgaggcgcagcaagaaggcaccttctgtgcggcagagtgagccctcaccagacactgaatctgctggtgccttgccttggacttcccagcctccaaaactgtaagcaatgagtttgccttgtttataaattacccagtctacagttttttgttgtaggaacccaaatggactcagacggtgtgtaaggggagcagtaggccagggttaggcacacagcctgaagtggcattgctgagggtcccgttgggggagttagcaaactcctcgacattcccttgttgctgaactataaaatggggatgacagcagctacctcacagggtagtcagaaacatgaaagaagacgaaggaaaatgatgaacatggtgccagtctcttagttggtgttgctaaatgttagcttaaaaatacagtaaaatgggctgagtgcagtggctcatgccagtaatcccagcattttgggaggcttgacgcgggaggatcacttgagcccatgagtttgagaccagcctaggcaacaaggtgagatttcgcctctatataaaaaaaaaaaaattagccaggcgtggtgacacatctgttgtcccagctacttgggaggctgaggcaggaggatcccttaagcccagggggtcgaggctgtagtgaattgtgattatgccacagcactccagcttgggcaatggagtaagaccccatctctaaaaaaataaatgagtaaataagataaaatgcaggattttgagcagaaaatgactgaccccagctgaattttcagaaatctgtcttgaatatgtggaacggatgagcccaggagggccttaatgccaatctgtgctggagaaaaaggcagggctcctacaggaaatgttgcaggcatctgatctgctggcctggacagccgtgaatttgagaaatgggcgccctagagaggagtccaagatgactgaggttttgagtctggaagagcaagagaaaggctgtgccgatgacagaaatagggaagtccgggctgaagctggttattcagggtttgttctgtgccccaggctgaggctggctgtacacaggcagatgccaggaggctgcccctgggaagggcttaccaacaaggagaggcatacgtatgagaccgtctcagactaggagaagattttctggagcggagagacttgagcacactttggaaggtggtgttgaagttagccgggccatgggagctgggcaggtttcctgggcctcctgtttgccacaccacatctctgtcttcttcctccagctctgcaccagcgcaggcgaccgtagacactgtacctgtgtcccatgccttccctgagcctgtgggcagcactggctgtcaggttggagggagggagaggatgcgtatgaggtgtttcctagctctggggtgctgcactttccgttttgcttctccctttcattacaagccctgcccacacctttgtaaacacttcctttctcagctcacctcagttccccagctggcgtcccaggcagaggcagttgcatgtgcaaaggcccggagccaggacttgataaatatggctcaagatgctgcagcctagatagatatgaaagtctctggttccctcctatactgtagtttttattctgtttactttgcactagaccattttacactattccaaaaaaaaaaaaaaagggctcttattttatttccatctccttttcctactgccttggctcattcactttaatcctttgatggaagccatgttacaggtaagggaataactacttattagtggtcatttagctctttgggatgctggttgcttgaggcagctttggagacagaaggacgtcacagaccagtgattgtgagctcttggtctcaatatagctgccagattatagcctctctcttgggtctgcatttcatatttgggacttgcctcggcctctgtttcttattccagattacaccctattccttatgggtctccatattataccctattccttatgggtctccagattacaccctattctttatgggtcttcaccttctggcaggagtccatagtttcttactccactatcaaagtttgttttcaggtttgaggtggtgtggttagcgatgtacaaatgttcttttccatttagtttttgtttttatcacttctttttttccagtgacttctgctgatgggatcaatgaattttactttggaatttttcttctgatgctgtatggaaatctgttcttttccttatttactgggaaagaatctgaggctattgggatgatttttcatctcaagactgtgggaaataatcagctttgaagcatttcctgtggccatttgctgaagtctgggattccgtcagctgcgccccaaccagattttcagtgttaatgtttccatgttaggtggtgaggctaagcagatatgtcatgtgccggctggtctaggagccagtgtcccagggctctcattcttcctctggaagtctctccaccgtggcactgctgacattgtaggccagatgcttccttgttgtagggctcccctttgggttaccgatgtctagcagcatctctgggctctgtccagtagcaccccaagttgtgacaccgtaaatgcctctgcacattgccacgtgcccattgggcttagaactactactgtagaagaggtcaggagcaaattcgacccatgttccaaaaagctccagctcagtattttcaacatgtggttcacttacgttctatttcctgctgagtcccctggcaattgagctatgtgcacattcttattttgttggttctcagacttgaatggtttggcctcttccgcttcccagtgcttattgtgcttgtagccgagccctgagtgccctctcccactcctggagactcgtcattattttctgattgtccagaatggtttcccagttgcctttctatttcttgccttaaaaggataatgaagctgaggcccgagataacctctccaacgcaggctccgaaggcagcaatttagtggcggaacagcgtgttttcagggagcaggagacgtgtggactctgactttaactgttgcccagcgcctaattgtattccttaaataggggttccctctctcctccttttctccctccctcctttctcttctactttacactgtgaaatttaagagttgcagtttaagtcctacactattctggagaggagagaaacttggtaagaaaataaaatgtttgacaaatttaaagaaaacacccctggaacgacatcccccaccccaccatgggtgtggggtcctagatttaactgtaattccttgatcgatgtgatcctttgtggtgttcatgaggattttaggaaatcatgagattaataatagaaaccttcttttcactgtcttgtacttggctggagcctgtttattttgtatggctaattcatatccataagaaaacgattactcagctagcattcccacctgtgtttatctttcagcagccaggatttgttaagccctgggcaattttaattgctgtgaagtgtcttccctgcaggtgtgtttccctcgcttctttctctctttcacatttccaagtgaaaatagtcttctctgtgtagaagagtgtgttccttggatctgatatgtctgtctgcctcctgccctgaacacacatttaattgacccatcactgtgtgctgctgagtcagaaggcagagcagcgctccgttgaacaccatcaacagtttttgtcgagagggcggctcatagttgtcaacagccttctgtgtgcctggcacctgatggacttgttctcctttcatctttacagttttatgaagttggcactgataactccatcttattgggtgaagatgtagagaatcatgttcagaaagcatggctgagttcacaatgtcaacagtggagctgaatttggaccaggtgcatttgatctatagccttggtgctctccagggagcaaagattattcagagaggccatccgtccctggtgtttaggtgtgtaggttttggaaccaatttaaactggatctgaatcttggctccaagataaactctgagatttgggcaagttgcttaacctcccttggggaaatgaagtttccccacctgtgaaatggatatgtcttagtctgttcaggctgctgtaagagaaataccataaactgggtgacttataagcaacagaaatttattgctcacagttctggaggctgcatagtctaagatcaaggtgccactagatttggtatctggcaagggcctgctgtctggttcatagatggagtcctcttgcagtgccctcacttggtggaaggggcaaacaagctccctcaggcactaattacattgatgagggctctgcctcccagatgccctacctcctaataccacaatgggggttaggttccaacatgtacattctgggagaacattcagatcatagcaggaggtgacccttacctcgtagggttactgagctatttacatagagcatttagcagtgctttgccaggctcagaatgaaataggatagctgctctcagctcatgacagcatttatgtaaatgaactggcttcagagagccaggctgaggggctgagatgacgggagggatgtagaagtggtgggaagtggattgggaggaaacctgaagaaacttggagtgggcctaggggtgcacctgctccccttctagtaggagtccttcctgcaagtggacggagggcaccatattgtgggttttttgtttttgtttttgtttttgttttttgttttttttttttttggagatggagtctccctctgtcacccaggctggagtgcagtagctcaatcttggttcactacaacctctgcctcccgggttcaagtgattttcatgcctcatctccccaagtagctggggctacaggtgtgtgtcaccacgtccccctaattttttgtatttttagtgagacagggtctcaccatgttgcccaggctggtctcgaactcctgagcacaggcagtccatccaccttggcctcctaaagtgctgggattacaggtgtgagccactcccagcctatattgtatattttaaatttgagaagaagatgggatttgaggagcagtgtatggctgatgggtgggtacaaaatggaaggccttgcccaggaaaacaatgatgggaatgaagccgaagatgctcaggaaagggagtgtgggcagcaggagggggatggatgaggagcattttctgggtgcagtcatgtgggagtagttgggttgaattcagagggtccaagagaaagggaccctgatgcaacaaacatgggcctggacagtgctgcctcagagcgggccacctgccaaccctggaaaggaggctgcgtgttcgtcaggggcaccatccacaggatcgacgcatttgttgccagagattaagagagaagtttagatcttttaattttgactgaggtggcttttccttcttttctttaaccaaggacttagactcctgaaatgttggggaaaaggttgacagggaaaacatccaccctcttcctgctgtttttcatctctatatttttctcttttgtggtggtgtggtggtgggcaataaataaaaggcatttcatttcaggggtaacctgggcagattttggaaaatgtagacagattgcaaaatcatcctatgttttcataaagtaagccctgtaatatccagtcctttattttttttttttatttagagagaggttttcactctgtcactgtcccaagtagctgggactacaggtgtgcaccaccatgcctggctaatttttgtattttttgtagagacagagtcttgctatgttgcccaggctggtctcaaactcctagactcaagtgatcctcccactttggcctcccaaaatattggaattacaggcatgagccactgtgcctggactgtaatagtcatttctaagtaattctaatcataacataaaagggtgtcttgattaaacagatactttattaagtcatctccatgagtcagtcagactgacaggttgctggttgattctgcagtaattggtgaaattcatcagtaattctcttcaagagtcactccggctctgttcattcattttatattgggaggaggtcctcatgaaattagttactgtataggtctcaacctatgcattctttcattgttgctgtggaaacaagcaataaaaatcgtgggttgaagaagaaaaataatcggtgctgaacatctgtaaaatacatgataattaacttgctttctgtaatccagaattttaaaaaaatcatcatacttggaacaaagctgagactcataaggttctgaactaattatgtaactgaatcattaatagttttccttggaaacactgtggaaaacaaattacgccgcctttaaaggagtgtttccactggtagcagcattcacagagccgctgccatcagctctgcagcgtgagctcagtcagatgcatgcctggacacacgccaccagctggtcactgtttcaatagggtcgggaactagatggtcgggaactagagagacattgtcaggagaaacaaggtcgcagactgagcaggatgctgcctgtggttcttctcgtggctggctaacgggctgtgaggggagaggcagccagggacgctagcactggccgccatcccccgggggcagttagtgagacccaccctgcccccaccctgtgcactgtgagagtggcagttagaattggttgtcacttgtgggtgttttgtaaagtgcatttctgatgttctttgaaaggacagaacatcatgggtttggtgccctgtgtcacaccctgagtccatggggacaggcggagtcagggttggggctggaagagaaccgagagggcatttaatccagtcctgttatgttattgacagaagaaacagaggctctgagagggtgagggatggaccaggccgctccttgctcaggaatcacagtgccggtccctgctggccagtctcgggctgccttccacatctctgtgtggattttcccctgatgtcttcagctgtatcttgctggtttgaacaattttcctttcataaaatattgtagttagggcagtcactctgcccaacagtgttgggtctgaccaattaaaatatgcttcattaattttttatgatacccatttttatccaaaagaagaaaaaagtcattttgtgcttctgtgaattctttcaagtaattcatttatgtttattttaaaaataagtatattgttcctttgtcaaccctaaagccacaaagcttatgggcattttattggttgactctggctgacctgttttatctgggtgtgagatacagatacatagtgtatgggtatttggtggaatgctgtctcaggtcattctgctgaaaagtgatgtcaggacatcagtaatgtggatatgtttcagtagtttggtaaaagctgttatggagttgtaaaaattagcctagtataaagcctataaacccatcttaggaatattctatttccagccaaatcataggtgctcctactctgtgatagttcatggtgacgtggtatgtggggtgtaaagtgtgatgatgtcatgcagcaggttcaagtgatggagacatgtttttcttttctgctcttttgcaggacagacccacgaagtcaagcatgcggagtgcagccaagccctggaacccagccatcagagcagggggccacggcccagaccgggtgcggcctctgcctgcagcctcttccggcatgaagagttctaagtcttcaacttccttggcttttgagtcccgactcagcagggtatggatcaaaatgcacagggccaggcagagcgcctggataccctgggttgggaggattgaagagggcagtaagcaaaccagtggcctctcggggcagggaaggaggctcccaaggaggggtcgcaggaggaccagcatgcctggacatgaaggaatagagctagcgggtgggagtgggggccctctggggtccagaaaggaggtctgcaaagtgtttaacacagtaattaaggtcctctgccctgggttgcatggacatcccggcagttttgccccaagcacggccctggataggggtcgaggtcatgcacgatctttgcagccccccacaatccagttgtagttcttcaagcccctcttactggaccccgcagcagcatggacgctgttgattacgcccttcatgagggagtgcgttctcctctggttttctcctccccccatccctttggtctctaaggttgggtgggcccatgccacattcctagactcatctcttttctagctgcattcatttctttacatgagaggctctcaccgtgcaaagcctagtgcctccttagctgccctgagatgaattcatagacagtagcacctacctcatgcaatactttagaaaagtcaatatgatcttctatattagcatggatttccatctgcacagctgtgctaaaggccttgagatgctccttaaagcaccacgggcgtgacagctacaatgcagatggatttgagatgcagactgatttgaattgtgttgatgactcaactacggtgaaggctgctgcagaaggagtgacgggattgttttgaaatagcagacactcttggtgaagttctgaaccaagcatggtgccggctccctttgttttagtatttttggacttagagcagacactcttggtgaagacactcttagagctaggcaaggggcacattgtttttatgagtcaaatggagggaggctctaggctcagataataataaaaggtgttccacctgtgtcagtgcctgcggaatatgtggaaagtgtgtgggtcgtggagcagttctttgtgtaagattgtcatgagcattttaggacatctgaatttcctgtcctcctacccgttaaatattagtaacacatccagtcatggtgacaaccaaaaatgtgccctcagattttcaacacatcccctgagggacagccctgtccccattgagaaccattgttctaggtgacgggtccattctcatggcttttaacactctaagtggataacgtccaaatttgcatctccagctgggacccctctaactgcctttgtgacatcacccttggatgtccaaaagtgtaacatgtccaaaaccgaatctcaatgccttcctctccatctctctcaccatcccctaacctgctcccccaaatcttcccatttgtgtaaatagcaactccatcttcttggttgctcaggccacagccagtggcatcacccttaaaccctccttttctcatgtctcacagtccatcagtgaaatgccatcacttctaccttaaaaatatgtgtcaactccaaccaattcccactgcctcccttgtgaccagttgggtcatgcccccacccttctgtgccctagtcctggtccttggaacacctgagtcatgtcacttctctgcgtcaaccctctagtggctctccccattcactcagagtgaaaagcagagtccttgaaatggccagcgatgccctcagggcccaaccctgtcccctgcctctcaggtgtggtctcgctcctctgtgccctggctcctggagctccagccacacgttctgctggtgtttggtgacagctgtccttcggattgccaggtgcactcctgcggcagtgtgtttgtgtttgctgctccctctgcccggaaagcacctggtgcctctataggaagtgtccttgacctccatcctcctcctcctgctgccttgttttccttctctgctcttgatgccattgcacacacctgcttgtttacggtctgtcttctcatggctggaaagtaagccccctgcagacagggactgtatgcttcttttttgtactcggctctgtccctagtgcttagaagagcacctgctacctggtaggcactcagtatttattgaatgatgagcacacctgttttctggcggtctgatggaacaagaggagcttgggggcgtggggctggcctgagttggaatcctggctctgccacttccccactgtgaagctgcaggcaagctgtgtagctgccctgagcttgtgcttccttgtctttcagatgaaggtaacaccttctttgtcataaggagtaaatgtgggtaaagcatcctatgtgtaattttgtttattattctattatcctggattgaaacatcatttccattatttttgtttttattattttcaacccaacagcacactttaaacttagatttttatgtttattattattttttctatatccaataagcaacatataaacttagatttttaaatgaatacatacattccacaataacagatcattagagctgctggaatacggaaatatttttaaaagcagtgtttaaaataaggcctcggccgggcagggtggcttatgccactttgggaggctgaggtggatggatcacctgaggtcaggagttcaagaccagcctgaccaacatggtgaaatcctgtctttacccaaaaaaaaaaaaaaaaaaaaaaaaaaaattagccttagccgggcgtggtggcatagtcctgtagtcccagctacttgggaggctgagacaggagaattgcttgaacctgggaggcggaggttgcagtcagccaagagcgcaccactgcactccagcctgggtgacagagtgacactctatctcaaaaaaaaaaaaaaaaaaaaaaaaaacccacaaaatatataaaataaggccggaagaagcataggaatgtttctaaaggacaatgaatgagatgctggacacttctcccattgataggttcatgttttggaaacttgttccaaagagaaaatgtcagggaaaagcaaatacagtcattccttggtatccttgggggattggttccaggacccactgtggataccaaaatccatggatgcttaagtccctgatataaagggtgtttgcatataacctacacacatcctcccatatactttaagtgatctctagattacttatgatacctcatgcaatgtaactgccgcatacatagttgttatactgtgtcattttaaatttttttattgttgtattgttaatttttaaaattaatgttttgaataactttttctgcacttggtaccatgcgcatattaggggccttctgctctccttcccgattcctgtcctctccaggcctgattctgtgcaggaaaatgatagggcttgagggaaggagcagcagaaagaaatgtagcccgcctgacctttccagccctggttctgttcctctgatttgaccttaatctttccacctatggtatgggaagaagaaaaatactaaaaaggaagtcagagagcagaagagagaaagaggaaatggtggtggacaaaaaagcaagtaattttccctcccaatattttactgtgacaatttgtaagcacacggggaggttctacagtagtacaggggatcccacagcagacaccatagaccaccacctaggtcctacagttagcatctcactatatttgctttataggaaatggatagatagggtttcactggtcaaaacaggaacactgagacaaatccactgaaagtagaactgaatacctgactttctttttttaaattttaattcgaattattatttttttaaaattttactttaagttctgggatacatgtgcagaacatgcaggtttgttacataggtataaatgtgccatggtgctttgctgtgcctatcaaccagtcatctagattttaagccccgcatgcattaggtatttgtcctaatgttctccctccccttgccccctacccaccaacagacccgggtgtgtgatgttcccctccctgtgtccatttgttctcattgttcaactcccacttatgagtgagaacatgcagtgtctggttttctgttcctgtgttagtttgctgagaatgatggcttccagcttcatccatgtccctgcaaaggacatgaactcattcttttttatggctgcatagtattccatggtgtatatgtgacgcattttctttatccagtctatcattgatggatgtttaggttggttccaagtttttgctattgaaaatagtgctgcaataaacatacatgtgcatgtgtctttttagtggaatgatttatattccgttgggtatatacccaataatgagattgctgggtcaaatggtatttctggttctagatccttgaggaatcaccacactgtcttccacaatggttgaactaatttacactcccaccaacagtgtaaaagcattcctatttctccacagcctcaccagcatctgttgtttcctgactttttaatgatcgccattctaactggcgtgagatggtatctcattatggttttgatttgcatttctctagtgaccagtgatgatgagctttttttcatgtttgttggctgcataaatgtcttcttttgagaagtgtctaaatacctgactttcaacattggcctgaactgaaggagcagtgaaagaaagcagggtgcagaggctggggacgtggacactcagggagggtgcatacactcctgtaaatcctccttgtggtatctgagcacagcccagaaagaagagaacctgcagtgtcatttgcgaggcccaggtctattaattggggtcctcttggttgcaaatgatgaaacattggcttaagcttgcttcagcagaaaaggaatgtactgagcagatcctaaggctcccatgtcactatgagcgggacaaaggtgcattttaacaaacccttcctgtgactctgatgtctgctcaagtttgagaagcggtgtccaaccataacatgttatccaccagtaacgaccagattatgttatgtctgatgattttagggctgtgaattcttttctacatctttgtggaattgagaggaatttcttagttactttaatctgtgaggcatttgaactttttccttttatatactttcttatacaggtggttggcagcttaaatatcagtgaagctgttaatgaagatacttactaaatagcaaagcagcaccgaagtgcacaccttcataggatcttctggagcaagccagaaatctcaagtggtgctgtggccaggaaacaaagcaaaaaatgcagtggtgaatagagaaggagcaagaattagtaactgagactggtagctttccttttgatgttgcatccaaaaagcagtgacaaagtaagagtagctaccttcagctgtttgttttgaaggacacgtgggatcagttttttgtctttatgtcctacccccaggaaaccttttaagctaccagtctttttcaaatggaattcctcgtggaaggtgcaggggaaatgaagtgctccccttgaaagctttgctgctacccaaactccatgccctatgggagggaggtggcacagcactggcctgcagcacatcatacttatcctgttgtctgggaaggacaggaccacatctacccacagtgcagcataaaatcccctagtccaagaggagacagagtcagctgagtgtggctggctcacaaaatggaacacaatagctgatgtgtgttatctctagctgtgcctggtgcatcacaggcaggcacactatgcatttttactgaatattgttcttggatggatttaccgaagaagagcctgaggttcagagaggttgatgacttgcttgatgttctattgtactctctggaatccccgttgcattgcgttcatttttcctaaaaacactcccctcctccctcctcctccttgccttaatttgaatttagtttttacaggataacaatagtaaaaacaataatgatgattttcatttgttatcgttatagttggtgtctgttcaatgcatactgtgtcagacactgttatcctaagcacactgcatggctaacttgtttaatcctcagagcaacactctgaagtgggtaccatgatcatacttactttttaggtgaagaaaccaaagcacagagaggacgtgatttgcccaaggtcacacagctaagcactggcagagccaggattcagacccaggtggtctgtattttcagcccttggccactaaactgtgctgccacgtgacatagcttttttcccaacccctgtgacgtgggatggggacctcctggctcctgttggtcttcagcctggtgttgctgtggaagacacccacccctccagaatgcctccctgccctctctgcctgagaaaaactgaatcatggcctcttctgtgaggtcttgggactcccccagcccctcctgggctttctccacattcgtttctctgcagcttagtgctgtcctcagtgtgttctgtgtggttatatgggaacctcctctttaggtggttaactctgatcggcagggcctcctgattcactttgacattcatgccatatgcacagcatacagatcttctaagtggacgtaggctaaagatgtacgtccagcctctagtgggtttttggtaaagcttagctgaattacagtgttcagaatgggagggacaggaatggagaagccacaagcccgacagaagcagccctggcaaagtgacaagaagggagggaggggtttggagctgtttctcctgccgatcttcccttccctctcccacatacatgtggagggctgctgcagtctccctaggagcatggcatcccaggaggagtgcccccctctctccccaggacgtccgcatcccccgtccacttcctcctggcactgaaatctggactttatctcactgcaggattcactgaaaggctgttggatggctggaatccccttcagcctttacagctaacatactaggtgttcccatattctaagggctcttttactgtgggtgagctggctggaggagaaggggagaggagaagggggacgagaaagggagccccaccctctgctcaggacccattgttcacattcttttccgtgtgaaatgttgctgcatccaggccctaggctatgagtggtggcatttctatgtttgtggaatgaatataaagtctgttttaggatcagtggacaaaaatcagcatgtttgaagtggaggttacaatcagttggttagtacgatatttgacatttaccctgggcccttaatggtgcagtttttctgatgtaaggagggtgaaaaagcagccactatgtgtactaaacagaaggcgtgatgagtacagtcagtgcaggatcgtgaaggcatcagcacattccttcttcagctaatcagcccagacagtgtggggtatttttgtattctctgctgtttgtgctctgagtacatgtgcacaaaatgcagtgacactgatcaataaactctttaagcctaataagcatatgcagtctcatagcaatgaggacataaacagggagaaggatcttaggtgattcaaattctcttttgttggccaggcacggtggctcatgcctgtaatcccgccactttgggaggccgaggcaggtggatcacctgaggtcaggagtttgagaccagcctggccaacatggtgaaatcccgtctctactaaaaatacaaaaattagctgggtgtgggggcacgtgcctgtaatcccagcttcttgggaggctgagacaggagaatcgttcaaatctgggaggcggaggttgcagtgagccgagattgtgccactgcactccagcttgggtgaaagagtgagactgtctcaaaaaaaaaaaaaaaaaaaaaaaaaagaaaaaaaaattctcttttggaggtgaggagactgagctaccagatccaaacctttccagggctccatggctcacaggttgcccgattcctaatacagcatggtacttcatgccctccttccaaaggaggatttagattttgtttgtaaatctaaagatgcttctgttgctgccagcctggagaaccaccatggagagccactaggaaaacagctgcaatgatgatgttgaagatgatgagagcctccaacatttatgttcttaataaaatgctttaaatttttaactaagggcacaactctagagatacgccaactgctttctcttttttttttcggtgggggggcgggagacagggttttgctctgttgcccatactggagtgcagtggtgcaatcatggctccctgcagcctcgaactccagcgatcctcccgcctcagcctcctgagtagctaggactacaggcacgcagtgccacaccccactaatttttaaaaaagattatttgtagaaatggagtcttactatgttgctcaggctggtcttggactcctgacctcaagtgattgtcttgccttggccttcaaatgttttctccattttagaattgaggaactgcagcatcagtacctgggtcatataggtaggaagaaggagcgctgctcccttcaccactccctgggctgcctccttcctgtgtgattgcagggaacctcctatatagagatcccagatcccaagtcttcttttgcatgtcccactccctccccacccttgaaaacaaaaacaaaccctgcgatgcagcacttactgctgactcctcaccagagaccccccagccctgagcatggtgctgcagctacctgtgctttccccccggtcactgctactgcttcacccctgttcttatcatgactggcgccacctatgttaccatgccaggtcctcttgcagtgcctcaaaggcaaaactcccactgcttgcgcactgctgtcttgtgttgcctccagctgtcatctcaccaagaccttgagtcccaggaaccaaccccttatggaagggggcagggcaagctctacctctgctgctctggggtggtggctggggatggaggctgtggtgggatctccgagggggtttcacttctgttcccagtaggagtgctctcatttgttggatttcctggtttattctgggtttcagagagcccttcctctcttggcctttgctgtagagtttgaaaattctgtactttgagtcagacttgcagattttagaaatgtcagagaatcagataggggaaaagcagaatccaccgtgtatggcttgcgttattgcgttaagaattcccttaaccactgtgatttccctttttcatttgagaagtcatctagggagttttcaaagtttcaaaccagaattgattttcatttggggaccagggaggcacctgagtgtgcttcttggaagagtgagtaatagtttttctctattgagaaaaagctgccaacattatagactatggtcatttaatattaaacatgtattatacaggtgacctgatggatggtttgagaggttggagagcttgagtgaagggatgctttttactctgagatgggaagtggaaagaccattacagagttctctaagaagggtagtagtgtaacttctggattaactcaagtgtcatgtttggtccatgatatggtttggctgtgtccccaaccaaaattcatgttgaattttagctcccataatccccacatgtcacaggagggatctggtgggaggtaattgaatcctgctgttctcatgatagtgaataagtctcaggaggtctgatggttttataaaggggagttcccctgcacatgctctctcttgcctaccaagagtatagtgagatgtgactttgctcctcctttgctttccaccatgattgtgaggcctccctagccatgtggaactgtgagtcaactaaacctctttcctttgtaaattacccagtcttgggtatgtctttattagcagcatgagaacagactaatacagtccagttgctaaattaggggactgtgctgttgttcagaaaatgtggtcgtgggccaggcgtggtggcccacgcctgtaatcctagcactttgggaggctgaggcaggtggatcacccgagatcaggagtttgagaccagcctgggcaacatgatgaaaccccgtctctactaaaaatacaaaaatcagccaggtgtggaggcacacgcctgtagccccaactactacttgggaggatgagaatcaggaaggcagaggttgcagtgagccgagatcgcatcacggcactccagcctgggcgacagagtgagactcgtgtctcaaaaaaaaaaaaaaaaaaaaaaaaagaaaagaaaaacaaaagaaaatgtgattatgctgacatctagtaactggagttgcacacaaatcatccttttaatgtgaattacttgtttttaaagttaataatttgttttgaaatcttgaccaagattgcatggctaatatgaagacatccaccatcaggctgggagtggtggctcataccgataataccagcatttgggaggctgaggtggaggattgcttgaggccaggagttcaagaccagcctgggcaacatagtgagatcctgtctcttcttttcttttcttttttcttttttttttttttttgagatggatagactgtttgccagtatagagtgcagtggcgcgatctcggctcactgtaacctccatctcctgggttcaagcgattctcctgcctcagcctcccgagtagctgggattacaggcatgtgtcaccacacctggctaatttttgtattcttagcagagatggggtttcaccatgttgaccaggctcatctcgaactcacctggctaatttttgtatttttagtagagatggggtttcaccatgttgacaaggcttgtctcaaactcctgacctcaggtgatctgcccgttttggcctcccaaagtgctaggattataggcatgagccactgcgctcgaccatgtgatcccacctctacaaaaatatttttaaaaaattagccaggcatagtgttgtgcacctatagtcctagctacttgggaggctgaggcaggaaagcccaggaattcaaggctgcaatgagccatgtttgaactactacactcctgcctgtgtaacagagcaagaccttgtctctaaaaaaacaaaaagacttctaccgtcatccctcttgttaaaaggcaatggcgagttactgtttaatgagtagactttatttgtgatggtaaaaatttctggagatggatggtggtgatggttgtacaacatggtgaatgtatttaataccactgaattgtgcacttaaaatggtgaattttatattatgcttattttagcacagtaaagttttaaaaattacaaaaaaaaggaaaaaaaaaaaacccagaaggctagtatttgcaggagtggaactaggactttgcctaaattgcaaacttccttcactccaattttctttttctgttttaatgaagcacagcatatttacaataaaatccataaagtacactaatcttaatcttagctataaagctcattgcatgtttatatttttttacacttgtgtaaccaccaccctgtcaatatgttgaacgttccagcaccccagaaggtttctttttggttgtaactccccgagaggtaaccactattctgacttatattaccatcatttgattgtgcagcttttaaacttaatacaagtggaatcaggcagtatatactcttttgtgtctgcttctttcacttagcataatacctgggacagccacccatttattagtatatcagtaattcatttttttcctatttgctgtgtggttctcattgcatttatcctctctgttgaaggacatttgggttgttctagttttgggctgctataaaaaaggtgctatgaacattcttttgagggacctatgtacttgcttctcttgggtgcggatctaggaatgggattgctgagtcacagggaactgtgcgtgctcacttaggagtctcccttcttcgacttactgcctttcagcaaatgtttgtcctacccctttcatgacagggaagaaagcaaagcaagagcagagggtgttgctttcttctattttccagccttagcgttagtagatactgccactttccaaagcagttatgccagtttacacttccactcacagggcatgagtgttccagttgcttcacagcctcaccaacacttggtattggtgtttattcactttcaaactatggtggggtgagggtggttacaccctgaaatttaaatgatgcaaagatggaaactttaaaaaattgtgcaaatatttaaacttctaactctcagtaaatgaccccaaagccagtggagtaggatggagcagggcttttcccttcagcctgtgtgatgggcggggctcgcccactgcatatcgacattgatttaagggcttttccttactgtgtgctctggatgtcagatacattagacagctttgggcagctgccttctccagtcttccggcactgttcctctccagagccttctttcatgaagacccaacagtagttgagagaattcagttgtggtttttctcattaacgttgaatgtaatctatctgggcctgaagtgtggatcacttaggagtctcctttcttagacttcagcaccttttagcaaatgtttgtcccatgacagggaagaaagcaaagccagaacagagggcgctgctttcttctgtcttccagcctccaagatttcctttctcacctttgaacacattttctgtgtcagatcatctacagaatgcttggtggtgaggccacagcagatactcagattgtttctctccctccacctcctcctggcctatgtcatgagcctttttttgttgtcctggaatttcttttgcattgccctaccctgccttttgtgcatctcccagttcttttttcattggttcccattctttttttcccccaccaggagagcagatttattttttatttaaaatttttgtttagagacgaggtttcactttgtcacccaggctggagtacaatggcacaatcatagcttactgcaaccttgaacttctgggctcaagcaatcctctcacctcagcctcctgggtgtcaccatgcccagctaattaaaaaaaaatattagcgagacagagtctcactgttgcccaggctggtcttgaactcctgagcccagcagtcctcccacctcagcctcccaaagttctgggactacagtcgtgagtcactgtgcccagccacattttttaaggctcattacttgaagtgtgacctgatggtattcttcacgcacagtcttagacactgctctttgaaacagtcatgggagatcatactcggacctgttatgacagaaacaggtttgtgtagctttgcattttttcacttcactctatcatgctactcaaagtgctgttattgtatcttgactgctgggcacatagcccagctcccatgctctgcttgtttatagcgctccttcctgaaaaccacctcttcatcctctctctttccttccaactctctcagctcaagagggccagcagtgaggacacgctcaacaagccaggaagtaccgctgcatcgggggtggttcgcctgaagaagaccgccactgccggagccatctcggagctcacggagagccgcctgaggagcggcacaggtaggagggaccgggcaggtgggctcggcaggccatcagtcctggccgcatggaagcacttcagtgacccatgacccatccattccttccctcgtgaaatatttcttgaccacttaccctgggccggaactgttttaggcagacgatgtcgctgcccacagggagtttacatctatagagtggggagaccgatgagaagcaaaaggtaactgggcgtgctgtggtttctttggtcccttcggaggtccatttgtcaccatgcacgtgtgaaatccttctgacatccaagcagggcggcatatgttctggggctgtcttgatacagaatgcattagaggaatgaatgaaccctgttgatcccttgcgaaggtgggtgtctaatatttgtactgaaccctatggaaagctgggaagagcctcgcccagcagctgtggaaggctgctcagagtggcttggacggcagtggcaacaggaagctgtgaaccttctcagtgttactcattttttaagaatcagaaaagggtttttcaatcattatatttgagttcagagcatgtgaaacatgaaatatcaaagaatttatttaattctctctttgtgcatatagataataactcttaagctttcatggcctaactcttacagtgcagccctcagtgtattgctaaattgtctaagacgggaaaaataactgaaatacatcgttactaatttttaatgtgttgaaggggcacttataatttttgtgctcttttcgtaaaagtcacattcaggctagatctcaaaaggtatattttaatttatcagtttttaaaaagttgaatctgtgaaaaccatacaaggtattcttttcttggatataaagggaatggcctggtttttctatataatggctttaccattgtaaatactgatattgtattaaacatacacacacacttggtttttaaaatacaataaacaaaagtaccatttatttttatcaagccagcctaacagtgatcccaaaagttaataaagccccactcaaaaaaagacagactgggaggagcctaggggcagggtgggaatgaggaccagccgagtcccgggtgtgggacaaattgcgtgtgtgtggtgtgtccccaaaagcaggaaggtggcgaaaggaggcgaatcccagtgggtggagggaggggaaaggcggaaggagaaaaaggtgggaggaggatcgggtgggagggtggtggctcactcaggacccagggggggggcagcgcgatgaggtgggtggccctgttcctgaacggcagccccaagaagggaaaggtggttgctgtatgtggaactttatctgatttgctttctgtggccagtggtaaacttggcataaaagccaccagtgtgtataatggcaaaggtggactgattgatgatattgctttgatcagggatgatgatgttttgtttgtgtgtgaaggagagccatttattgatcctgacagattctaaaccacctgagggattgtcaggattccacatagactggctaacattaaatgctggaggggcggtactttacaaccacacagagcactttagtgaataaagaacctgatagtatgctggcccacatgtttaaggacaaagatgtctgggaaataagcaagatcacagaggagctttcttaattgaccgaagtcctgagtactttgaacccattttgaactacttgtgtcatggagagcttattgtacatgatggcattaatttattggatatgttagaagaagcaagattttttgtattgactcattgattgaacacctagaaatggcaataaagaattctaaaccaccggaggatcattcaccaatatcctgaaaggaatttgtctgatttttgctggcaacttcaatcaagtcagaactgcgatgccaaggtttgaacttcagtggtgctgatctttctcatttggacctttgaaacattaacttcaaaatggccagtttaagccgctgcagtcttgcacatgcaaatctttgctgtgcaaatcttaaacaagctgatctctctggatcagtgcttgactgtgcaaatcttcagggagtcaagacactctgttctaatgtagaaggagcatccctgaaactgtgtaattttgaggatccttccggtcttaaagccaatttagaaggtgctaacctgaaaggtgtggatatggaaggaagtcagataacaggaattaacctgagagtgactaccttaaaaaatgcaaagttgaagaactgtaacctcagaggagcaactctggcaggaactgatttagagaattgtgatctgtctgggtgtgatcttcaagaagccaacctgagagggtccaacatgaagggagctagatttgaagagatgctaacaccactacacatgtcacaaagtgttagatgagaattttaggggctggaggaacatgtacaagatgaaaatgttttccttatcacttttctttctccacccgctcagttgtctagaagaaataacactgtaaggaagttaaaaaaaaatttagaggattatgcttgttctcagtggtgcataagggaaaaaattgacttttttttccatattctgatttttaacagaaaagcactcatttaatagatatagggaaactagatattgctgccttttgaacagggtaggggggtttacctggttttatgaccaggaatagtatctattacatttgcttttaaataggcatgatgtggaaataccatcttggtttgagatgcatttgaggattttaatttatggaaagcacaacatatgcaatttatatttattgaatactagatgcagtatggatatttaaattgtaaaaactttacgaaaacttggaaaaggttgttcaggtttataaatagctttagtgatgcctccttctttaaatacttgtcacagcatatgaatatggtaagatcagactccctaagactcttcaggttcatttttataatgtttactttttagaacaaaacagtagctaaattacagtaatatccagttcttactgattgagacagagtggaaagaaagacatcgttgtacatcactgtcattccaaaggtacagtggaactccggatggaggaagaacttacctatcactacaacacttataaatgagcatttctcagaatgtcattctaggcaagttccactcaacaccagaccaagcaattctgtctattcacactattagcctagttttctcatacaatcagcacaagcataggaagatacttcaaaaccaaaaaaccaaggtgcaccattaatattcatttaattcaaataccaaatagttttacatagggccatcttagaaatagatattaaatccagatctactgcaatcaaagcttacacaatatgaatgaatatggtagagttgcctgttaaaaggcaatgtaatataattgctgctagaaccctacagtggggaatgaggaattttaaacatatatttgattacagccaccaaaaaagtatatataaagaaagtaaaaataaaggcatttggctggtccaagatgtaacaccaatcagtcagcacctatgattcttttacttacattttttactttttgtttttgtttttgtttttttgagacagagtatcagtctgtcgccaggctggagtgcagtggcgcaatcttggctcactgcaacctccgcctcctgggttcaagcgattctcctgcctcagcctctcgagtagctgggactacaggtgcacaccaccacgcccagctaatttttgtatttttagtagagacagggtttcaccatgttagccaggatggtcttgatctactgaccttgtgatccacctgccttagcctcccaaagtgctgagattacaggcgtgagtcatggcgcccagcctgtttttttttttgtttttttttttagtgaaatttagcctgtttttcttgagtcattttctctctgcaacagtagaggaagggcctgtatctccctaccaatgacctggtgtccttacatctaccccaagagcagggatgttagctgtgtccacagggttctgaattctacagactcatcaacatgaggcaaggaatcattgaaaaccacttttgtctcctttgggagaatgactcatctttagtatttatgtagtgtattcttctatatctacatatgcaaagctttctttgacagtaaagggcacatatgcatagtgggagaagatcagacctttacaagtgaaggaaagcaacttcagaaatgaattattttctttgctttattatttttaccaagacagagaagtattgtattgagagattatctattttcataatcaacatttgcctaaattatatttaaatcatttcactttgtactatattttcaggaattatagaatgtgttattcactcacttaaaggtacctctgtagaaataacctaaaactgcagaaggatccgaaagatataacatggtgtgtttagaaactgcagattttagatctaatgtatactgcattaataaatgatgtaaagtgtggaaaaggaaaaaaaaagactgatcccatgatcaaatattaatataaaaatttgagatcagccgggcacggtggctcacacctgtaatcccagcactttgggaggccaaggtgggtggatcatgaggtcaggagatcaagactagcctggccaacatggtgaaaacccatctctactaaaaatacaaacattagctgggcgcggtggcgggtgcctgtaatcccagctactcaggaggctgaggcaggagaatcacttgaacccgggaggtggaggttgcagtgagccgagatcgtgcaactacactccagcctgagtgacaaagcaagactgtctcaaataaataaataaataaataaataaaaataaaaaaaattggagatcaaaatattagtgcataggattcaacaataaattaaaagaacagtagtgtacatcacaactaagtgaatttatgccacccaagaatggatgaatattaagaaattttggaatataatctatcataccatattaacaggccaaagaagaaaaactgtagttatctctatagatacagaacatacatgtgacacaattaacaatctttctaacaacaaactcttgatagactatacatgtgcagagacttctttaatgatgtgtatgtgtcacaaacaaaagccagcgattcccattaaagtcaaagataattcaaggttgcttactatcaccagtcatctaaaattttcggtagatactaaccaaggcagtaagataagagagatgtagaagtacataaatattggaaatgagggaacaaaatgatgattgtaatcagataataacattgtatgctttgaatttcctgaaaattgtcttagaattttctgaaattctattagagacaataagagttctgtatgtggctagttgtagactataatatatcaataactttcttttttatttattttatttatttatttttttgagatggagtctcggtctgtcgcccaggctggagtgcagtggcgcgatcttggctcacggcaagctccgcctcccagtttcacgccattctcctgcctcagcctcccgagtagcttgggactacaggtgcccgccaccacgcccagctaattttttgtatttttagtagagatggggtttcaccatgttagccaggatggtctcgatctcctgacctcgtgatccacccaccttggcctcccaaagtgctggaattacaggcatgagccaccatgaccggccatcagtagctttcttaccagtgactagaaaagataataatgtaagaaacagttctatttataaaggaatgaaagggcaaaatatttagaaatagtgtgagcatctataaaaaaaatcttaaaactcttttgaaggagaagtcttatgtccttcaaagaagacataaataagtgaaagcatatatgtgattcttaggaagattaaatagaattaagattaaacttagtacaagatataaaatgtaataaggatgtctgaattattctaagaattccttttcatcttgattcagtgggaatttgggagtggaaacctgaataaaataactggaatttatctaaaacccgttgttctcaatgggggacgattttgtcccccagttccaacccagggaacaattggcagtgtctggagacttttttttttttttttttttttttttttttggctgtcatgactcggggctgctactgccatctagtgggtagaagccagagatactaaacatcctaggatgcgcaggaccgtccctgcagtggagagtgtcctgcccaaaaatgtcaacagtactgctgctgagaaatcctgacctagcagaataaatattctagagtaaccaggaaaattctgacaatactaatcaggggattaaccttaggcattctggaactgaagaggtgctaggcagctcagtggaacggtggacaaagtgcagaatacactggaagatttagtacaggggaaaggtggcatttcatatcacggtggataattcactcaaaaatgtgaccgagtaagtatttaggaaggaataaagctggatccctatctcattcctcccatcaaaataaattctaggaggattaaagatttaaatattaaaaaatgaaactgcaagactacaaagagaaagcatcagagaattaatttgtagtcttggccttggaagaacctttctaagtaggaacagacacagaagccataaaggaaaagatgaaaaatgtacttacataaatataagaaacttctttgcaaaaagaagaaattatttgcaatacatgtaacaaaatgcttatttacaaagagtttatacaaatcaataagaaaaagaaaaataggccagatgtggtggctcatgcctataatcccagcaatttgggaggccaaagtgggaggattgcttgagcccaggagttgaagaccagcctgggcaacatagtgagacctcatctctacaaaaataaataaataaaaattagctgggtgcgtgcctgtagtcccagctgcttgggaggctgaggtgggatgattgtctcaaaaaaaaaaaaaaaaaagaaaaggaaaaataatataatagaaatatatatagcgcccatgaaaaatacagatggctagtggaaagatactaagccttacttaagaaatgtaaagcaaggctgggtgcggtggctcaacgcctgtaatcctagcaccttgggaagctgaggcgggctgattgcttgagcccaggagttcgagaccaatctgggcaaaatggtgaaaccctgtctgtacaaaaaatacaaaaattagccaagcatggaagcgtgcacctgtagtcccagctagttgggagacagaggtgggaggatcacttgaacctgggaagtgaaggttgcagtgaactgaaatcatgccactgcactccggcctgggcaacagtgagaccctgtctcacaataaataaataataaataaataaataaataaagcaaaacaacaattagatatataatttccgctaatacattagcaaaaattaaaacagtttatcatttctggtgtcattaagggtgtaaagagccacatatggttgatgcacaaggacaagttggtaatatctatctaaatcttaatttaatctttcaccaagcatttctattatttagcacttaacggttactgatattcttggaaaaggatgccaacatgtatgagcaagttcagttgcatgattatttataatagtataatatgggaaacaacctaagtatgtattcatacagggctggttgaacaatgtgattttggtgcagtagaatagtatacaggcatgaaaatgaatacagtagatttgtgtgtactgatagggaaagatttccaatatacattactaagtggggaaaataatatggtgcatatggtataaccttaatttggttttggttttagaagtatatattaattattaaaatcaacttttttttcctggaaggatgtcagaatgattatctttgaggagagttagcagaattgatagtggcagaggaaaattttttcattttagattttcctgtgctgtttgaacattttaaacatatgcatacattgctatacaaaattaaaaacaaggtaaatacaacataaatttagacaatataaatataaactaaacttttttttgccttcacaaaatccttcctcttctacttgccttttgtagtgttctttagccatttgttggtggatttttttttattgtttgcttatagcatctgctcctttgcacaggattctaggaaaagaccttggtttcatattggctcctaaagtagacaagttcccatgccccaaggggcattggcatcctttatttgtcaaaggaaggaaataactacatatctactatacagtgatgttgggaaaaaggtctgtgaataatttatatagactgtaatgaaaagtaagtgacagttattattctcctagttatacaaattgtttgtcagttacttcatttaagtgaaattaaattatttgagttaatagggttgaatttgaaaattacattttgtttctgaagcttttatttttttaaatttattttattttttgagacggagtttcgctcttgttgcccaggctggagtgccatggcgctccacaacctccgcctcctgagttcaagtgattctcctgcctcagcctcctgagtagctgggattacaggcttgcgccaccacgcccagctaatgttgtacttttagttgagatcgggtttctccatgttggtcaggctggtcttgaactcccaacctcaggtgatccacctgcctcagcctcccaaagtgctgggattacaggcgtgagccaccacacccagccaagagcttttatttttaaatgtcagtagtcctcaacatttttgtagcacctttggacagctgatacttttgtacattgtcatgctgtccccagactgcctcatttggaataggtgaataccagtctattaggacagaccattaggagcagtggtatgcagtgcctgtctgttgcaggtgttatcacctctacagttgtatagtattgtttcggtaatcatttcaatatttgattgcattttgtctattttacatgcgtgaaaacgaggaaaatgaaagtgctggttgggattacagcaactagttgtacaggctgaacatcccaaatccaaaaattcaaaatcccaaatgcttcaaaatctgaaatgttttgagcactgacatgatgctcaaaggaaatgctcactggggcattttggattttggatttttggattagagatgctgaactggtaagtataatgcaaatattccaaaataaaaaatcagaaatccagaacacttatggtcctgagcattttggataagggatactcaccctgtagtaataagcttgggttttaaaatctcagtactgccgggtggggtggcttatgcctgtaatcccagcactctgggaggccgaggcaggcggatcacctgagatatttggagaccagcctggccaacatggcgaaaccccttctttactaaaaatagaaaaaaattagccaagtgttgtggcgggtgcctgtaatcccagctacttgggaggctgaggcagaagaatctcttgaacctgggaggtggaggctgcagtgagccgagattgtgccactgcactcgagcctgggcaacacagtgagactcagtctcaaaaaaaaaatacagttgatacaaagatggaaattatttagtgtgttagaaattagatgttcactggacttaaaccaattttctataggctcagctgtgaaggaaaagaataaaattaaaggaaattgggggacttctggcaatatatagttgatttcctttcagaggaaatttcttttcacaggaaatcaactatatattagacttgtagggggcagaattctttttatgccatgcaagacttagtttttgtacttttgacttggggacaagttttctacgatgcatagcatggtattatctatattttatttcaattgtattaattttgagaaagatttttgtcatgaaattttaatacagtgttgtgattttgaacttacaagaattaaatctatagtcagcctatattttattgcaccctttcctgggagctgatctgtcctcagggagaatccctgaaatctactccaggagaaatcatgtaatcttttggtcgtaataattatattattgtctcagccttgcctagggcgccaacttgccatctgtcatgggtggtattggaactgcttgaatggggaggcatgagcttcctcattcttttcaagactatttccagtttctggtttccaggccttatgctgttctctggggctatgccaaagtttgctccaacaatagcaagaacacagcaaaaatcacaaaaggggcttctatttttgagccctgccacctgcctgcactgtgccggcttctctgagctgctgtctctattcatgctcacaatagccataggaagagcatggttattttatctagaccaggaaccttggctttggaaaggtcaaaccagttttactttttctctcccgtgcccaccacaggtttccatatggaacatccactttttctaattggttttatttcattaatattattcacttatctgaattccaaaaaagaattctgaattcttttttttgttgttgttgttttttctatagacggagttttgctctgttgtccaggctggagtgcagtggtgcaatcatagctcattgcagcctccaacttctgggctcaagcaatcctcctgccccagctctcgagtagctgggactacaggtgcacaccaccggggtctcgccatgttgcccaggctggtcttgaactcctgggctcctcctgccttggcctcccaaagtgctgggattacagacatgagccactgcgcctggcctggattccagttcttattattctttttctccctgaggtgtcctttgtgtgtatctcatgttacacagtggtgtggcttttagagaatgaggaggttccttgtgtgcagggtcctccctgcctgccccagggtcaagtgaaaggttgtggaacccccagaaggctgtcaaggaatccagccactaggtggcagccttgtcaaaagcacccaccttctcctctgctacaagttctggttctgacaaatgtttctgactttagaaacaatgcttgtatttattgattaattcaacaaatatctttgagtggctaccatgtgcctggcactgttctaggcaaaaggactatatgagtgagcaggacaaacatccctgccttcataaaggtacatgagcaagacgtgggagagatgagaaagccaggtgaacagctggagtggtggacattccaggcagagatgacggctggcccgtgtcccccacgtcaagggagtggcaggaagaccagtggggccgcagcagagtgaacaagcagttggggaggaggatagaaagatgggggagcttgcgagtcactgtcaggactttggattttttactcttgactccactggggaacttttgcaaggttttgcacagagcagtgatatgacccaacctcattttaaaaggactgctttgggctgcttgttgagagtggacagatggggtaagcagaccagcttggaggctagggctgtggtctaggaaagaagtgacctgggctgggctggcagccatggcaccggggaacagcagctgcgtctggatatattctgaaggggagagccagctggctctcaactttcctggtttttgaattgtggaaaaatacacataatcatttttaagtgtacagttcagcggcattaagttcattcacattgttgtacaaccatcaccaccttccatttccagaactgtttcatcttctcaaagtgaaactctgtccccattaaacactcgcttcccattccccttccctcagctcccggcaagcaccattctgttctttgtctctgaatctgactgctctcagttcctcataggagtggcatcacacagtgtttgtccttttgcaaccggcttatttcactcagcataatatcctcaaggtacatccacactgtagcatgtgtcagaatttccttcgtttttgaggctaaataatatttccttgtctggatataccgtatcttctttatccattcacctgttgaaggacccttggcctatttctaccttttggctattgtgaataatgctgctctgtacacaggtgtacagatatctccttgagacactgctttgactttttgagggtatatacctggaagtgggattgctggattctcctgatggattgtaaagttggtgtagggtaagatttctgctcatgttagcagtgggatgagtgagatgaaatctgatgggccttcccaagggatgaggagtgaacgtggatctcttctggagacagcagtcggctagaaggaggttcatgtagccacatttaaaacatttttaaaaccacgagacatggaagtgcccatttagatgtttctttatatagcacacgtgggatccaaagacatgtcactattttaaactgatatcagtgttttctaaaaggcaaaataaatgtgaagggctagttttactgtggccaaactctgatgcttgcagaatctcagacatctcagatggtgatcagtaagggcaagcagtcgtgattggctcactgccaagaaactgtcagtgtcctcgctgatacctggacccctgcatgctcccagttacctgcatcacaaccaggtaatgcctgaggctccaacctgagacacctgtcctctctgacatgaggagggaataactctgtcctctctgacatgaggaggggaactcgtctaacatggaaggtaagtattcttatccccatctgacatgtgaagaagcgaaagctccaggataggtagtgttcccaaattcaaacccaggtccgactccagagttcttttttctgctactctgtttgtctcaggtagggagacttgttttcttccctcatcatctttacctgttgtagaattactattaccggtgactagcattctttgctcactatgtgctaaccactgttctcagtgtgcgatgaatatggtctcctttagtctttactacagccctatgaaatagtatccttattatcattcccattttatagatcaggagactgaggcataaagagattaagcagactgtccaagtccatgggatataaatattggtaccaggacttgcagattaggaaacaggggctgaaagaaaaccatggatgggttggcttgctggggtgagagtggaggaaggggatgttggaagttttggagttgagaggccggaaggtgggtgggtcagtttcttggatgccacagaaggaggagggccatgagccagggatgtcagggaatggggagaatggggtggggatgtgtagatggcaacagggaggggaagaggatgccaggtcctgctgtgtgaactgcagaaatggaaggtgtctgtttacagtggggaggggaacagacggggggaagcaacagtcataggtatgaggtacagcgagaccttcagtttgggaaatgtgagaaaatgaacagactggccttgggaaggcagtggtgggattcatccagctgtggaagtgaggggacattcagagagctcagcctatgggaaatgttgatttcactgtgagttctgaagggccctgaagaagtgttggggactcaagggaggggcctggggcaggtggggctgaatcgctttggagatgagaacctggaaaatcacagaatgccaggaatgagtttgttcttgttttcataattttagagaggtcatttatcaatgagtatattttgtgataaaaaaaatttcagattcggtatagatgctcctccacttacttcatcggttacttccagataaactcatcataagctgcaaatatgctaagttgaaaacacatttaatgcacttaaccttccgaacatcatagctgagcccagcctgctttaaacaggctcagaacactcatatgagcctacatttgggcaaaatcatctaacacagagcctattttataataaagtgttgaatatcttacataatttattgtattagattggtgcaaaaaagtaattgtgatttttgccattttaaaaattgcaggccaggcgcggtggctcatgcctgtaatcccagcactttgggaggccgaggtgggcggatcacgaggtcaggagatggagaccatcctgactaacacggtaaaaccccgtctctactaaaaatacaaaaaatcagccaggcatggtggtgggcgcctgtagttccagctactcgggaggctgaggcaggagaatggcgtgaacccgggaggcggagcttgcagtgagccgagatcgcgccactgcactccagcctgggcgacagagcgagactccatctcaaaaaacaaaaacaaaaacaaaacaaaacaaaaaaattgcagttacttttccatcaacctaatttactggaagtgaaaagcagaatggttgtctgggcacttgaagtacagcttctactgaatgcgcgtcatgtttgcatcaccttaaggtcaaaaagggtaagtcacaccatcataagttcggaactgtctgtattttcattttcttctattttattctacatttaattcattttcacattgtggtaggagatctaccctctgaacacatttttaagcatgtaattcaggggcaatgctgcatagcaggtccctcaagcttacgcatctgtacccactgaacgactccctgtcgcactgtctgcagcccttggcagccaccactcaactttctgtttctgtgagtttgactgtttgagattctgcatccaagtgagatcatacagtatccttttgggactggcttatttcccttagcatagtatccttcaggttcatccacaatgggacatgtgtcagagtttccttccttttaaaggctgaataatattcgatcgtctggatagccacactttgtttatccatcatacatggatggaccagactggctttcagcttctggtggtgtctgaggtaaacccagttgtgaggatgttatgaactctgcactagttaaggtgctgaattctaagcttgaggacacacatggtggtgtcgtggccctgcgtttcccgggagtacatgatttagtcagggctttggagtggggccaagggttttctgtgactttctctgttggcacaaggtgcagtgctggtttggggatggcagctctcctgggtcctccctgggtgcctgtggtatagacagtggggagctctccctgcacctccccgaagaatactgacatctttgccaactctttccatccaggtcctggctgtctctccagttctccatgtcctctcttccttttatttgggctcttcccctgaagtttgctatttcctttctccctccttccctgctctcctctcctcctttcctttttgttgagtttatacctttgtttatgccttccctcccttcctctcttcttctctcccttcattccttccttcctttttgttgagtttatgcctttgttttatacttttattcctattgtgaatgggattctttattcattgtactttgttcttattttctaacatatggactatttcacgactttgaatgtcatccttacacaggaaccatgctaatcttctctgcatcattccagttttggtattagcactgtcactgactatattttctaattagatactttaaaaaatatttagtttggaactggctcgctcccttaccatcctctcttcttagcactaatggttttcagttgattctcaggtgtcttccaagcagacagtcatatcagctgcagataacaatgccttttgtctcctccattccaggagttattcttttatttctggttcttgctgttttgtgcatgtgtgaccccagttgtgttaaatgctagtgacatcttgacttgctctcactttactgtgggtgattttggtgttttctgattaaatatgatgcagaaagttggcttggggctttgttttacatgttaagtcttctcctcctatattcctttgagttattaggatttggtcatggcttttattaaatgccttctaggcatgctgttattactttgattattgcttctctttttaccctggagtctcctccaggaaattaaagtatgtgtgtatttggtctcctgggtatttcttccatgtcacatatgttatctctgattcttgtgatcactttcattcatgctctgatttttcaaagtttatcatctaatgtgctttgctttgtatgtttcttttcttcaactattatgtttttaatctttagtctgatttctgtgctttcaaattatttcttcatgacttcttgctcaactttcatagctatcaaatcttgaatttcaaatgagaatgcaaattgcagatttttttgaaatctcccatttctaccagtaactttgtttcataggtgcatatttacttggaatcctcagctgctcccccttttatgatctgccagagctttccagatagatctagagagttttctgtgatcacctatctttacagagggaagctagtattggtccaaaaatcagaaattgagagggatactactggagaatgtgtggttatcaggtcatctttttttttttttttttttttttgagacagactctcactcttttgcccaggctgaagtgtagtggcgtgaccatagctcactgtagcctggagctcctgggctccagcagtcctcttgcctcaggctctcaaagtgatgggattataggcgtaagccacagcgcccagccaggtcatatcatttacgctctgtcgaaggaagaggaaaaatttttgcattatctggggtgaaagtaaggagggcattaaagcctgaagtgcaattttgccatttttttcttttctatgtattttgtttttgttgttctcattgttactttagtgcctgttggaaggtggccttgtcctccccttctgcttgcatgatggcccctgttcttatcagctggccatggctgtttcccttgtgtggccttctgtgcatgcaggcaaggagaagggaacactagcaggccttctgaagctgctcatggcagaggcctcaacttagtagtccagttacccttttaaatgatgacgattctgtaatgtgccctttaatatcctaaaatgaaattcaccagtccatatacattactgaaaaaaatcaatataatgctgtacctataatgtagagaagaaataaaaggcaaataatttctaatgaagtgacatatcagtgtgtaagtgctggagcctgactccactagaagacagatgcttgtacattagtggagattgctgccttaagcttgaatgctacaaatgagactgactcatgggtgcagtgttgagaattcaaataccaggcgtgttgacatcagtgactttgaaatgttgacagctcagggtaaacattttgaataaagcaaagtactgtctttccttaagttacatgatagttgcattcctagaaaattcagtgtataatagcaatgctgtgtgaaactgctttgtgtttctctgtaaaacagagttagattctggatgtaggtatttataactgtgttctcctattcaggagtgctgtcagatcacaaggagggagcaggaagcaggaagcaggcgtgcccctcatatttgcaaggcttggggcaagagtgcagcgggggccatctgtttattcacaatattctgatataattaaatattctagtaaaggagatcaagtgtcagggatttcagatgacctggtagcttgtcgatctaatgacaataattttcttactcattttcatcttttttttaatcagtaatgggtgaattttgtgtggtgaattttattttttcttcccagcttcccccaagttctactttagtattttctcatttttatcactttgaaatttgtaattcttctcaaaggttaaaaaaattaatgatattcaaatataattttaaaataatttttcttcaaaatagaaattaaagtcaatataaagggtgaaatatatttcatatttttaaattttttaatttaattttttatttttagagacagcgtcacactctgtaacacaggctggagtgcaatggcatgatcatggctcagtgcagcctcaaactcctggcctcaaacgatcctcctgcctcagcctccaaagttgctgggactacagccatgcgccaccatgcctggttaattttttaaatttttttgtagagacaggtgctcactatgttcctgggctgaagccatccttccatcctggcctcccaaagtgctgagattatgggtgtgagccactgtgcctggcctgttttgtttttttttgttttttttttttgagacggagtctcactctatcaccaggctggagtgcagtggcaccatctcggctcactgcaagctccgcctcccgggttcaagccattctcctgcctcagcctcccgagtagctggggactacaggcgcctgccaccacgcccagctaatttttttgtatttttagtagagacggggttttaccccgtgttagccaggatggtctcaatctcctgacctcgtgatctacgcacctcggcctcccaaagtgctgggattacaggtgtgagccaccgcgcccagccagatttcttttttttttagctgttgaattttgtgagttctttatatgtactagaaactagttctttattggatatgtggtctgcaaatatgttcttccagtctctcttttatcttttcaaccttataacagggtctttcacagaccaaaaattttaaattttgatgaagtccaacttgctaattttcccttctatagattgtgcttttgatgtcaaaattctttgcctagagccagttttgttgttgttgttgttgttgttttgtttgtttgtttggttgttttgagacagagtctaactctgttgcccaggctggagtgcaatggcacaatcttggctcactgcaacctctgcctcctgggctcaagtgattctcctgcctcagcctcccaagaagctgggattataggcttgtgccactgcgcccagctaatttttgtatttttagtagaaactgggtttcactatgttgctcaggctggttttgaactcctgacctcaggtgatccacctgcctcagcctctcaaagtactgggaatacaggtgtgagccactgcgcccagctgcctagagccacttctttaagattttctcttatatttttcccgaaagtcttatagttttacatttacatttaagtgtgttattcatttttagttaatttttgcaaaagttgtgagacttgggtcaaggttacttttgttgtggatgtccagttgctccattgttggaaagggtatcctttctctattgaatcgcttttctacttttgtgaaaatcagttggggctgggcgtggtggctcacacctgtaagcccaacactttgggaggctgaggccagaggatggcagcctggacaacacggcaagatcccgtctctacaagaaataaaaaaattagctgggtatggtggtgcacacttgtggtcccagctacttgagatgctgaggtgggaggattgtttgagcctgggaggtcaagtctgcagtgatatataataacgccattgcactccagcctaggtgacagagcgagaccctgtctctattaaaaaagaaaatatcagttgggcatacttttattctgggttctccattttgtgttgttgatctatatgtctgtccctctgacaatgcctcatactgttgattatggtagctttgtaatgtcttgaaatcaagtagactgattcttcctactttattattttccaaaattgttctagctagtctagttcctttgacttcccatataaatatacctacaaagaaatcttctgagatttgatagtaattgtgttgaacctgtaaatcaatttggggagaattcacatgtttttactatgttgaatctcctaatccataaacatggtatggctctccatttatttagatctttgatttctttcatcagcattttgtagtttgcggcatacaaatcctatacctgttttgttagatttacacctaagtatttattttttatttttgaggaattgtaaatgatactgtatttttaattttggtgtttgtgtgttcattgctagtatattgaaatgcaattgatatttatatgtttgccttataccttgcaactttgctaaagtcgcttattagttctaggaggattttttgtttgttttagattccttgggatttttcaatgtaaacaatcatgtcatctacaaataggtacagttttatttcttcctttttcttttgagtcgttttcttcctctgttgcccaggctggagtgcagtggcatgatctcggctcactgcaacctctgcctcccagattcaagtgattctcctgccttagcctcctgagtaggtgggattacaggcatgctaatttttttgtatttttagtagagacggggtttcaccatgttggcgaggctggttttgaacacctgacctcaagtgatccacccaccttgacctcccagagtgccaggattacaggtgtgagccactgtgcccagccaggacagttttatttcttcatttctgatctgtatgccttttatttccttttcatgtcttatcacactggctagaaagtttaacactatattgaataaaagtgctaacagtagacatctttgtcttgttcctgatctacgtggaaagcattcagtcttcttctttttttttttttttttttgcttttttgaagatggagtctcactctgtcacccaggctggagtgcagtggcacaatttcggctcactgcaacctctgcctcccgagttcaagcaattctcctgcctcagccttccaagtagctgggattacaggtgcgcaccaccacgcctggctaattttttgtattttagtagagacggggtttcactgtgttgcccaggctggtcttgaactcctgagctcaggcaatccccgcccgccttggcctcccaaagtgctgggattacaggcgtgagccactgcatccggccaagcattcagcctttaaccattaattatgtaatgttagctttcgggagtttctgtagatgctctttagcaagttgaggaatttctcctctattccagtttttctaagatttttttttttctgagaaatgtccctctattccagtctttaccatgagtggattttgaatttgtctaatgttttctctgcattgatagatgtgattatgtgacttttcttagcctgttaatatggtagattacattgactgatttttcagatcttgaacctgccttgtaccctctaaagtccacttggtcgtggtatatgattatttttatatattactgaattctatttgctagtattttgttaagaatttaaaaatctgtattcatgagggtctgtagtttgcattttttgtactgacattttctggttttggtatcaggataatactacttcataaagtaaactgggaagtattcctaacttttctttttttctggaagaaattaggtaaagtttgtgttaattcttcgttaaataattggtagaattctgagtgaaatattctctacttagaagtttgtttgtttgtttgtttgttttcatttttttttggcttttttttttggtgtgaaagggtgagtttaaaaaaatttcaaattcaaatttccctaattgttatagggctactcatattacctgcttaatattgagtgagttgtatttttcaagcagttggtccatgtcttctaaactgtcaaattttatgtgtagttatttatttatttatttatttatttatttatttatttatttgttgagatggagtctcgctctgtcacccaggctggagtgcagtggcgtgatctcggctcactgcaagctccacctcctgggttcaagccattctcctgcctcagcctcccgagtagctgggactacaggcgcccgccaccatgcccagctaattttttatatttttagtagagatggggtttcactgtgttaggcaggatggtctcgatctcctgacctcgtgatcctgccgcctcggcctcccgaagttctgggattacaggtgtgagccaccgtgcctagccgtgtgtatagttattcatattatattcccctttatcctttttgagtctgtggagtctgtagtgatatccccagtttcattcctgccattggtaatctgtatattctttctctttttttgtcagaagtttgtcaattttataattttttttcagaaccagctatttgtctcactcgtttttctctatttttttttcccatttcaccgagttctgctcttctttattatttccttatctgaaaaacagagctagtcttacccatctcctacagtgtgagaattaagtgaaatgacaaatacacgtacctaggacagaagcagaagtgtagattattttgtaaaatgtgatttttttcccccttgaactagctcccttaatagaatctcctacttaggaatcatggcagttaaaaaaaaagaatctacctgccttagtgtggtgtaccttgcccagtgtttcaggctttgctttcttaagatttttcttttttttttcaaaatcacacttgactcatgttatgtctagatttacatatacataaatttgagaggaataagaatagtttagtattgcaaactactcctcggccaccatggctcctgttgcaaacactgcagggattcatgaatattccagaaccacctgttgggatggaaagaaaaagaaaatggaaaatggaacttggcacctctggcaaagtgtaagaatgtattgtattcatcctatctgaaaccagtttaacagactgaatcttttgtgtgatctgttgtcaaagcccctcccggctttgcactccgtattcccaaccagaccagtctccactgtgggcagtggtacaactcacaaaccctcacagcgttcagacgcactcttttttgtttcaaggacaaggaaaagagatgtgaagtgtttcttggggcccagatggtgttattcataacagttgatggttagggttacaagattatatattcccatatagaatattcacacattatataagtattacttcatataatgtttatatatgtttaaatataaacatattacaaacatgtatatatttatgtaatataaatataacaaaatatagtataaaatatatattatatattccctatgtatatataataaagccacacctccaatttcaatccaaccactcagggttctttctagccttgcccctttctctgcttgtaaccatcatctctggtagtagtgagaaacatggctgccagtatcctcaatttatgtacctatttgctcaatataaccagtctcaaatccttctcccacctgccacctgcacccaactccccattccccaccctccagcctcactgaccaacccacccctctgcatgactccataacatcctttcactgccccatactcagctcccatgctgaccccttgccctgggaagggaaaaaaaattgggcacaggagctttttaaaaatggtatattataaagccaattaaatgtgcttcgtacttctagttgtttgcattatcagaaagcaagatttcctgctttctttgttgagaaaggtacttcttattgcttaggaaagttttgttttatttttttgagacagggtctcactatgttgcccaggctagtctccaactcctgggttcaagccatcctcctgcctcagcctccagagtagctgggaatataggtgtgagccactgcacctgacatgttgcctagaaatgctgaaatgggggtgaatgagaaatgctgtccctgcaggtaacttggtcaggttccagtatcccatactcccttatggaagaggagaaaagggaaagaattgtaggatcccaccatataacaagttttatgttccagaagaaagttctgcttttctggttctgtgtaatcatcacattggatggaagggaagctgaaggtctttccactgaattcatggaatattaaagttccagtccttgaacttgggtgtgaccttctgaaatgttcaagtttgtcagtggaaaacatgatcagatctcttatgctgcttttcctggctgctgacacacagtagattctcagtgttgtgtgttctcttttcctgaaagtttgtgcatgttactgagtttgccattgaattgtctttgtttgcatattgatttccacttcaaaaagtagtttaatactgtgaaagtactgttcctaagcaaattacagtacagatggtcagagtagaagtgtgtactcttgatacttccctcttccccctcaacagtggaatcttgctgggattttgtcagtgctgtttagatgggacgtttatccttatttgatcaatcccaaaaggcagcccctttgtggtagttttatactgtgaaaattagttttggaacattaagccaagaagtttgcaataaaatcaaatttgtttatgtattcatttgagacagggtcttgctgtgtcacccaggatgcagtgcagtggtatgatcatggcccactgcagccttgacctcctggtcccaagtgatcctcccgcctcagcctctggaatagtctggatggaccacaggcatgcaccaccatgcctggataatttgttatttttgtagacagagtcttactatgttgctcaggctggtcttgaactcctgggctcaagtgatcctcctgccttgacctcctacagtgctgggactacaggtgtgagccactgtgcctgatcccaacatacatttaataatctacattgcagggaattacattaggaaccatgtgtgggggaccagaagataagacttgcacgtagtcaatgcagtaatgagaagaccataagaaaagtctgtataagagagggcataggcatgactttgttctgtcctcttggccacatcctggctgtgtgaccttaagcaaattaacctaccaactacaaccattccttctgttgggaggagccaaatctgtgggagtggaaaaatcactgagaagaagccaaactctaggatgttgctgtagaaagggcctacacaccctgctgtagaaagggtcctagagtttggcttattttgtgtactggggatcactatgtctccttgcaaaccattgcactgggcgcggtggctcacacttctcacacttgtaatcccagcactttgggaggccaaggcaggcagatcacgaggtcaggagttcaagaccatcctgaccaacatagtgaaaccccgtctctactgaaaatacaaaaattagccaggcatagtggcgcacgtctgttaatcccagctactcaggaggttgaggcaggagaattgcttgaacacgggaggcggaggttgcagttagccaagatcacgccactgcactccagtctgggtggcagagctagactccatctattaaaaaaaaaaaaaaaaatctgtcttttcaaactctagtcttttatcaggtaaacattttctaagttttattcattttttttggaacaagtaagacagtttacttattcaaaatgtaaagggttacagtgaaaagttttgctcctgcccctttgcccagccaccaagttcacccaccagtggtggggaatgtggtatctttctagaactattcagtgtgtctggaagcaaaaggatatccttttacctttctgtatgcaaatagtaacgtaaatggacacaccattctgcacgtgcgcattttctcttttcagtgtattttggaaatcattcctatcattccataaagaacctcctcgttctggtccccatctctctggcacttgttttatgatttctcagtggttactgatagcagttcacagcctcattcccaagttatctccgtgtttggggtttaatttccctgggccaggatatttacattcatgagatggtttccttggactttagtttcctcccactaaggtttgagctacactttgcaaatgggcaaagaccatttttggatgtatatgcctgagggaagacagaaaaacaaagctgaaagagcatccagagggtttgccttcaccatcggaaaccactcagctccttttcagggctagcttttcagactgctttccgagatttctgcccactcctgtttggccatggccgtgtgccctattttcagtttctatatatgccctcatgttttcctgagcacatcaagaacgcctgcacggttacactggtttatttaggaaccgtcccctttcttcttcagtctgtcagttactcatttgaggtcagactcacaattctgcgaatgtcttagcctcttggaggagcatcgtgtgtgatgttggacaagctgcttagtgtctctcagctggtttcctcatccataagatggagttaatcgtgcccattacagagaattgtgacaagcaaatgaaatgacacatctgcagaactaagagcagaaactgaaatatagatatttttataaaatgtgatttttccctcaaataatcttctttaacagaatatcctacttaggaattatggcaaaacaaaaacaaacttaaaaaaatccacctgccttagactcttggtcatcttttaagattcttcaagttttgctttctttttttatttcctttaaaaggtttttttaaaattaaatctttattttatttattattttgttttttgagacagagtctaactccattgcccaggctggagtgcagtggcacaatcttggcttactgcaacctctgcctcccgggttcaagtgattctcatacctcagcctcctgagtagctgggattacaggtccatgccaccaagcccagctaatttttgtattttttactagagatgggttttcggcatgttgaccaggctggtctcgaactcctgacctcaaataatccgcccttccacctcccaaagtactaggattacaggcgtgagccaccgtacccagccctttattttattttatttttatgcaacagggtctcactctgttgcccaggctggagtgcagtggtgcaatcatggctcactgcagccttgaactcctgggctcaagcagccctcccaccccagcctcctgagtagctgggactacaggtgggcaccttcatgcccagctaaattttgtttgtagagatggggtgtcactatgttgcccagggtggtcttgaactcatgttcaatcaatgttcctgctgtagcctcccaaagtgctgggattacaggcatgagccaccaggcctagcttgagtcttaatttttttttggagtttccatacaccctctgcccccacacatgtacagcctctcccattatcaacatcccccaccagcgtggtacattgacatgacagatcattgtcacccaaagtccatagtttaagtttgggttcacttttggtggtgtacattctgtgggtttgaatgaatgtataatgccacgtatcggcaattgtaatatcacacagagtagtttcactgcccccaaaatcctctgtgctctgcccgttcatccctccctcatccctagtccctggaaaccactgatctttttactgtcccatagttttgcctttcctagaatgtcacatagttggaatcatacagtatgtcaccttttatattggcttctttcacttagtaatacacatttaagtttcctccatgtcttttcatggcttgatagttcatttctttttagcactgaataatattccattttctggatgtacaacagtttatttatccattctcctactgaaggacatcctggttgcttccaagtgttggcaattatgaataaagcttctataaatactcgtgaagctttgctttaagatgacatgtttttttctccccaagttaccatcacttatcaaccagttcttttttggtcaatattaaatttttccatttttggctccaactagtaaaaatagggccagattttgactaatagatgaaagaatattctggttagctgcagcaattcagagacaagcatgttgctccaggaagtaaggaactccatgtgcttgctagagaggtactcattctctacaagtggaggagctatggagtgacaggattggaagactttcatcaaagtcctttccaaccctgaaggggctgctattaaggtcaaagacctgttcttgggtacattttcttgtatcctcccatgtgggaagctctgttccaagcctttgggttacaagatagacagaagtccttgatgattcccaaacctgcatctcggatcccaacttgcccgttgtactccagaaacactcctcccactgtttgctgaaaatgtctggggaatattctgcatgtgtattcattcattccttcaatacatatttagtgtctactatgttccaggcatctttctgggtgctagggatgcagcagttaacgacaacaaaaaaagtccctgctctcatggatcttacatttcattctcaacatgtcttaaccaaacccatcatcctcgtttcattatagagttgtttaactgctttctctagcatctggatttgtcctaactgaagtggcatttctcagtcctccagatacattctagtgttatctttattaacttcctttctctcaacatgtaattgtcatctacagttgcatcttacacttcttatttatttatttatttattttttgagacgaaatctcgctcttgtctcccaggctagggtgcaattgcgcaatctcggctcactgcaacctccgcctccccggttcaagcaattctcctgcctcagcctactgagtagctgggatgacaggtgcccatcaccacgcctggctaattttttgtatttttagtagagacggggtttcgctatgttggccaggctggtcttgaactcctgacgttgtgatccgcctgtctcagcctcccaaagtgccgggattacaggtgtgagccaccgcacccagcccacttctttttatttcttttgcattcccctgacttcacccaacacagcatctcttacccaaagcacagtagcttcctgacttgagttgctgctggtggttaatgcttactctctcgtcctatgtgagtaggatcattttcggcccatcaattgaaaaagttggctaaaccagggaaacctaaaaaaattaaactatacttttaaacattttattttcacccaaaacatataactgcacatttgttcactcatctttagttatagagccaagacattgtcttacagtggtcttgttgattgaagtttttttaaacatctttccattcttatatctcctatgatttccagttttagtttttttaaacatgagaaagaacgaaaatacttaagaggaagattggatactgaatcctttcacatgtttgcaaatattcctctattataattgcttcagccatttttagtgactcatcttcattgagtcttttcaaaccattcagcatgtcttttgaggaagcgatatctctccctctttgtactcatatttcactagttaatgtacaaagttatggaaataaatttgcaagtacaactagcataaataggtttgggaacaaatatgcttgactcttactatgaagacaacccacatgatgggagcatgagtgcccaggtgtcccagagaggagactaccagccaaaagtgttcatcttgccaagggtgtcagtcagtgtgtcctgtaaacatggggtgcattggttattttggtgaattgattatctgtaaaatgttcagtagagagtgcataagagagcaacttctgtattaccagagtaatcttcctaagccacagctgtcatgagatcacttctctgctcgaaaaccttcaagcactcctcactggttgaggggccaagggcaacatcttgccttgtgattcattgtgatctatggctgtcttacctccctcccccgttggtgccttgactgtgaccttttcacagtcactctggtgaacaacgacggggcctgctgccggggccttgcttgtctaggctgtgcatgtccaagccaagcccctccctccctgctgcccccttctctcctcctgccactgcagaccttgatggatatgctgttcacctggaaaggacccgctcatagtagcacctccttcaaaaagcgtttcttgagctcctttcaacagggcatgctttttcctttaaaaacccttctgcagcaccccatgtgtatttgttaagtcactcccatatcctacctatactgcttctcctgcctaataactctctgttgccgtgagttgaacccagctcactggacctgctcgctgctcattcagcaagcaggcaactcctgagtatgggcgatgctgtcccctttatctcctcttcttcaaagactgtgtgtctttgaatgcgagctcaccaggctcccccaggcttcagtcatgctaactgattcagagcgaggacatggctcttttgaggttgtaaataatacatcaagtcttgaaggcttatctgcttgtctcccttgactttttcaagaagcagctttattgataataatttacataccataaaattcacccatttacagtgtgcaatccagtgaattttagtgaattgactgagttacaaccatcaccgcagatgagttttaagatattcctgtcactccagaaataccccatgctgctgtttccagtcaatatctgtttccaccaccagctccaggcaaccactaatctgttttttatccgtatagctcctcccttgactctccctgccacttcctcagaattggagtgttttctggactaatgtgtgtgctatttgcctaaggaacttttcttccgattcagttacgtaactttgtgatcttctctttcactcattctccccatgttcaagtttctcttggttttctttgttgtgtgaacctagtctctgttcaccgagttggcctttggcttattaagaaaactgagctttttcccctctttcagaatatggaaaacttgaatagtgtcatgtacaaatattgtagtgtcatgtacaaaccagatgctgaatgttatctaccgaatgaaggaatctgagccctgctaaggcatgggaaatcttgtcttctgttacattcagcatagtgcgtgtaaagtcactaaattattattttggttaataaatactttttattttttggtaaggaaaattacattgtttttattaagatgattcatgcttgatagcttaaagagtacaaacaaagtaataccttaaaaagaaaagtataatatgatccagtatttccacttctggttatatacccaaaataattgaaagcaggaacttgaaaagatatttgtgcgcccgtgttcttagcagcattgtttgcaataactaaaaggtggaagcaacccaagtgtccatcaacagatgcgtagatcaacaaaaatgtggtatatacatacaacagaatgtcaggccagccttaaaaagaaagaatttctgacacgtgctacagcatgtgctacctcaaagacattatgctgagtaaaaggattgtgtgatcattcctatgagggacctagagtcaccaaatccatagagacagaaagttgaatggtgattgccagcggctgcgggaggagggagtagagagttattcttttataggtaccaagttttggttgtgcaagatgaaaagagttctggaaatgggggtggtgatggttgtacaacaatgtgaatgtacttaacacctctggactgtacactaaaaatagttgagatgccagcctggctgacacagtgaaagcctatctttaccaaaaaaaaaaaaaccaacaaaaattagccaggcatggtggtgcgtgcctgtagtcacagctactcgggaggctaaggcaggagaatcacttgaacctgggaggtggaggtttcagtgagctgagatcgcgccactgtactctagccttggttgacagagtgagaccctgtctcaaaaaaaataataattgagatggtgagttttatgttacatatattttaccacaattaaaaaataaaaataataaagggaataacagaagaagaacagagaagaaagttaaagtactatctgaaacaccacgtcttagaaacaaccagtgtttgccacaggaatattctttataggaaaaaaaaaaaaaagcctgggcaacgtggcaaaaccccatctctatcaaaaatacaaaactttagccaaccgtggtggtacgtgcctgtggtcccagctactcaggaggctgaggcaggaggattgcttgagcccaggaagtcgaggctgtagtgagctgtgatggcactactgcacgccagcctgggtaacagagcaagatcaagtttcaaaaaaaaaaaaaaaagtccgagcgtggtggctcatgcctgtaatcccagcactttggcaggccgaggcgggcagatcacttgaggtcaggggtttgaaaccagcctggccaacatagtgaaaccctgtctctactaaaaatacaaaatttagctgggcatggtggcacgtgcctgtaatcccaggtacttgggaggctgaggcacgagaatggcttgaacctgggaggcggaggttgagccactgcactccagcctgtgcaacagaggtaagactctgtctcaaaaaaaaaacaaaaaaacaaccagtgtatggggatggttttctaagcatctctttcagcggtggtaccttcgtaacgacaaataccagtacaggttcagagtagggggaatccattcagagtccttgagaggaggcctgcagcagggatggggggctgatcacgcaaggcaggaaagttgtctgtacctgcagcagtgagtgcctgataggcctgtggggcggcttcagtgcccaccacagggcgtgggggagcccaggcaacagggagcctccttctgccattagtggagggaggggcctaggctgctgaggttgagcttcccaagggagttctgtagaggagagaataaagagcacactatgtgagttcactgagagtcctcgctttgagaaaaggtgacacactcctgggactcccagaaatactgcgggaactttgcagttgggacgataagtaaatgactagggccagaaaaatattatttaatactgtttttttcttttctttttttttttttttttttttttttttgaggcagggtctctgtctgtcaccgaggctggagtgcagtggtgcgatcacagctcactgctgccttgacctcctgggctcaagctcaagtgattctcctgcctcagactcccaagtagctgggactacaggtgcataccatcatgctcggctaatttttttactttttgtagagatgtggtctccctgtgttgcccaggctggtctcgaactactgagctcaagtgatcttcttgccttggcctcccaaagtgctgggattgcaggtgtgagccactgtgcccagccagtactgttaacatgaccccattggtacccctagacttgttggtctagggaaacatgagacacacaaaatacataggaaggtgttcagcctataattttcctttatatataagtgaacttcaaaatcttgaaggccaatgatgactttgatttttctgttttagcaatagggtcttgctatgttgcttagattagactggagcttctgggctcaggcaatcctcctgcctcagcctcccaaatagctggggctactggcatgcattactatgcctggctcaatgaagattttttatatttgtaccaaggtctcaaagaaggcagtgggcagataatagaggtgtcacacgctaggaggatggatcacctaatgaatcagtggctgagacaagtacagaggttttttttgtgtgtatagttttatagtgattgatatcagtcttctttcatttagattatagcaaggttattcatatttaagttaagccctattaaggctaaaaacattctaattcaagaaggatgttcaagattctctccttaaagatattacatattttatagtttgctgtttaaagaaactatttgttttctgtgaatcctgaaatgttgatttctctttgaagattctgtgtccagcttctactggagacaaagtggtttagtgtaggaagaacgagtgcttcagtggcaacaggcctgcattaaatttcagctccctacttttaatctatatgaccttgggcaagatagcgtaatctccctgaacctcggtctcttgcttgtaagtagagaaaaagaatggctactgggtcagaccacaccggattcgctggattgtaacactgaggaagtgtgccaagtgcgtaacagaatggaaagtaggtaactcagagggtgtttaattcaggggttcggcatgccaaaaagggtgcaggttctttccatctttttggtcgaccaccctgattgtgctggcttggccctctggccagctcccctcgtcatcacgagataactactagagttctggcaacctcaaaccgaggacagagtcccatggaagaagaaggtttcagtatctctttaagaataagagaactttccccagccttcctcccagcagacctcccttcaaatgtttttggtcagaactgggtctcatagcatccttgacctagtcactagcaaggaaaatggaatcaccaggattaacgtaggctgtgcatgaaggatctactactcagctaagaacaggccaccttctctcagggccagctccctggcaggcaggaaggaaggaaggaagatgtgggaaatggctgataggtagtccacagagactgccacacttgttttgtggtgttaatttaaggtctagtttattatttggatcaggaatgtttaaaaaattaatgggctttatcttttagaggtattgtaggtttatagaaaagttagtggaaagtatagaaagtttccatatataccccctcaccatcacctccagactcccaagttactaacttcttgcattaggatggtacatttcttggaattgatgagccagtgtaagtacattgttattaactaaagtccatagtttatgttagggttcacttttggtggtgtacattctatgggttttgacacgtatccaccattacagagtcatacagagtagtttccctgccctaaaaatcgcctgtgctccacccgttcatccttcctcctaagtgcctggcaaccactgatcttactgtctctacaggtttgccttttttgtcagatagctggaatgatgtagtgtagctgaaaagaagtggccttttcagaccggcttctttcacttagcagtatgcatttaaggttcctccatgtctttttgtgtcttgatcatttctttttagtgctgaataatattccattatatggatgtaccacagtttatcattcaactattgaaggatatttttgttgcttccaagttttggcaattatgaataaaactgctataaacattcatgtgcaggtttttgtgtagacctaagttttcagctcatttgggtagatatcaagaagctcaactgctggatcttatgataagaatatgtttagttttgtaagaaactgacgctgggcatggtggttcacgcctgtaatcctggaactttgggaggctgaggcgggtggaacatgaggtcaggagttcaagaccagcctggccaacatggcaaaaccctgtctctactaaaaatacaaaaaattagctgggcatggtggcgggtgcctgtaatcccagctacttgggaggctgaggcaggagaattgcttgaacccaggaggtggaagttgcagtgagctgagattgcaccactgcactccagcctgggcaataagagcaaaactctgtctcaaaaaacaaaacaaaacaaaactgacaaactgtctttcaaaatggttgtaccattttgcatttccaccagcaatgaatgagagtttctgttgttctacatccttgccagcatttggtgttgtcagtcttttggattttcaccattctaataggtgcataacagtatggatcgtgatttttttttttttttttttgagacggagtttcgctcttgtttcccaggctggagtgcttggctcaccgcaggctccgcctcctgggttcaagtgattctcctgcctcagcctcctgagtagctgggattacagatatgcaccaccatgcccggctaattttgtatttttagtaaagacagggtttctccatgttggtcaggctggtctcgatctcacaacctcaggtgatctgcctgccttggcctcccaaagtgctgagattaacaggtgtgagccaccatgcctggccatggatcatgatttaaaaaaaatactggcacaaggaaatttgaactctggctatttggtaaaaaattattgttaatattttttagttgagataatggaattgtgtgtgtgttttttaaagagttcttatctttagaaatccatgctgaaatatttaccaatgaaataggatgtcttggatttgcttcaaaataattgaagctagaggaagaagtgggtgatagatgaaaaaaattggctctgagttggaaactattgaaactgagttgagaggcatatggagggccattatattagttctctttagttttgtgtatgttgcggcttttcataaaaggtttttactaattaaagtttaatcatgtattatttaaaaatgatagagacagggtgcaatggctcatgctataatcccaacacttcaggaggccaagtagggaaaattgctggaggcctggagttcaaggccagtctgggcaacatagtgagatcccatatctataaaacatttaaaaaagttagctgggtgtgatgacatgaggctataatcccagctacttgggagggaggctgaggtgggaggatcatttgagcccaggagttcgagactgcagtgagctataattgggccactgtattcaagcctgggcaatagagcaagactctgtctcaaaataagaaaaaagatggacactttggtgtttagtaaaaattaggaactgtcttctggtcctacctttgcttaagtttagttcttaacagtattctgaggaataaatgaatatttgttgaatatatatgtattagagtttattattcaaggaatcttcctagaaactgaagatttttggtaatatgataaattttacttgaaattattatttttagagatagggtctcactctgtggcccaggctggagtgcagtagtgcaatcatagctcactgcaaccttgaactcctgggctcaagtggttctcccacctcagcctcccgagtaactgggactacaggtgcacactaccacacttggctgattttttattttttctagagatagggtcttgtgctgtttcccaggctgaattttactttaaattattttaacatttatgtatttttccaaataaatgtatttttaactcaaaagcaaaaagcagtacatgtgcactagaaaaaaaaaaaaaaggacaagcaataaaagaacttatataaaggacatcataatcttgcctactcagagagggccactctcaatcagtgccttgaggtataattgttgaaaccctttccatcttatccaggtatctgtgtctatatagtttttgtttatgtacaaaaatttagaattgtattcttttttttttgagacagagttttgctcttgttgcccaggctggagtgcagtggcgcgttctcggctcactgcagcctctgcctcccaggttcaagcgattctcctgcctcaggctcccgagtagccgagattacaggcacctgccactgcgcccagctattgttttgtatttttagtagagacggggtttcaccatgttggccaggctggtctcaaactcctgacctcaggcaatcccgcctgcctcagcctcccaaagtgctgggattacaggggtaggccaccacccctcgcccagcggattacattcttaacatatgtactgttttgcttttaacttagtatctgacacatagctttagagactgcataggaagccatcatatagctgtattatattttattaaacttggacatttgtgttgaacattgtaggtttttccagctttttgctattacaaacagaaaggaggcaacgtgcagttgttaagaacacaaactctggagttaaatggcatggtttctctgcagaaaagggtgaatgtagcaggtctgggactgctgtccttagaaaggctgcttccaaggttggcacttggctcgtgtcagggaacttggatttcggaagggttcctgccaccctaattggtaagagtggctcactgcataaactgtgcaaacactgtagtttatgctgaactcctgttttccttccaggagcctatgtgatcgcctggtaaaaaccctggatgctaagtctctagtgaatttccctggcagacatttcacacgtgttgtcacagctcattgctggaagaattaagcacaccctgaatgactacactggggggaaattcatggaagcttgcacctagtttcctctggacttggtcttgtagaccttttcccttttctttgtatccttttgctgtcatatatcatagctctgagtgcaactgtgtgctgagtcttgtgagtcctttcagagaatcaccaaaccttggggtggacttggggacacaggtttaaatcctggctctgctgctttctagcggagtaaacttaggcaagttactcaccctctcagtcattttctaatctttaatttgagttaaaaaaacagttttgttttataaatcgaaatatataatgtacttagaatagtgcctggcatgtaattatttctcaacaaatgttaagaattatcttgcaagctagatgtttgtgtatatttgtaactatttcttttcttctttttttttctgagatggagtctcactctgtctcccaggctggagtgcagaggtgcgatctcggctcactgcaagctccgcctcccgggttcacaccattatcctgcctcagcctcccgagtagctgggactacaggcgcccgccaccacgcccggctaatttttttgtattttttttttagtatagtagagacagggtttcaccgttttagtccggatggtctcgatctcctgacctggtgatctgcccgcctcagcctcctaaagtgctgggattacaggcgtgagccactgtgcccggccttttttctttttttttttgggacggagtctcagctcatcacaacctttgcctcacaggttcaagtgattttttctgcctcagcctcccaagtagctgggatcatccctgcactttgggaggccgaggcgggcagatcacctgaggtcgggagttcgagactagcctgaccaacatggagaaatcccgtctctactaaaaatactaaattagccaggtgtggtggtgcatgcctgtaatcccagctactcgggaggctgaggcaggagaatcgcttgaactcgggaggcggaggttgcagtgagccgagatcgcaccactgcactccaacctgggcaacgagtgaaactctgtctcaaaaaaaaaaaaaagtgctgggattacaggtttgagccaccgtgactggcctgtaactatttctttcaaataaatttctgtaagaataactgctgagcttaaggatatgtactttttttaatgtgttctggtcatagtagtaaaatatatttattaagacagatatttggtatagaaaaaaagtctttcctaattctatatttcagatatagttatttctaataatttgctatatacatgtcaaaatttatttctacacatattaatatggacagtagaatatagaaatttttaataaaaatgggaccacatatatattattttattgtttatgcctgtatataagggatctttatattcagtgaagttccataaaaacctttttgtcttccttaaaacgcttagattataggtgaagtaaaaaatatgtaattataatgtccaagttgtcaacttagttatacctttacatttgaaattacacattatagaaatacagtaatttagaaattacagacagtccctgacttatgatggtttgacttaggattttttgactttgtgatggtacaaaagctatactgtacttcaaattttgaattttgatcttttaccaggctagtgatatgtggagctacacttttttgtgatgctgggcagtggttgtgagccgcagctcctagtcagccctgcaatcatgggggtaaaccttcaacagtactgcgttgtcagcatttttttgaatattgtttgccagcatttttgcatccatcctgtctacaaagcccatctcgacttagaatattttcagtttacaatgggttattgggacgtaacccatcataagttgaggagtgtctgtacactgttgctttttttatagtcatcacaggcgtctttgacatgtcaccctgtcaccatgatcatcagagccacttttaaggtttacatcagatacacagcacatcagcttcacttccgcgtgttgcttgattccactggactctttgattccacaggaaattttatcctgttcatataacattcaggcagttggtttttcatttgcccaggatgtgtgactgccacaacctgactgatccctgaactgctttttaaaattatccatggctgggcatggtggctcatgcctgtaatcccagcactttgggaggccaactcaggtggatcacctgaggtcaggagttcgagaccagcctgaccaacatggtgaaaccctgtctctacttaaaatagaaaaattagctgggcatggtggcaggcgcctgtaatcccagctacttgggaggctgaggcaggagaatcgcttgaacccgggaggctcttgtctttgacatgctagttctgtgggagaaaccccagctgggcctggtggctcatgcctgtaatcccagctactcgggaggcagagggaggtggatcacttgaggtcaggagtttgagaccagcctgaccaacatggtgaaaccccatctctacaaaaataaaaaaattagccaggcatggtagcatgcacctgtaatcccagctacttgggaggctgaggcacgaaaatcacttaaacccaggaggcggagattgcagtgagctgagatcacgctattgcactccagcctgggcaacagagcaaaactgtctcaaaaaataaaataaaataaaataatacaagcattgacaggtacagaagtaccatgagggagacagcattgaattctgtctgagatgtgcaggcagaccaaaggggggtgataacagagcaagaatttaaaagatgatatatattactctgcttcagctgccataaccaattgcacagactggatggcttaaacagcagaaatttatttctcggagtgttggaggctggaagcctgagttcagagtgccagcatggctgggttctggtgaggagtcttcttggcttatacatgccaccatctcactgtgacctcacataacagaaagagagagagagaaagatctcttcctcttctttttttatttttatttgttttattttgttttgttttttgagatggagtcttgctctgttgccaggctggagtacaatggtgcgatctcggctcactgcaacctctgcctcccgggttcaagcgattctcctgcctcagctgagaaggtgggactagaggcacgtgccaccacgcctagctaatttttgtatttttggtagagatggggtttcaccatgttggccagatggtcttgatctcttgacctcgtgatctgcctgcctcagcctcccaaagtgctgggattacaggcgtgagcctccgccagcctcttcctcttcttataaggccacctatcctgctagattagggccccccacccttatgacctcatttaaccttaattacctcctaaaggccctgtctccaaatactatcacattgtggggggtagggcttcaacatgaatttaggaaggacacaactcagttcacagcagatgaataagcatttgccaggcagctcagttatggacgaggtgttgaaaccgacggaatatagcagatatgaaagcatagaggcctgaaacaatagggtgtgttcagggagctacagctggctcaacattgctgtaatataagttgggagggagaacttctgaaagctgaggctagaacaataggggtggaggtggagcacatgattatgaaggaccttggtatactaagcttagaaggacttcatcttaagggtagaggggagccacaggaacttctaggcagaggcatggcgcagtcagatttgcatttttgataattcaggtggaggagcaatttaagtagcagcgaaagtggaagtagtaagttagttgggaagctaatgcagtagcccttgtgaagcaaagatgcagcaaagacaagagaggcaaagtctggaaaatgttaaggtgatgaaatgtgcaggacttgactagatattttaaatgtgggaggtgagagagccataggagtccaggttgggttggggtcttacttgtccagtttccataaagagacatgttaattacttgacattttacagaattagtatattgactcattgatttccaaaactctttgaataagtatgtaactgttctgtagattgaagttgtgtcactcttaccatgatcacaaactcaggctctgcctatcattttggaactatttggggaagtcgaccatcttttctgggctagttacctttttaaaaggggagggagttgcacttggtgtcatatgcatttctgctctaacattgtttcctgctatttattttccttagtatatttgcttgtacatgctcagtattgtgctgtgttttatagattacagaaataaaactgtgactcttgtctttgacacgctagttttgtggcagaaaccaactcatggtactatactaccactaaaaagaagtaatgtgtatttaagggctaatttgtgtctgctgcctgcagcctatacattggttcattcatttgttttcattcatttgttccgagtctctgtgtttataaagtttacactctagtggaggaacaataattagtaaacatgtagtatatggaatggtgatcagtgtcacagaggccagcaaagtaggagagggtgtgtgctgagggtctggcttactatttaatgtggtgcgatgagagaagcccccttagtagggtgacatttgagcaaaggcccagggagtgagagagggtgagacataaggtctatgcagtgtaggtgtcgggaggaagaatgttgcaggcagagggaacaccaagtgcaaaggccctgagatgggaacatgccccgcttatttgaggaacagtgaggaggccggtgtagcaacagcaatgtgagaaggggaaggtgagttcactgatgggggaagaggaggattattcagggccttggaggccattgtaagggctttgactttccctccaagtgagacagaaagacactggagcgttgcaagtgggggtgtgacatgatttgacctaggctttagaagcatcactctcactgtatgtgcagaatggactataaagaggcaagggcaggagaagtgagactggttaggaggcagttgcagtaatcctggcaggagatgacagcggcttggatcgggggtagcagtggaggaggtgagaagtgctgagatgtagggctatttatgatacacatactgacaggcgttgttgagggacgagatgtggcatgtgaaaggagtcgaggtttctggcctgagtcactggaagaacggaactgccacttatggagatggagaggactattaaaaaacctaagtggaggtgtcaagagaaggtgtcaagaaggtagttggacaaatgagtctggagttagaagagggaaccagcctggagatatgtagatggtatttgaaagccacaagttggtaaatcaaagaccaagagagtatataggaaagaggtctgttggctgagctttagtgcccagggtgggtcaagatgaggaggaaccaacaaaggggactgggaagaggcttctaggggagtgagcagaaaactaggagagggtagcatcctggaaccaagtgaacacactgtttggaggcgttaggagtaatcagtggtgtcctacgatgttgatgcgtgacacctgagaatggaccgtagtgttcaagtgatgcacgagatagaaccagtcataccactaatggtttttttagtcctaaatatttttactgcaagatttcgttgttctaagtgttttcactgtcagatgaaggatgaaagtcgttcagggtaatttccattttagtaatttccgacagcggcagaacagtttctacttacgattggtatgcatttttattattagccatagtattcattttgggtgagtacgtctttgttagcgttatttttcttcaccacctcctcgagttgttcatccattcattcattcacccaaagaaatgcttattaagcgcctgtcctgcgctagtcctaggtttctcttgtcctgataggtctagcttcacacgagcaggattttgcctttccggcggcactaggcttccgcctcaccgcagtggggtttttccagcctaccttgtgcagctgcggttctcagcatccgcgggcggaggcctgcagccggtcagccggtgcgtcccgcccacggcgcggggccttctggcagccaagaaggaaatacagatgaggtgggcggacagtatgcagatgacgggggcgggccgcgcctggcgggcggtgtgcagttgaggtggtccggcaggatgcagatgaagggggcgggccgcgagggcgggcttgatgcagatgagggggcggggcccacgggcgcgggagagcagcggctccgccggcagctgctgggaactggaaggcgcccggtcctttctttgactggagcggacccgccggacgcaaccgcctcgccagccggagccagcgcgagctcggcacggtggacacccggtccgaggccggcaagccggctggtgcccgagtcggccaagcatgggcaaccactcaggacggcccgaggatccggaaccaggtctgtgcggctggcgggggtcgcgccgcagccgcaaccccaccccccctccaggcgcccttcccccaccgcctccggctcgcggcgccgactggggcgagcgaaaggctaaggtcctggggtgtgattcttgtcgttggaatgcgccgcttgggattgtgaaattacctgtgccgacgccgcgaccagaaaacgctgctcgtcctgaacgcgcacctgggcgccggggccgccgggcaggcaccgctgggtccctgccgcggggttccccactccgcgcctggcctgcgcctagaccaggtctcctgagcgcgcaggccgccctcggactttccgggcgtttgcggggagggcgtgccccgcggcctctccctgtcggccgccggccccgcagtttgtggcgcccgcggctctgcccctcacactcacgccagggctgccccgcgactgttcctaacccagaatagtccgtgcttgttctggggtgtcgggcgcgcctctggttatcccgtttttacttcctcagtcctgagtgagcttcgtggagtcagttgggccgtagttttcgtcctctggtagctcatgtcggcccccagcagagttagatgccgataagcagggttgcttttaaaaacaaaacgaaacatttctggactgtcacgtgaagcaaaagggatttagttttgcctgaaaaatggcatcttggctgataggaaagaggtggttgacctgactctggagtccttgtgggggtggggggccggtgacaggtatgtgtttctgtgggagagtcagaactgtaaatattttccaaaggcgtaatatttgaattttaatttgaatgaggactttgaggctctgagaggtgaagcgacttgtccgagtgaccttttccggagctgggtgccgtgctgtaggacgctgggtcgtcctggcctctgcgcattgcttctccttcatctcccagcgccccagccgccccaccttggccctatcctcggggtggggtggaggcgggtgcctccctgacacttggggtacattggactggtaccacagccaggatggaaaacttggacgggctgtccaagtttcttcacaggaatactatgaagaaaaatttcaggggccagcttactgcctagaggtgactttagttacacagcacttgttcagactattttttgggcagaataaccaacaataagcatattcataaaatgaaatatgcataaaataaaaataatatacttgttataaataaccctgttggtaaaggattggttcggtaaaggattggtaacattttaaaaacacttctcattagttacatgcttgtccaggtattgtgaaaacccctgtgtattatttcctttgtgttaaaattgtgaaaagagttactcttgttacagcttttaagactgattggatgcctgtgttccaatttttttagtgaccttactttttaaagcactgtgatggataggacataaaaagaatatgtttatgccagtgacttattttattgtatttttcaaagaatgcatatcatttcagaatgggaactctgatttgctgcaaatgaagataccggatttagggcatttttaagagatggtgtctcactatgttgcccagactggccttgaagtcttgggctccagcacctctcctccgtcagcctcccaagtagctgagactacagacaaatgccaccttgcctggctagaaattcgtggtaaaaactttaaatgctggattactgtctgaaagtgtaattttaactggccttctaatgctgtgatgaaatgctgtagagttcatcactgagatcctggaaattagagctttgttaaagatgcgtgggttttcagtcggctttaccacagggactgggatgaggtcgcatggccccaactggcagttgtggtacattggactagaatctcaacaagtgcttccgagggtcatcagagcaaggggaccaaaaggatataagggggaagcagaaggagaagggaggctggatgagtgatagcagcacacaagcctgagtgtcgcatggttcccgtattgtgtcagttttgtccatggagaacagacatttagaattaagaatgtatccaagacagacaatagggataggaagcagaattagaggagttcgagaccagcctgggcaaggaaagcttttgatcatgatgcagacccaacacctatgaaagggaagcgggaggcagcaggtttgggcagggagagcctcagataatgatgcagacctgaagtcttggccacttgatgggggagctccctagcaaagcccacccattagaggggtctcaggttgggcagaaaggacagtccctagtctttctgtgggtcagtcattggccagaggctactttggaagaacgtgccttcagctcagaagctaacacaagtcttgggatcctcgtggtgccaacagctggaagctgtcagccctctgcagtccttgcagatgaatggcaagttcggttttttttgttctgttttgttttttgagacaaggtctgactgtcacctggggtggagtgcagtgctgtgatcatggctcactgcagccttgaccttccaagctcaggcaatccttccacttcagccacccaagtagctaggacaacaggcccggctgtttcgtttttgttttgtttttttttgtagagatgggattttgtttttgtttttgtttttttttttgagatggaggcttgttctgccacccaggctagagtgcagtggtgtgatcttggctcactgcaacctctgcctcctgggttaaagcgatcctcccgagtagctgagactgcaggtgtgcaccactatgcccgcctaatttttgtatttttagtagaggtgggatttcaccatgttggccaggctggtcttgaactcctgacctcaagtgatctgcctgactcagcctcccacagtgctgggatcacaggtgtgagccaccatgcctggcgtagagatgggatcttgccatgttgcccaggctggtcccaaactcctgggctcaggtgatcctcttgcttcagcctcccaaagtgctgggattacaggtgtaagccactgtacctggttaagttctttcttgaaaaagggatcccagtggaacacctccatggttgactgccacaggacctcagttgcttggacagggagagtctctttaaagagtaaagaggtaaaatccccatctgagacccgctgtaggcgttgagattgcaccatcttttccagatggaagctcctcatcccctctggggtgtttctaaggcagaaggcagcttctcagctgctgctgcttttctagccctggaattggctgtggtggcagcaggattcctctgttgtggtatctgcagtcctccgagttgggacatcatgacttaacatggtattgcagaatggataagataaatagatccagtaaaagatatgaaaatttcatgtctgaaattttcagcctgggcagagaaagttggtgaccacatctcatgcttcctaaaaggtcctagttaacagtccttcagtttccaaccaggttgtcatcacctcattgtcagggctgctgggcatggttgtgcaatttgtgtactgttcaaaggcatctgcttagagagttgagtgggcctggcagggttgtagcaacccagaggaaggggtgccgttttgcaattttgcctttttatattcacacaaaggtgcccaaagtgttaaagaagtcttagaaagtgagtttagaaggttttccctagtcccagtaccagcttattatttgttttaaatttgcatgtatgaaattaaaaagttaatgcaaattacatgaaataaaagctgctcaggtgcactctgtattagttatagttaatgctaactgtggttacagataaattccaaaatagccacttaagacagttaaagttgattgctgcctcatgtcgcatctggtgtgagttgggggccatcagcaggtggttgttagagactcaggctggtggatgctcctcttcagcatatggctcccaaattgccctgaatctgccagcagtcgggagaggagaaggcgtgtggaggaccctgcccgaggttttaggggccaggcctagaagtggtgcacattatttctacttatgttccactggccagactcagtcacagagacccactgacatgccaggggactgcatcaagcagagagcatgcatattggtaaacattagtgtctctttgtagacatgatgaccattctcaaccacatttgcatcagtattttattacaaaaattttaatcagaaaaattaagacttacatagtaaacacccatgtaccaaccacctagattctaaattaatattttgctgtatttgctttatttgtacatctctatattcattcctctacccacccattagtctgtcttattttttgatgcatttcaatgaaatggtagttacctctacaattctacatgatatactatacccttattgtttcttgatttgttagttttcaagcctctctactactaacctgcactatgaaagttgaggaattaagcacattttccctgctatatattctcctcactccccgtttctgcaagtcatacttaaattttccaaatccattgttagtataaaaatgctagtggtagaatacaagtagtggtatacagaagtttactgtaaaagtccttccactttgctatatgaaaatttcattttgagaccagcctggccaacatggtgaaaccccgtctctactaaaaatacaaaaattagtcgagtgcggtggtgggcacctgtaatccgagctacttgggaggctgaggcaggagaatcgcttgagcccgggaggcggaggttgcagtgagctgagatcgcgctactgcattccaacctgggtgacagagtaagagtgtctcaaaaaagaaaaaactttaaaattctaaggtaatctattgttttccacttctatttcttgactcaccagctttaaatagtgtcctaggcttcgtcacaggtaaatgaggatgtagtgcccctaaatgtcttctgccttattctcaagagtccccctcctgcacttattcccagtctgcctctggacctttcacatggctagaacattttcattctgttccataattagtattagtaagtcttctgtgcatcatttataggttaattctaaaaatggaaggcctatcagcatttaaaatatcaggatctcatgtattatttaatggagaaccaggtagtatgtttagatttatagagaagacagtggcatcttacattgcataacgcgtgatctgtgaagacaggaggaaggagtaaggagaatggaaaggagttggtatgaatatgctctttacttttaaaattaatatgcttttatcctgttactcagtttctgtcttttgcagactgtaagagggaatttcttttttcttaaaaacaagaagctagtctgccttttcatactcagttctgtcacttctttttttctttcttttttttttttttgagacagagtctcattctgttgcctaggctggagtgcagtggagtgatctcagctccctgcaacttctgcctcccaggttcaagagattctcctgcctcagcctcttgagtacctgggactacaggtgcgtgccaccatgcctggctaatttttgtatttttagtagagacggggtttcgccatgttggccaggctggtctccaattcctgacctcaggtgatccgcccacctgggcctcccaaattgctgggattacaggcatgagccaccgtgccctgctctcatttctgtcacttctgccctcagacttcgggcaaataattttttatttttttatatatatattttttagacagagtctcgctctgtcgtccaggctggagtgcagtggcacgatctcgcctcactgcaagctccacctcccgggttcacgccattctcctgcctcagcctcccaagtagctgggactacaggcacctgccactgcgcccggctaattttttctattttttagtagacacagggtttcaccgcgttagccaggctggtctccatctcctgacattgtgatccgcccaccttggacccccaaagtgctgggattacagacgtgagccaccgcgcccggcccaggcaaataatttttcctcgagcttcaaattctttatctaggaaagggaagagtaatataacctacattgtaggattgttgtggtgattcataggttaaaacatatgaaggcttaaaatagacacacatagaaagcacctgataagttttagctgttaattcttcttaaccctccaacataatactttggtttggactggttgctttctagtcccatctcattctcaggttagttcattatttcttggatcctttttctcttttttggattctctttgcttttgtaaaagtgaagatgtggctgggtgcagtggctcacgcctgtaatcgcagcactttgggaggccaaggtgggcggatcacccgaagttgggagttcgagaccagcctgaccaacatggagaagccttgtctctactgaaaaatacaaaattagccaggcatggtggcacatgcctgtaatcccagctacttgggaggctgaggcaggagagtcccttgaacctgggaggcggaggttgcggtgagccaagattgcaccattgcactccagcttgggcaacaagagcaaaactccatctcaaaaacaaaaaacaaagtgaagatgcatacatcaaatatcaatggtaatacatagtaaaaaatctaagaaggtcaaatatatgttactgtaataaatgtcagtgggttaagctccccattaaagagcttcccctaattaagacagaaaatcaaatatatatactgcagaaaagcttgtttatacgttactttgatttttaaaattaagtcatttaaagttgtggataataaaaaagtagctcttgaaattttcaagttcaacgtcttgttattccatatgttctatttacaaatgcagtaaaatttaataagcactctttaagagcatctggttaaattgagttctgtttacaaactttgctaataaaattaacattttaatttgtgtttattaatttagtatatttaggttcttgttaaagtctgacaaaaaaatccagtttttaaagtcttataaatttaataattattctaataaacttagtgattcttaagtcctcttatatattccaaaacatttatattctctctctctcttttttttttttttgagacagtttctgtctctgtcacacaggctggagtgcagtggcagggtcagagcttactgcagccttgacctcctgggtgcaggcggtcctctcactgcagcctcccgagtagctacgactacaggagcatgtcaccacccctggctaatttttgtgttttttatagagacggggtcttgctatattgccctggctggtcttgaactcctgggctcaagctatcctcccaccttggcctcccaaagtgctgagattttataggtgtgagccacagtgcccagcctgtattctctctttatatgtgtgtatatgtagatgcaagctttccaatttaaaattacaaattaattactcagttacatattttgaattggaatcgcaaggttgaccctgtaactctttaatagatccaattctcataaacattaaaagtataattctataatgcagatatttcttaatatggaattctattactacttgtctgattcttttgattatttccccacttgttctaaatctttctaggattaaaagatgtttacataagtgttttattccaaataatattgggatttcttcccatgtaatttttttttttttttttttaaagagacaaagtcttgctctgttggccaggctggagtgcagtggtgcgatgctggcccactgcagccttgaccttcctctctgccccagcctcctgaagtagctgggactacaggcagtgccaccatgcccagctaattaaaaaaaattttttttttggtgcagacggggtctcactgtgttgcccaggctagtctccagctcctggcctcaagcggtcctctcacctaagcctcccaaagtgttgacatttgccaccatgcctggccccatataatttttggggttgtcttctcagtttgctgaggttttttttaataaacagagatctctgacagggacaaggttgggattcttaccctacccagacttcagatatcagcttgagcaacttttgctttggttggaacatattctttaacatatttggtttgagcatattcagggatattctgtgcttgttagttttctcaaccttcatctgaggataatgttttgcccttaccctttatatactttgcccgggtatagaattcttgttcaccacctttgtaatctttctgtagcatggacttcaaaacttgaagaaagaggtgtcataatactcatgtgccttagattcaaattacatttaatttgtgtagcttctaatagcctgagacccccattcgaacggccatatcacctgattagagtttacacttctttagcacttaaaatatataaatattttcccatttaactccaaagaactttgacttgatagaatactgcctggtttttttatactttctgtctcttaaagcagtatcttttttaaaaaaattaattttattttaagttaaatttattttaaaaagttaaatttattttaaggatacacgtgcatgacatgcaggtttgttacataagtaaacgtgtgccatggtggtttgctgcacagatcaacccgtcacctaggtattaaagccccacgtgcattagctgtttatcctgatgctgtccctcctactacccccgccctgacaggccccagtgtgtgttgttccccccaccccctgtgccgtttccatgtgttctcattgttaagcttccatttataagcaagaacatgcagtgtttggttttctgttcctgtgttagtttgctgaggataatggcttccagctccatccgtgtccctgcagagggcatgatcttgttcctttttatggctgcattctgttccatggtgtatatgtaccacattttctttatccactctgtcattgatggacatttggattgattccatgtctttgctattgtgaaaaatgctgcagtgaacatacaggtacatgtatctttataacagaatgatttatattcctttgggtatatattcagtaatggaattgctgagtcaaatggcatttctggttctaggtctttgaggaatcgctgcactgtcttccacaatggttgaactaatttgcattcccaccaacagtgtatttctccacagcctcaccagcgtctgttgtttcttgactttttgataatcgtcattctgactggcatgagatggtatgtcattgtggttttgatgtgcatttttctaataatcagtgatgttgaactatttttcatacgtttgttggctgcataaatattttctttagaaaagtacctgttgatgtcctttgcccactttttaatgggttttttttttcttgtaaatttgtttaagttccttgtagattctggatattagacttttgtcagatggatagcttgcaaaaatgttctcccattctgtaggtagcagtatccttcttgacagttaaaacaaaatgtgatttaattgtggatatctttcttggctttgtctatcttacaagataattctactgaaacaatagtatcagttaaaaacacaatacaccacagagtgtcttaaatgagataggaccttttatattgataaaagtacaattcaagaataaaaagtagcagttacaaagtccactcactaaatagcaaaacactggaaataactaaagcaaaacctatttgaaacacatggaaaaactcacaagtaaagtgggagaatttaactgtcttacacaaaccattttttcaaaattatcatggaatggttaatatattgatctattctaaggccaggaagaaaacgtcattactgttgttcaagggaaattttactggtcactctgtgatcgtaatgcaataaaactgtaaataatgaaagttgacattttaaaaacttattctatttggaaattttgagtcaaataggaattgaaaactacaattatagatcatttagaaaaataattatgaaatactaataaagttacaaataataagcaaatttattcctctgaaaacttttattatcaaaaaataaagaatgaaaattaagttctacacaaaggacattcaaaagaaaagaaacaacaaaagaaatctgggataaccggagggagtttttaaaaacggcagacattaatgaagtaagttacgactgtgtctgtttcactcttctctttcctcagtacctagcccagccttgtccctgtcagagatctctgtttattaaaaaaacctcagcaaactgagaagacaaccccaaaaattatatgggaccaggcatggtggcaaatgtcaacactttgggaggctgaggtgagaggaccgcttgaggccaggagttggagactagcctgggcaacacagtgagacaccatctgtacaaaaaaaaatttttttaattagctgggcatggtggcactgcttgtagtcccagctactcaggaggctggggcagaaaaagcctaagagtatgttctttgttaaacaaatgaagtaaagttttagttagactcatcaagaaataggataacacaaataccccaaattagctatatatatgtaatgtgtatatatatattatattatatataatttatattatatatagtgtatgtaatatgttagctacatatatgtgtttatatatatactatatatataatgtatataatcaggaatgttggatattttttaaaaactagaataaaaaatagaaaatcttgatgaaattaggaaaacaaaattaccaaaatcaattcataaagaaatgaaacacttggacagaaaaatattcttggaagatgtcacaaagtgacttaagaaaatagctcccagctgggcgcagtggctcacggcctgtaatcctagcactttgggaggccgagatgggcggatcaccaaagtcaggagttcgagaccagcctgaccatcatggagaaaccctatctctactaaaaacacaaaattagacgggcatagtggtgcatgcctgtaatcccaattactcgggaggctgaggcaggagaatcacttgaacccaggaggtggaggttgcagtgagctgagattgtgccattgcactccagcctgggcaacttgagtgaaactacgtctcaaaaacaaaaagaaaatacctcctcaaataatcctgaatccagatggtgttataggtaaagtttttcatatatgagaaaaatgtaatttctgtgctatttaaagttatgtggtatgtttcccaaagatattggatattacatattacagaggatataataagatatgtacagatgattatttcttaatttaataattaacatatgctagaaaaactataacttgtacatttaatctatgtctgttgcttaggatcaggttaagtcaaagaagaaattagtcaatattaagtttatgcagaaaaatattaaacacataagacagctgaatgcaaatatagccaaaattatgaaggtgatattcaaataatagaaacttgaaaaatattccaaagtacagaaaagatggaaagcattccgatttgttttgataaaagtagtactaatactgttaatactgtttctgataccaaagcttttcaaagatggtatgaacaaagaaagccacagtatattcttactaatgtagatgctctccttaactgacatatcagccacatttaatccaaccatgcatttaaaaaaacattacaccattggctaaaaagtggcttattctaagaatgcaaaaatattattatataaatagaattggaaatatcagtacatttaaagataaaaattaacatcatactgtatgtcagtaatgcatttaataaaatttaacatctacctcataaacatttaattcctgttggaatagtctggatcttttctgaagataaataaaatgctctaaaagcagcacataccatgcttaacaggaaactaaaaacatccccataaaggtcagggacaaaacagtggtgcccatacaagactgtatgacactgttttcaaatatactagccaaaccagtaagattttaaaaaaatggttattaaaaaatgagaaaaaattagcattatttgtagatactagaattctcttgttagaataaccaaggagatcaactgaaaaagcatgagaacttatggcaatttagtaaggtaaccagcttggaaatgagtatataaattcagatatatatgtgtgtgcttgtatgcttgaatgattcagatatgtatgtgtatgcttatatgatgtagatgtatatgtaacagtagttttatgttagtaatcagaaacgatggtatattttattttatttttttgaggcagggtcttgctctgtcatccaggctggagtacagtggtgctatctgggctcactgcaacctgtgccttccaggcccaggcaatccttccacctcagcttcctgagtaactgggactacaggcatgcgctaccacacccagctaatttttgtattttttgtagagacggggtttcactatgttgcccaggctggtcttgaactcctgagctcaagtgagccacccacctcagcctctcaaagtactgagattataggcgtgagccactctggccacaatggtttgttaaaaggtttcattcacactatgaacaaaatgtataaaacctgaggaagaaataagaagtgtgcaaggcctctgtgggagctataaactatctactcaggggcatagatacaaactatctcctcagaggcactggtgttgatgtggtaggtgtcctccattaagtggaggaattatcattatatattatagttctgaaaatcagaaatagctgctgaattttccaaaatgccttttgggcattcacacagatctatttttctttttagatagaatgatttgatggatttaaatatcttcaccttacaataaactgtgtcaggtttttctaaatcttccttttggaatttttttttttttaacatgaaaggtgaattaacagcattaatttttcttggtcccttattgcgttatatataaaataagggtatgtgtgcatggttagttctaaagttcctgataattttaacattctgtgatcttatggttttagacattttttcccaagagacaggggcttgctctgttgttcaggctggtctcgaactcctggcctcaagggatcctcctgccctggcctcccaaaatgctggtgtaacaggcatgagccaccgctcatggccagacttttaaacatttctaactcagagaagtgtttggattttacctcttgaatgtgttgcgccaatttgctttaggtacgggatttctagtttgttgaattctattttacttacaaaaattttttatatggctccaatcagatcaaaccagcctatgtagtatcatagaagtaacattaaaatattgagaattttgaagggttccaggtatcctgaagactttaccgtcacaggacaaaaacacttatagggctgtccttccaccagacccagcctctgctgttccattgcccttgctgccctcctccgtccagtttgtccgctaccttcttgcttagccaggatgtgtgttgtttggcatctgccttcacatggacattgtgctgcagttggttgcttctccagctaagtaagaactgtctgaggatccatgtttatctttgccatctccatggtctccaacactctgcagagtccttagcaaaatgtatggttttaatgaattgatggcagctgtcccttgtatttccaggaaagttttgaattctcaggagaaagtaggtttgatatttcaaaacgaatgtggttggccaaatgttttatattgggattaaagaaattattttagtaccacaaacttccagaaagcttgtccataagagtttttcctcaccccacaccactacaaaagtgacccagaaatcctgagccagtggaactcccaggggggtgcaggtatcactgggaccttgcccaccctactgtctcctttcatccctgtcccagagacctaacatcaccatggtctcctttccctcagtctttcataagtatttgtaaatactcttttaccaatatcattctttctctgttatttttcctttttaactgttgctcttttacttcagaaaaatttttcttttttcttttatgctcccctcatttccaacttcctgttccaaattaagcctaattatggttgagtgttaagattacggtttatgataaacctagaaagataaagtaatacatttttatgtgaaactatatctagtaaagaactggtaccaaccacctccaaagcccttgaaaatcccctttgttttatctgccagagaattcatctctttctctaattggtcctgcttttctctctagcacaagcagccaaattttaaaaaaatcttggaaggttacattataagcagtctaaccttttgatctgtaagcagataaacagagtctattcatagtggtaaaaaactgttatgaaaattatctgtttatagttatattttggcctcttttgctctcccctcagtcgtatgttatagtatgctgaagatacatggaattaatatacttccaaactggaccaaaaatgtcatataacagcctgtatttgcaggttaacaaagtatgagtgagaggggtatgtggctctgagtgctttgtttgcctgtttgtatttgtgtttctgtgttcctcctgcacaacttccctgacagcctgtgctttatgctttcatagggattttgaatcataagggaaagaagaaagattgcaaatcaagagataccagtaatcagatcaatgatgaaattttagtgtaaactatacattaaaatgacttcttctgtaaattttggtatccagaaccttatgctaaccctttcagatagaaaacagggcttgaagtatcacaaacatgcctttttcatttactgtttttttcattacttaggttattcctatttttttttgagacagagtcttgcgttgtcacccaggctggagagcagtggtgcaatcatggctcactgcagcctcgacctcccaggctcaagtgatcctcctgcctcaacctctcgggtagctaggaccacagacgtgtgccacctcacttggctaatttttttaaatttttagtagaggtagggtcttgctgtattgctcaggctggtctcatccctattaatgtgaattctggtaccagctttgactctggagatgctctggggcttcttgatggctgtggtcagcccacaccatggtcatgtgcttgccagcattctggtcattcctctcttatctgctgcctctaatctgttcctgtgtgcctggagactggtagccaaacctgccagaactgtatacagaccagaagtgcttctcctagtagtatgcaggtgtggagtttagggcacagtcattttgagcttctctggagctctcttccttttcccgctgatgacattatctcaggtagctgagtggccatagaactgagtcttagataaagtgtcactgcacaagcatgtggtcaggtgctgttcccctgccctggcacctgtggaaggtgtgtgggcctcctttctgttgctttcttgtaccacaccacaccccttctggcctcagggctcctgcatgggcttctctgtgcctggatgctcctctctcagcgtgttacagctgatcctccatgggttgactgcaaggcccagtttgcacaggatacttccagttaacacctgattgtggatcagtttactcctgttatttttactctcaaaaagtgccccaatttggaagataaaatatactgtctcctacttaaccatttcaggtctcagtccagtgtcacctcttcaggtagacctttccctttctctctcagggggcaagtctcctggtttgctgtgactgcagaataaaccccagggcttggttgggctgagccagggtttgccagcagacaaattcaggcttctttctatgtgagggcccatggcaggccagcgtgggaggacgtgagatgggaggggcagccaggtgctgggagggttgggagagacatggggaggaagagtgaggactgaagccagggggaagaaacatggaagtgtgctgtaagctctgtgcccactagcccttgatgagttttaatctgctttacccctcaaggctgtaagagtcagatctgagtgttttgaaaatgagacggtgtgtgcgattaacttgaagagaactgatacaggagagatctttggtgaggcctgattataagtggatgacaagcttcatttttcctaggtgataggttggactgttagacaaaactttggattcagagaaaaggcactctaggtgcattttgcctcctttctttaccttgatggattttcatgttggtcaaatgaagacttgggctacatctatgaaatcccttccaatttttagaagtatataattctgttgtacgctctagtgagtccagactataaagcattttgaattttactatttcttttcccctaattgtgggccagaaaggaaaatttccaaataaggatgcacagtccactctgggaaacacagggaaacaataactagaatacaagtctagcctttgccctggcatgaaaagaatgcagactgttagctgacctaaaggtttctgttttatttcacgtttaggtgaaatggtcagctttgaccattactcccaaagaagtttctctccagactttaagatatttgtgcaacattaagatggttttattatctgtgagacagctgtggtcacttttatttatcaaagtgccatgtttattgtatatgtatcaggagcagtgctggaaagctaaatttagagaaataaacctgggctcacaaatgattatggtgacattcagtatacccccaatgacactatcactataacattgctaggtcgcctcccagcagtctagccatctcaaccataaaggaatggcgaagtaatgatggcaacttgccttattggagagtgtgtagactgccgttttaaactgtaattgtcaggattagacctcaaccgtggtgaaatgttgggcataaaggtacatgaacaaagctaagtgcaaagttgtgtgaatgctgattcagtctttgtgaaagtacagtccacaggacacaaattggcaaaattcatttgccttacagtgtttaaagttttttgaattataacattttgggcctgagttctccacttgctgcagtttctgccagcccctttgttctttacttggctcttgcaaacatttatttacctatttagctctatagacagttgaagtttttggtgttttttttttttgtttttgtggagacggagttttgcttttgttgcccatgctggagtgcagtggtgtgatctcggctcactgcaatctccacctcccaggttcaagcgatcctcctgctcaacctcccaagtagctgggattacaggcatgtgccaccacatttggctaatttggtatttttagtagagacagggtttcaccacgttggtcaggctggttttgaactcctgacctcaattgatccacctgcctcagcctccaaaagtgctgtttacatgcctaagccactacacctggctggcagttgaagttttgacccctgtttaaaaaaagaaaagactattataatactggaatttaaattacaataaaggtgatttttaaataaaataaattttaaaaattaaattgatatactgtaaatatgcagttaggagataattgatcttcctggttacttcccagggaagcaggactcaagacccagatttgtgtgcagagtttatgggggttgcttctgggaacagtaccaatgagggggtgagggaagccggttgggcagagggagaagctaagatggatgcagctgcgatagctgcctcttcagtcccaggggattgagctggaatgggccttcaccgtgtcccaaatggagaccaggtggtcacatcagtctctcccccccatcagtcttggaggggagtctgcagagaatctgtttctttgccttttccagcagtcttgcccttcatttcctttatacatctcaaacactcaccgagtattttcttctttcaaaagtttattctcggggaggtggctccctggctgaccacaggtcccgccggcattcagcctggctgactcaggaggtcagcgcctagacctgactcattttcttccgctccttgccgacctcaccagggcctgcttcctggcacctcatttgaccaagccctctgccttggtcaaaatgaccaaggcaaaattttggtcaaaattttttgaaatgttagtttcaaaaaaaatcttaacctcctctttgcctgtggtgggtgggcaggccaggtcaggctcaccctgcagtgtggagggtggggtcagaggcccctggacagcctggggccgcctctgtgctccgcagctcagttttggcgggagagccctggccagttgtcaagaaagtgcgcctctgtttctggggtaatgctgtgggcccaggaccttcagcctgcagcccccagaggggatgtagtcatgccaaagctcctgatgccatcatcatcacgttagaacccctcaccaccacctccactcataagtcatttgccctaagccagcacagcacttcgaattcaggcagttgatcatcatctaagcgtgaataccattttattaatttttgcctagaaattggcactccctttaaaatcttttaatgcttttgtttactgcaagttttcttccattactttttcttctgtgtgtgccctctcctggctctctggctttcctgttatacttgtattggatcttttcagtcctctatgtctcttaaatttttaaaacttctattcatttcagtattcttagtcggtcttctcattcattgattggattttctgtagtgttcagtattgctagtgatcattattttgcaagtgacagcaatcttttctgatgtgacattttcccttttaacaaagatgtttttctttaaacatcttactgaaaattggttgactttctgaaggactattactacactggccttgctgggtatgtgggtacccatgactgttctgctcctggagattaagtactgggacttctgtagctcaggtccctagggggcctgggcctctgccgggtgggacagtgggctggatgcacatgtagggtaggctttagtgcagcattcctagtctgtgaacttctcctgtgtcatgccaagggatttgaatccaggtgtgaattcaactactcataaaagagaaccatactgacctatggcacattgagtagagagtattttttaaatgaattaggcctgatttaaactatattcagcccccttggcttatgtaaatgcgcaaatttctgcagattctctgcatagaagtttttttcttcatgctttctggagcgaaaattcttatcctggcttcctttatttactagctgtaggatcgcaggctagtttcttgcttgcttgctacattcccctcctgtgtaaaatggggctgttagtatttccttagggagttctttgaacaaagcccagaagttaataagttctcaatgaatgttaataaatgttaaataaattatcagaaaatgttagtttcaaaaaatcttaaccccttctctttttcttttgtcttctccgcctcgttttcctacttttcagtcattttacttgagggtaggcaacatttcatttctcaccaaatgcagacaggtgcttctccctacttccgtgtccctctccttctcccactacccttcttgccttctctaaggtattatttatgtagtcagggagtgtattggttcctgttgctgctataacaaataactacaaatttagtggattcaaaaacaatgcagaattatttcctggcagttctagaggttagaagtctaaagtcaaggtactggcagggctgtgttccttctggaggcttcaggggaatatcagtttccttgccttcccagcttctagaggccacaagcattcctcagcttgtggccccttcttccctcttcagagtatattgcttcaacctcttgggctgtcatcacatctcctttttccgtccctgattgtcttgcatccctgttgtaaaaccctggtgattatattgagcccagcagagaattcaggataatctctttatctcaatatccttaagcacatctgcaaaatccctttgttgtgtgacatactcacaggttctagggattaggatgtggacatatttgggggattgttattcagtgtgctgcaggaaggtagatgtgtaaaccttttatcatagcatagtgcaggtgggacttgcacagcggtaccctgagccaaaggtgtggacctcagacaaggaagcagttatttctgaggacattgggaaaagtttgatagaagagagatgtttgagctgagtcctaaaggatgaagaggccagggaagtttggaaggcttttaggctgaggaaacaacacttgctaagaaatagacttgtaaaaaaaatccagcaattttgaggaatagtgaaatctttgatgttgctaagacacagggtatattgaggagagtggtaggcaaagaaaattgtaggttaaaactagaatgtgctgtgataatgagcttctaatgtatcctgtaaagagaggggagccagtggagttgttttggtggcttttcaattataaatttttgtctgattgtgtaagtagttttcttcttctagaaaatgaagaaaccaaataaatagatcaagaaaataaaatcattcaaagccctgctactcagagataatgactgttgacatttctgtgtagtgtcattattgagccatttgtgtgtctgtttacccagttgaaacctcactgtatattaaatttcatatcttgaattctttagttaacggcatatcaacatttcttcatgtaattaaatactctcaactatccttaacatctccataatatcctattgtatatattaccataatttatttaatccttcattgttagattcaatatttttgtattttattttatttattattattttttgagacagagtctttctctgtcgcccaggctggagtgcagtggcgcgatctcggctcactgcaacctccgccttctgggtttaagcaattcttctgcctcagcctcccgagtagctgggcccacaggcatgtgccaccacgcccggctaatttttgtatttttactagagacggggtttcaccatgttggccagaatggtcttgaactcctgacctcgtgatccgcctgcctcggcctcccaaagtgctgggattaacaggcatgagccacctcacccagccatattttattttatttatttatttttgaggcagggtctgtcttgccctgtcacccaggctggggtgcagtggtacgatcactgctcactgcagccttgacttctcaggctcaagcaatcctcccacctcagcctccctagtagctgggactgcaggcatgagccaccactcccgactcctctctattttaaataatactaacacatagatctgtgtttaagtttttgaatgtttcctcagggcaggagtgcttctcctctgtttattctcttgagacgtgagatcaggtagaaatgttcccgtgtctaggtggaggagaccccagtgtgccctttcatttactcctgggctctagagtggaaacttctgtgtttttctctgtgtgatgatttgtgtgggtgccaagggccaaacccacatttagcaaagaaatagtgtgatccacttaaaagggggtttaataacttgagatggagatatcaagctgaacattcacaacaagcataactaaatcagagaggcagaagaaagcattaaccagaaaaataagtactaacttttaaagagtgattactcctgatttaaaacttttactagatgaaatacaaagggtaacagactgtgttgagaactgaattaattttctggaaggagtgtcttgtaaaacaaagatattgtgaggtgaaaaatgtaagatgcttaagggatctatgtaggagacctaataattgaatgataggattcttagaaggggacaaagtaacagatggaaaatacatcgtattataaaagaagaaacccatctgagctgaataaaatgttagacttcagattgaaaggactcatggaattcttttttaaaagacaattgctggactgcagcaataaagatagaaatcctgtcaacttctaggcaggaagataggtctgttttgagggaaattgggatgccataggaattcttacccacttcacaaagaagctagaatagagtctgtatggattattgactctaaggaactaatataaatcttctgtattcagacatatcagcctgggtttttacttgcatgccacagaagctgattttggttggctaataaatttttaaagatgttgagttgctgtgaaattgttagaagggctagagagagatgtctgcaggcactgcagccagggacagcgcatcaaatcttacacagaattggcccaggccggatgctgctgctgtgttcctgggcgtagacagtgtagcttgcaccagatgctgcaggcactaaagtctacagtgagtgccttggccactgctttctgggatcttgatcttgctgcagctaccattcttgcagtgagcattttccatcatagtccttgctttgcagcattagttcctgaatcaaagtctgggacaggtgtaaataatggcagggtcaagggggcctcctagctgcaagggggcactgagaaggcaggcagctggcatttttagcttatttaatgggaggtagaccctacctttaactgagactaataaggtgggaaagtccccaggcttaggaaagaagggttcaaaagctaggtagtcagaaagaatgtcagagatcaagtactcttgcccagatataattcagcgaaccagggcaaaagaagaatatttttagccatgagggattcatccatctcatttgaacaaatattcagatgtccaattggatgctggtaattggctcagaatagaaatatgaagatagaagaaaatgaataatataagtaacagtagagagcagtgaatgttgcagcaggaaacattgcatacataaatggaagatattaacacggctgaagattcagaatgtaagtgtaaagtaagaattcttggaaggatcgtactgccttggaacatctaggaaatagcgtggaactaaaaattctagaccatctcagcaaaatcctgaactaggattgcaggcattcagatataaaattcctctaaaaatttcatctttgttggtgtgggactggggggcatggttatttagtttggatgaaggtttaattaagagtgttagaaatggcaggtaactactaaccaagtagtaaaacatagtattcccaaaataacagggatcaaggatgatagtgagcacagaggtaagcaggccaggaaggaataaagagaagtaatatcaaattagcaaaagcgaggagaggaaaaagatgaaatgagttaacaaatagtaaacaaaatcaagtggaaacagtaaagccaaatgagcagccccacagtaaatactcatcagctaaactcacctattaaaaaacaaaggtccagaatattagtgtcagagcaagatgcaagaacaaaagcattgaacaggactaagaggtactatatattggtagaaaccaaaaatataaagtataactgcctttaagcagcaaaatgcatagaacaaacaccaggaacaaaagaatttggtaagaaacatattctactaagagatgctaattatgtgtcttttctaatttgacgggtcagctaagctaaattgccaacttggatgctcacaggggccggtgggtggcatgaatatgtgaattatatggtgagagaccagggatggtgggaattgcacagcgaactggataatgcatgtcttgcctaaaggcattgaaattcatacattttaaagcactttgccagccaaacaaaatatatttgtagcttgcttgcagcctgccagttttcaacctttgaaacaaaaaagcaaaagtatagaggttagaaacaacatatgcaacaaatgtattgcatatgttgcaaacatatttattgcgaaaatgtacagggaatgtacattttcccctaggtctagggagtatttacagaagttgatcatgtcatttatcacagaaaacaaaaagtgaaatatgaaaattttgatttttgtatgcaataacctgtcctgtcagtccagtgaaattagtggtaaaaaaaaagagatgattataacaacaacaacaaaaactaccttggagttaagagccactgttgtaaaataatctctgcaccaaaagaaaatctagacaaattataaatcatctagaaataaaagaaatagaagccttttgatatcaaaatttgtagaatagaactgaatctatagtcaggaaaaagtataatcttagatgcttttattagtataagaaaagaaagactgaaaatataagagcgaaatattcaacttatgaaactagaaaaaagtacaaaataaagagaaaggtaaaagctgaaatgaatgaaatagaaaataaaatggtagagaagataaataagaacaacactagttctttgaaaaggcaaataatggaaattattcttgattaaaggaaaaaggaaaaagtattagcaaagaagaatccattgttataggtatggaataaatgaaaaattaaatctgcagcaatatttgtgaaactctggaggaagtgggcaatttcccctcaaaatataaattcacaaattgttttctagaaaaaatataaaacctgaagtattattgctagtatttaacattgttttggtattgatgcaataaggcaaaaacattttttgttttaaatactgaaaaagaggaaaataaacttgacctaagaataagagaatttgtgattatatataagataaatataaaaacaaaataccttttttctatgccatcaataactggttagcattggaacgtgaaaaaaaaattcaattcacaaataccataaaatatctaggagtaatttaaactagaaaattataggacataaagtgaataaatattaaatcttactgtggttcataaaacaagacctgagataatggagaaactgcagtatgttccagggtgggtagatataatgttataaaattgtccttcccaagtagcctgcttaagagactaattctccccagaatttttcattaggaaaaaaggaagctccttacatttaagtcttagaaagtgtctttttaaacttggcatgttcttaataactttatttttgaataacgaagtaatacttcagacaaacctcaattttttctttttctttctttttcttttttttttggagacagggcctcactccactttcccaggctggagtgcagtggcatgaacttggttcactggagcctcatcctccagggcccaggtgattctctcacctcagcctcccaagtagctagaactacagttgcacaccaccatgtcccgctaaactttttgtatttttagtagagacaaggttttgccgtgttgctcaggctagcagcaaactcttggactcaagtaatccgccttcattggcctcccaaagtgctaggattacaggcatgacccaccacgcccaacctcttcaatttattttaaattgagttttatagaggccaccggacagaatcggtttaaaaaaagatagacaattttgttttatttagtacttattccattgggtatgatctcatagttacaagtattgttgaattgaggctttgaaagactatataacaatgcaataattggttaggttgtagagatcacaaatgtatacctacaggaagaatgtttttaaaaaaactgacctaatgtcatataagtacgtatttgtgacttagtataacattttcaatgacagcgtaatactatcattggattcagaaagtactgagtctcaagtagcttagaggatagaggaaaggggtgaagaaagagagaaccaaggtgatgcatgatacctgcactgcctgttaaagagagcttccagaaaatgcttcatccgcttggccagaacctagccatctggccacacccagctgcaaaagacgttggaagtgttctggaaccaccaagtgcccaacaaaaagttgagttaatgaggaagaaaagagaacaaataatggggtacaactagcctctacttggacataggtagtactctgggggaaaacattataaaatatgctgaaatattagtacgcttgtaaacaaataaaagtaaatgccaaaagaggtggcggtagaggtcagtaggtatagggtgatgagcaatcaagtggcaaaaaagaaaaacaaaggtgttcaacatcagtagtaatcagagaaatgcacatcaaaagaaatcacttttcgaccttcaaaaataataacttccagtggtggtaagtgtacagagaaacaattactcctatatgtctacccctgtggtgtgtgaatgattgcaatcttttttataaagcaatccggcaataattttgagattgaaaatatgtttctcttgaggaatccaggaattctgtcttgtagacataaaagcacaagtacatacttaacgttgcaaatgtaggaaaagtttgctaattgcagtactttttttgttctggcccgaatctaggaatactgaatgtccctcagtaggaattggttaaataaattatagtacagtcatcctcagtatccttgggagattcattccagaatctcctatggatactaacatccacagataactcaagtccctgatataaaatgctataaaatggcatagtatttgcatttaaactacgcacattctcccatatagtttaaatgatgtccagattacttatactacctaatacaatgtaaatgccgtgtcatttgttgttatactgtattgtttagggaataatgacaagaaaaacatgtctatatacattcagatgtacccatccctttttcccccaaatatgttctatctgtggttggtagaattctgggtggggaacccagaaatatggaaggccgactatatcattcttatgaaattttattaaataagaatgatgtcaaccgggcgtggtggctcacgcttataatcctagtactttgggaggccgaggcaggcggattgtctgagctcaggagttcgagaccagcctgggcaacacggcaaaaccccatctctacttaaaaaaaaaaaaagacaaaaaattagccaggtgtggtggcacgtgcctatcgtcccagctactcgggaggctgaggcatgagaatcgcttgaacccgggaaatggaggttgcagtgagctgagattgtgccactgcactccggcctgggtgacagagcaagactcctgtctcaaaaaaaaaaaaaaaaaaaaaagatgtagaggtaagaaatattattaaaaaggacaagtgagagctatttcctgaagctatgaccaggatgtattatcaggtgacaaatataactcacaagagagtgtttacacctttatgtcatagtgcctatgctgtgatcccaaacgaaaggctaagcatgtttgtgtcaacacagagagaatgtattcttggaagaatacattctttccaggctgttcataatgattatcccaggcaagtaggggattttgattattttgctcttagaaacagcatgtattgtttttatatgtgagggcttaggggagtttagtgattaaaagtatgaactttggagcccgcatttcctgagtttgaattccagctgaagctgtgtgatcttgggcaagttatctctactgtgcctcagtttcctccttggtaaaatatttgtagaaacaggacctactgtatatagtttcaaacaagtcagtatatgtaaagtatttggtaccgtagaagttctacatgagagttctatataagagagggccggctttattatttttaaacattttaagtattattattaaagtaagtcaagggtagaggaaaggtcattgtattctttccgtggtaaagtgctgaacatattttcatcagtcctagagcttgattttgaagaacatggtgatgcagcaaaatatttcttaattatgcctttgcctcgttttcagtggagtgaagaaacaggatcagctggcctgagaaagtgcgaagcacagagttttgtatttaacagcgagtgggctttatagctgtcttcactgtgtttttggaattggctgattgtccacagaattcacactggttcgatgtctaaacacttcagtgatgcaaaaatcagtttgggaaatagagacacttgaatgaatgggttttgagataaaaatctgtcttgtcatcctcctgaggtggagcagattgcattttccagctgaggctgtgactctcccttgtcccacatgccctcctacagtgtgactctgccacttcctctgttaagggatctacttcttgaatttgggcagccctagaaccgcttcagctggtagaagagggtggaagtgctcctctgactgctgaggctaaattataaaaggctgtgcaggcccctcttgtttgcgggggcacttgtgcttggagccgtgagccgttctgtaataagtccaaccactgtgaggctaccatgctggggagactaccacatggtgctccagcccacagtccgtggagctgtcatctcagccagggtttcggatggcaggagccacctcctagtgtctatgtaagaatggcctagccaagctcttcccaaattcctgaccggcaaaatgatcagaaaataaaacggttgtgttaagtgatgaggttatggggaaatttgctctgaaacagtggtggcaggaatgtaagggttagtaaacagcagcgactctgtgatgaaggaattcattcattcatgttggaaagacctttgcagagccaacctccactactccttgcacccagattgatggtcccatgaaccagaagcatttgtctagtgataatcacaggagtcttcaagtgtggtgtcctgttttgtatttttatttatttattttttttgaggcagagtctctctgtgttgcccaggctggagtgcaatggcacgatcttggctcactgcaacctctgcctcccaggttcaagctattcttctgcctcagcctcctgagtagctaggactacaggcgtgtgccaccacacccagctaattttggtatttttagtagaggcggggtttcaccatgttggtcaggctggtctcgaactcctgacctcaggtgatccaccctcctcggcctcccaaagtgctgggattgcaggcatgagccactgcacccagcttgtgttttgtattttttatttcacgttgcattttaactacagacacatcttggtgatgttgtgaattcagtttcagaccaccacaataaaatgaattacatgaggtttttggtttcctggtgcatacaaaaattatgtttacactatattgtagtctgttaagtgtgcaatagcattacatcttaaaaaaagcaatgtacatgccttaatttaaaaaatattgctaaaaaatgctaacgaagtaagcccattctgttggagaaatgacactgatagacttgctcgatgcagggttgccacaagccttcaatttgtaagaaatgtattatctgcaaagcacaaaaaagcaaagctcaataaagcaagtgcttgtattgtgtctcatgtatactaaaagtatgccaaatggtttacgtgatttttgtatgtatgtatctgcttatgagacagggtctcactcccatcgctcaggctgaagtgcagtggtacaatcacagcttactgcagccttgacttcccaggctcaggtgatcctcccacctcagcctctcctgagtagctagagctgcaggcagacaccaccacacctgggttttttttgtattttcagtagagatgggtgtctcactatgttgcccaggctggtttcaaactcctgggctcaagcagtgctcctgccttggcttcccaaagtgctgggattatagatcataggtgtgagccactgagcctggccaatttttgtttttaattgttgcctgatgtcccctgctgggtcctgaagtcttttgggttggtttgttttcaactggcacactacaccagttctatgtgctgtattaattatacaggtttgagtatcccttatctgaaatgcttgggaccagatgtgttttgaactttggattttttttttgtattttggaatacttgcattatacttagcaattgagcatccctaatctggaaatctgaaatactccaatgagtgtttccttttatggtcatgtcagcactcagaatgtttagggttttgtatttttttctgaattagggatgctcaacccgtaccagtatactacaccagggaactgactcggcattggtcagaccacattttgaacactttttggttgacttcccagcatttaaccccgtcttctcccaggaattctctttagctaattcccactttaaagtgagtcagcatatcaccctggtctcagtgagtcaaggatggcagagactcaatcagaatgagtgttgagtagatgttttttggggtgcctgggagagagtccccgctctttgctggatttgatggtgtgcagatgtgagccctggagctgccagtaccatcacatagccatgagggcaggcagcttattgatgaaggtgacctgtggaggaagggaggagcagaagatggagagaaattgaccctgagagaacatctttcagttgagccagacctgaagttggacttgatcctagactttcagttatgggagtcaaaacctctttttattgttgtaagcttgagttgggttttctcttgcaaccaagagatttttaactcacagaaacccacatctgcagtgtttctgagattctgggtaatatttcagagggaccttggtaaatcagaagctctctaggcagtttatccaatgaatggaccccgggacctatgaggcctggtgggaagaattaggaatgttttgagtgaagatttagaagaccaatggggaaacaaagctgcctgcagacattcagatgtcacgtggaagaggcaataaatttgttctttgtggttccagagtgtttcagaactggaatcggtgtgtgccatgttaatgaagatatagaattcagcctcatataaggaaggattgtccaactatttgagctgctcaacagtggaaggggctgtctagtggtgggtttccttttactgaaaatattcaatggtaactggaacatgagactttagtagatggcaacagaagttggatgctattgatgccactttgaatgaaaaattaggttatatgatttctgtttcttccagttctgaaataacgtgattttgtatttccttaggtatcaaaagacatccttttttttttttctttttttgggacagagtctcactttgtcacccaggctggagtgcagtggtgtgatctcggctcactgcagcctctgcctcctggattcaagtgattctcctgtctaagcctccggagtggctgggatacaggtgcgcaccaccacgcctggctaatttttgtatttttagtagagacggggtttcaccatgttggctaggctgatctcgaattcctgacctcaggtgatattcctgacctcaggtgatctgcctgccttggcctcccaaagtgctgagattacaggcgtgagccaccgtgcccggcttgtattagaagatatacttatgatgtgaccgttgggcaaattatgaagtctctcagactttgtttctttatctgtaaaataacaataataatacttttatgaactgagttttgtgtgcctcaagttaatgtatgtgaaagtgcttacaaaaccaaagtgctacacaaaggtaaagtgctgttatccttcctacatagtaaactccgattcaaaggatacggacgattccttaaatttctttgtgtgttttgacccatgggtgctttgaaaaaacaactcccacccccaaagtgatattaatagaaataaacaggattttgcgtgcccagtccatctaattatctaatttctccagttacaaattcaggtgaatttattatgttttcctggtagaacttggaagtttctcagtgatctctgtgaggtataactgaggtacacctgagccataactgtaggaagtcagggcctgattatgatctagactagactaggtggttctcacttgcatcgagcctccgtaacctggaggttagcttttcccatctgtcctgaaagtaaggctgcacgtgaatatggcagatcttttagttcactaaagcctgcaccctcagctcctccttattctcagtgtttggtgcctggagactgtgggctttattttcccacagtgctgctgggagatttctgttcagaggtgccaagctctctagttaggcaatgaggatttcatttggcctacacaatgggcaaggaagctaaggcgcagtatgcagagagaattctgggacgaagcgctcctccagccacttcagtttcaatggaaatttgatgtccctgcctgctttgcacttttcaaatggcctgtcaggagttgccctcccagagctgcttggcattctggcttctcctggagatgactaatggcagctggttgtgtgggccgcctgctagaagctagtcagaccataccattatctctcctcagaaacactgaggctttgtctgctgccctatctcccctgcatcctgacacagagcggtcactgtgtcctctccaggcctgagccccttcttagtgttagggggcttttgttcagaagctttattgtccccctctttctggagtgctgttcatagtggccgtggtacagcatgagtatttgggaaacaggaggagtagatttacaagcattttgaattctaatccaatttgctgagcaagtggagtgtgaggaaaattaattttgcattcttcccaaaaaaagtaaaatggagatgagatagaaaatgtttatccctttacaaaaatcatctttacacattgacactgctgtttgcttttaacaaaggaagtaaaatgggtgagtaatttggttcatttgcatgagtgtaggactcttttgtgtttttttccctccatttgatttgcaaagacaatttctattgacttttagtacaagttaggtatgaatctctagaaagcacaccactgagacgacccaaaagacagtccagctgtggaaaaaactacttttctgtcatagtcaaggtggggccccaagatttgataacagacttagttccttatggctgtgcatctgcttgctgaattgcctcaaacttctgttatctcatttgttctaagtccaaaggatcagtgctgcctataaagctgacggattgctaattgcctgtttccacactgtactcataaacattcatatttctttttcctaattttcattatcaaagtagtatatacaggggttaaaataatgaaccaggacaaggagcttattatgaaaagcaagactgctgctgccctgctgccctaccccttcccatttcttgtccctcttctcaaaggtaaacactttattatgcttttactgccttctaaaaaaataaacactcttttttaaagagcagttttaggcacagcaaaattgagtgaaaagtacaagttttcctatagtgtactcctgttcccaaacacactcagcctcctcattatcaacatcttccaatcagtgaacccacaccgatgtaacattgctcagagtccgtggtttacattgaggttcactcttggcattgtgcattctgtaggtttggataaatgtataatgccatgtatccaagttttttgtagagacagggccttgctgtcttgcccaggctggtctggaactcctggcctcaagcaattctcccaccttgcctccctcccttgggggtgggggatgaatgggcaggcacagtagctcacctgtgcctggctctacttattcattcctccctccccccaacccctggcaaccattgatctttttgctttagcaagcaaaaggaccatagttttacaaaactacggtctctgtagttttgtcttttgcagaatgtcatagttggaatcatactgtgtgtagctttttcagactgcttctttaacttagtaaatgcttcagttaaggttcctccatgtcttttcatggcttaatagttatttcattttaaggggtggatgatactaatagtccattatctgggtgtaccacagttggttgcttccaagttttggcagttatgagtaaagctgctgtaaagatccatgtgcaggtttttgtgtggacatatgtttttgactcatttggctaaataccaaggagtgctattgctggatcatagagaacaagtatgtttacttttctaggaaaccaccaaactgtcttccaacgtggctgaattattttgcgttcctaccagcaatgagtcccggttgctccacatcctcaccagtatttggtgttcttattgttttggattgtagccattctaatagttgtgtagtgatatctcacttttgtgttaatttgaaattgcctacggatgtatgatgtggagcagctttttttttttttttttttaattatactttaagttctggggtacatgtgcagaatgtgcaggtttgttacataggtatgcacataccatgatggtttgttgcacccatcatcaacctgtcatctacattaggtatttctcctaatgctatcccttccctagcccccccacccactgacaagccctggtgtgtgatgttcccctccctgtgtccatgtgttctcattgttcagctcctacttatgagaaagaacatgcgatgtttggttttctgtatataccccttaatgggattgctgggtcaaatggtatttctagttctagatccatgaggaattgccacactgtctgatgtagagcagcttttcatagctcattttccatctgtatttcttcttcggtgagttgtctattcaggtgtttttccatttttagtcaggtgtttcgttttccatttttttctttattgagacagtgtctcactctgttgtgcaggctggagtgcagtggtgcaattatgacttactgcagccttcacctcctgggctcaagtgatccttcttcttcagtctcctgagtagctgggactacaagtgtaagccaccatgcccagctaatttttgatttttttgatgagacgagtctcactatgcagggagaccccttgagacaggggtctcaaggctgcccagactggtcttgaacccctggacacaggtgatcctcccgccctggcctcccaaagtgtgctgtgctgggattacaggtgtgagccattacaccgagccctcattatcttactgttgagttttgagcattctttgtatattttggataacagtcctttatcggatatgtcttttgcacatattttctcccagcctgtggcttgtgttctcattcttttgatgttgctatttttttccccaattttgttgattcctcttatgatagatgaggatttaacacatggccctgcaaccctctcctagtgtcataatatcactgtttttagtttctttcttggttattgcttttagtaatgtatttcatctttatttcttgtcttgtcaactgtatatagtatctttgacaccctgtttgtaaggtgagggtggatattattgctgccatcctttttgcccactctctctgctttctcttctacctcccagtttctttcatctgtactttacctttttcactagcaaggatgacagtattcatatgttctagaaaatagtcttgcatgttctgtgtgtagtatggatattattgtgactacatatatattgtgccctgcagagtgaagttatgtgctgtgattttgttatctgtcttatacagcttatttttatgaagtttcttgttttgtgactatttttgttacaggaaagggggcccgatccagaccttaagagaggattcttggatctcgcacaagaatgaattcagggcaagtccacagtgcaaagtgaaagcaagtttagtaagaaagtaaaggaataaaagaatggctactccatagagcagccctgagggctgctggttgcccatttttatggttattttttaatgatatgctaaacaaggggtggattattcatgcctcccctttttagaccatatagggtaatttcctgaagttgctatgacatttgtaaactgtcatggcgctggcaggagtgtagtagtgaggacgaccagaggtcactcttgtggccatcttggttttggtaggatttagccagcttctttactgcagcctgttatatcagcaaggtctttatgacctgtatcttgtgccaacctgttatctcatcctgtgacttagaatgccttaactgggaatacagcccagtaggtttcagcctcattttacccagctcctattcaagatggagttgttctggttcacatgcctctgacatttcccccctcccttttataagagaacgcttaatcctaagggttgcggagggatgaagattcatcttctataactccttcaggctgaatagaggtgatgatattcctgcctgactattagggtctcttacattcagagtagagaggagcagagtcagaaagcatcagtatggtaaggtccattcataactcttgagtttcgacagagggtggtatctggaagatgaataagagtttaagaaaacattcagtaagcttgtcctgtattcctacacaaaaagtataacagcaatatattccacaagagtaaagcaaaataagtaaagttattccaagtaaactaaattagaagactttccatgaactgggcaactgttggaattaagctgatatagggttgttagctgattgtaatgtgcccagaattagaatactaatccagatttttacattatccatccctcttgtttcttctgagcagcagtcagagatcactggtaggttcacaggaataagcaggtgtagactaaattgcagaaacaaactgaaaaacagatgagactagaatttaataacaggtgtaccatagttcttgaaacatatttctctctccagttttccatttttacgaaagacaaattatggtaagactgatttgttttattatacttggcctgataatttgtataaagtgcagcaagaataattatttttcacataggctttttaattgactttaatggaactctgttttgtaagggatctcagataagactttttaaaagctgagccccatcatgggtttgtaccctcaaatacctatgagttgggtaaattcctttctttttgaggtcccaggataacttggggctcttcgacctgtgagaaagtgacattctttacttaccccaagtcagaaaccttgaacagggactgttgtagacaaggtgtgaggccagttccacacaggcttttattggctctataaatcaagtttaattccttaaaggaaaacacaccattccagtcaaaaccttggtaacataaccaatttctccaattgtgttctgttagaaaagagaacgaatttttttttttttttttttttttgagacagagtcttgctctgtcaccaggctggagtgcagtgacatgatcttggctcactgcaacctctgcctcccaggttcaagcgattcccctgcctcagccccctgagtagctgggactacaggtggcgccaccacgcctagctacttttttgtattttagtagagatggggtttcaccatgttggctaggatggtctcgatctcctgaccacgagacccacccgcctcggcctcccaaagtgctgggattacaggtgtgagccaccatgcccagccaagaaaacagattcttattgcacctttgcaaataactattttgctgtaagttaagaatactcacaactagttgccaaattctggagaaatcaggtagagagaaacaaatatgctcagaattttgtgcataggagtatataaactgttaagagctataatataaatagctcaaaaggaaagtttccttgactctgaaaaacaaaggatcagtagtgttttatgcaaagtttgaaatattacttccgttttttattggttcagtgaatttaggtaactcctgttttgcttgatattcatgaacatttcatctctccatgagagtcctgaaagtttttcctctattctgttgttacgctctccaaagttacaagaaaacatgcattgaagaacacctgttagagttctataattgattataaaccaccttctaaaggagattaaaacaagacagtcatctctggatgataaaaagctttaggacagccactattaaagccacatttgataaggaaattttgttacttctgtgatacacagaattttacataacaattataattattaataacacactaaataatattagaattataggagtttcccataactttagaatataccaataacacatttatgtaaatatagtccaaagaaagcaaaacaccatttcacattcgattatgcttcctgtatgatttttatatcaaataagccaaatgtcactgttgtattagtgcattatagatataaaacccaatttttttttttttttgagacggagtcttgctctgtcacccagtctggagtgtagtgacgctatcttggctcactgcaacctctgcctcccgggttcaaacagttctcctgcctcaacatcctgagtagctgagactacaggcaccagccaccacacccggctaatttttagtatttttagtagagatagagttttgccaattcttaataaaaccttataaataaataaatctttccaatcttaatcagtttgaccataaggtaagattctcataaactttttataaccctttacaagtttttgttaaagagcaggtcataagcaggtttttgctctaagaaaccaattttaatttatagaaaagctgaataatacccctttaatttagccaatgtccacacactggctattttaatttgctctaagaaaccaattttaatttatagaaaaactgaataatacccctttaatttagccaatgtccacacacagaatctcttttacaattaattttttacaaaccttccacaactgttcaaacctttagctttattctaacttaaagcaattctttaaccctttaggcaaaaaacccatattcccatgccttcttataatcttttaccaaaaatatattctactttccttacacaccttacaggtaaaactatttcttcaatagtctcaattacatgttacaatgttaacttttagcaacttttatttttggtgaaaaccctggttagtaagcaattttaattgtgtattaggtgtggagcctagccttaggacacgccaggcagaagtgcagataagggctgactctccagcatagctagggggcatggctaactccacatgtccccaggccttaccttacttaagcaggcaagttatacagtaagagtcatagtggcattttatgacgcatttaggaggcctaacaacctttgaattgtgcaacatttcttgcataaattttctttcaaaaatcctttcacgacttacacagaccatctgagacattcttggactttctgacttgccctaaacatccctccttttaaacaaccattttattttaggagaagaatttaccataccaagatcttttcttatataaaatctttctttataatcatctttgtatagctagggggcatggccaattccacatgtccccaggccttatctagaatctaatggctttaaggcaggtaaattgaacaatttttaaaagttaaacagtttatgaccttaaagcatttaacaaacttaatatctgacctgcataatttagactgaatgtttttattttatcagtaatttttaaagctgtttgtatttcccgaagattactaagattacatgaactaaaaggcattacagtttttgttttgctttcaaaatatttgatttaagcacttatttttgtttcagccaattagacttcttttatataaacattacacataatatgtatatagctacccagaaagaagaatattactacagtagttgtaagatttttcatttgccagtttttaagtttcttaattggattactggctttaaggtggagccgttggaagaacagggccaggaaagggggtccctggtgcctcctgtttttcccaaggagttcaggctgttagagcttgaatatctgcttttaattaaactgattttaaccatagcactctttaacaaagtctttttagaattttttatgccaaacagccaatatttctggcttttgaactttacctaaggtaacctccaaggtgcttagagaaaggaaaatttaagacagtccatggaggagaagagaatagacaaggtcacacagatattaaaccagaaacgacttcctagggaaggaatcaaacccgaactgctactgtgaaagtgcaaaaccctggcttctgagctacagcacgggacagtctctgtttcctttcctagaaggaatttagagtagttaattttgagcttgcaaaggcttttaactaatatgatttttagatctaactatgacatgaaccctaaaattcctgttccctggaaggcagagaccaaaagtactgccacatggttacaaggtcaagctcccaaggacataaacaaggtggagacttcatccacttttttgtttgtttcagggatctgtagccaagtttgttactgaccagctagcttgctggcttatcttgaaaagtgggcctgcaggtattctaagcccgtgttttatcctaaagcaccccttgacacggaaaaagaaattcatagcacaaaatacaccagcttaagactagccttagaatttttttttgcattaatcaaaacattacagaggagataaatactgatttttccccccattcattcaactgtttgcatagagagtgagaagctagaaatctgactggcaagaaattcttaccctttggccagcatgccaggcttctgggttccctttccctgagtggcactagtgatctggcttgcagcaccattgccctgggggccaagcctcatcataaaggaaaattacttttttttgttctggccagagcaaaatacatgtgataagacatagacattagccactctgcttaacacccaatatcaaactggtgaggcttaaatttgcccccaaatgggccccgtcatctttaatccagcctcagacttacgtggcctctgggcaaggtggttgccctgagtaacagaaaagataggaaaggaaaagtagagagagaaaagcattgcctgtagcagggtggggaaagcgaaatgatcagggaggtcagagaaagacccacccattgcagtgacattgaaaagttcaggtggctgctcctcagtagcaaagggatcttttccagccatcccatcagctcttaagtttccccttttagggaagaaaaagttccccatgtcccatagtcctgtacatacctgactctgtcacccacagccattagcaaagagtgcaaggcagattaatccaaagagaatagcagttaacatcccatagtgccaaacctgttcttacccaagaaggcctttactgagacgggcctctaaccccctaaatcttagaagggactctatccctcataagttggacctctaacccttgccttttattaagaggggcactttgtcctcttgaatcagagactaatttttcagacttgtttcatggatatcattttgagacttctcttgactggtttcctgtaatagagccactgctttctcttcctctttggtttcctcccttgtttttctggaacacatcctcaaataacttccttagaaagggtattaacagtttaattttctcagtttttgcatgctttaaaatgtattctacctctgtgattgatttatagttcatctgggtagagaaatctaggttgaaagtcattttccctccgaactttgaaggcttttgctttgttgccttctaggctacatatgtggtaatggaattgcaggatcttatggtagcttttttttttttttttttttttttgaaacagagtcttactctgttgcccaggctggagtgcagtagtctgatttcagctcactgcacccttcgtctcctgggttcaagcaattctcctgcctcagcctcccaagtagctggagttacaggcatgtgctgtggcgcccagctaatttttgtatttttagtagagacagggttttgccatgttggccaggctggtcttgaactcctgacctcaggtgatccacctgcctcggcctcccaaagtgctggaattacaggcgtgagccaccgtgctggtttttttttttttttttttttttttttttaaatagagacagggtctttctctggtcacccaggctggagtacagtggtgtaatctcagctcactgcagcctcaaactcctgggctcaagtgatcctcctacctcatccttccaagtggctgggaccacaggtgcatgcccccattcccaggctaatgtttaaatatttttgtgtagagatagggtctcactctgttgcccaggctgttcttgaactcctagtctctagtgatcctactgccttggccttattttaaactttttgaggaaactccatactgttctccataatggttgtactgattgacattctcaccaacagtgtacaggggttcctttttctccatatcctcaccaatacttgttatcttgtgtcttattttattttattttttgagacagagtctcgctctgttgcccaggctggcgtgcagtggcgtgatcttggctcactgcaacctccgcctcccggctttaagtgattctcttgcctcagcctcctgagtagctgggactacaggcgtttgtggcaccaccgcccggctaatttttgcatttttagtagagatggggtttcaccacgttggccaggatggtctcgatctcctgaccttgtgatccacccgccttgacctcccaaatgtagtacccattctaacagaagtgatatctcattgtggttttaatttgcatttccctgatgattagtgcatttttttcatatacagtttggctaactcctgttttctaatttattgcacagatgtaatcataaaagagaaacagtaacattactcacagaccaaccagcttaatactcagctgttctcaatatcatgtgttctgttatagtttgtgaatgcttattttatatgaattctatgaatgcttagtttgatgtactcgtgattgaccacagtataatttttcattggcatttaaaaaatgtcacacttcaaacatgtttcttctttatgattgtgttaatcttcataattatgagatggagcttgcttttatgttaacttcttggaatcagccagcctcaggaggatggtacacataagtgatgacggggtgggagcagcacaaaagatccaatggtgctggctgagccaatccctgttccactggcccttctctccactgtcccttatgtggtgctgtgtaaggaagcatggccagtctcaggacttcagagtgctttggttagcagtgaggtctgactcccactgcttcaaggaggtgtcgtaagctgtagggctgttgctctttacttttccctgtcagtacccacgaggaggtgtgtttgggctggaggcctgggctcacatggtgggtgcacaaccaagaccatcatcattggtctgatgatgaatttttagcaactctgaacctaacctgtgctctgtaacagtttctgaaatgaggtgtacagagatgggaagaatcttttggaaaacagagacagacatagtaaaaaaaaaaaaaaaggaaaaagaatagatataacaaaaatatggctggattgtacatttcataatacacatccattcataaatatactttagtttcatggttttttaaaaattcctagtagtatagataaggcagaagtaacacttatggggagaacagactgcaatttggcagcaaaaggaaggtgttaaactgtagctggaaataacagcagacttgatctgttctatattaatttttccagcttcaaaaccaacaaacaattgaaggtttaaaaaaaagaaagtggctgggcacggtggctcacgcctgtcatcctagcacttgggaggccaaggcggggagatcacctgaggtcaggagatcgagaccagcctggccaacatggtgaaaccccatctctactaaaaaaaaaaaaacaaaaaaacgaaatacagtaaattagccgagcatggtggctcgcgcctgtagttccagctattcgggatgctgaggcaggagaatcacttaaactttggaggcagaggttgcagtgagctgaggtcgcacattgcattccagcctgggcaacaagagcaaaactccatctcaaaaaaataaaaaaagaaagaaaaagtcagccttaatttagtgatgttattaagaataacaaatgccagtgtgatgatcagtcctggactctcaggtttgcctgttctgactagagttatggtgaaactttagttatcttccagtttttaatacggtccttgctgcaatgactttattctagagaactagcattactaaaacattttagtgcttagtggtttttaatacttatttcacaagaataattaaataagtcttttcctcgttgagtgtgtagtatgatgcaggttaggtatctgtgacacctataagtaaggctgacccatgaacaacactagcttgaactgtgtgggtccatttatatggagacttaaaaaaaataaatacattggaaaattatttggagagttgcaacagtttgaaaaaaattcagatgaactgggtagtctagaaatatgaaaacaattgagaaaaagttacatatgtcatgaatgcataaaatacatgtagatactaataatcagttttatcatttactaccataaaatatacacaaatctattataaaaagttaaaatttgtctaaacttatgcacacacagactgtacatggtgctattcatagttgagagaaatgtaaacaaatataaagatgcagtattataactgcatacaattaactgtagtacatacagtactcctgtaacaattctatagccacttcctgatgttgttgcagtgcgctcaagcattgggggtagctgcttggaaggtactgtgatgctaatcatctctgtgggagcagttcctctctccagtacacctcagatcgcagtaaaaagtgacctcttgagattcttgagtatgttttgttgtgtttagtgcagtaccacaaaccttgaataacactatgggacccatacaaagtgccactagtgatgctggcagtgctccctagaagccaataaaacccctgacagcattgaattgcttgctagattgaggaatggttgcctgtcgcttcagacagatgattcattttgcaaacagaccatgtaaacttatggtattgataaatacagtatggtactgcaaatgtatttcctcttccttatggttttctgaataacattttcttttttctatctcattttatcttaagaatacagtatataatacatataacacaaagtgtgtgttaactgtttatgttttcagtcaggcttccggtcaacaataggctattagtagttaagtttctggggagccaaaagttatacacagagttttgactgcatgaaaggttggcacccctaacctccaagttgttcaggggtcaactatattaaaagtctatgatatactcttggctttccagaaacttaatttgaagaagttaatttaaaaaccatagttttctatatattaatttgacagttcagcctttattaggtcaaagtttcaaaagagctcagctgttagatgtttagtaatgaatgccatcagcctttatgtcatcaggattcaggatgtttaggtgtgtgtttgctcagggctcagaaatagtcttggtggtgggtttacagctgcccatcttgttaggtgtggaacctgccttagcgctggggctgctgccagtctatgggaacattccctcccgtgcccttcctacactgtagaggcctacaggttgatgaccacttctgggacccttcattacacctctcactgaaagcatgtagagttgtgtaagtgacagcagccagccttgactcatcaaatagtctttcagtttgtaaaaaaaaaaaaaaaaaagtccaggattttattttacactgtaacatctgaggtgggtttcaattctagagcacaatggagactgatgtctgggtttcacccctagaattgtttttacattgtctgtgatatagtacagatgaaaataaaagagaattatttacaccttacatttgctgttacaagtattctgtattatgtctatatcatgtcaagtaacataggtatgttcttatttcatttattcttgtttctccatgtacacaaatgagtacatcatttccacttacggcaaaagtgatatgtcattgtatcagatccatctctcagtattatctgtatcttctgatttcttaatcaaatttatgctgtcaaaatatgttaatgatgttttttaaagtgtttattgagaaattcacaaagaacttgtattttgtcaaaaggccattgtttttgttgccaacattatcagtgcagatgtactaaattgcaagttacagaaaacccagctcaaggtgacttataggaagggtatttactggcttgcctaactgaaaggccagctataggccaaacttcagggttgatttgatttagcaacttaacaatgctattgagagtttagtttccttcttccttctctgccatctgcattcccaccttcctcttgaaagggcagggtggttgccagccattcccacacctacacattttctcactctggtcccgtggtgtttaatagcttgcccagaaaaccttccctttgtcacattgatcttaattgagttgtgtgcccatgcgtgaaccagcaactggctggggatggggtcatcctgagtagctcaggcttggagtcagcctcacccaaagtatagggctgtggggaggaagcacagaaaccacagtcagaactgggtaattagctagaggaggaggaaatggatgaagagcgacagccactgtccactgtgccatgtgatttacagtcatttgggttttgtttataagaatgcttgctttattttttcatttttttcttcttctgtctttaaggggcctttacaacaactaaacggacaggcattccagccccacgggaattttcagtaactgtctcaagagagaggtctgtgccacgtggtccctccaaccccaggaaatcagtgtccagtccaacttcttccaacactcccactcctacgaaacacctgaggaccccttccacaaagcccaagcaagagaatgaaggtggagaaaaggctgcgcttgagtcccaagttcgggaacttttggcagaagccaaagcaaaagatagtgaaattaacaggcttcgaagtgaactaaagaaatacaaagagaaaaggactctgaacgctgaggggactgatgctttgggcccaaatgtcgatggaacatcagtctccccaggtgacacggaacctatgataagagctcttgaggagaagaacaagaactttcagaaagagctttccgatctagaggaagaaaaccgggtcctgaaggagaaactgatctatcttgagcactccccaaattcagaaggggcagcaagtcacactggcgacagcagctgcccaacatccataactcaagagtcaagcttcggaagcccaactggaaatcagatgtccagtgacattgatgagtataaaaaaaacatacatggaaatgcattacggacatcaggctcctcaagtagcgatgttaccaaagcttctttgtcgccagatgcttccgactttgagcacattacagcagagacaccctcaaggcccctgtcctccaccagtaacccctttaagagttcaaagtgttctactgctgggagttccccaaacagcgtaagtgaattgtccctggcttccctcacagagaagatacaaaagatggaagaaaaccaccatagcactgcagaagaactacaggctactctacaagaattatcagaccagcaacaaatggtacaggaattgacagctgaaaatgagaagctggtggatgaaaagacgattttagagacatcctttcatcagcatcgagagagggcagagcagctaagtcaagaaaatgagaagctgatgaatcttttacaagagcgagtaaagaatgaagagcccaccactcaggaaggaaaaattattgaactggagcagaagtgcacaggtattcttgaacagggccgctttgaaagagagaagctactcaacattcagcagcagttgacctgtagcttgcggaaggttgaggaagaaaaccaaggagctttagaaatgattaaacgtctgaaggaagaaaatgaaaaactgaatgagtttctagaactggaacggcataataataacatgatggccaaaactttggaagagtgtagagttaccttggaagggctaaaaatggagaatggatctttgaagtctcatttgcagggtgagaagcagaaagccacagaggccagtgctgtggagcagacggcagagagctgcgaagttcaagaaatgttgaaagtagcccgagcagagaaagatctactggaactgtcttgcaatgagctcagacaagaattactaaaggcaaacggtgaaattaaacatgtttccagtctgctggccaaggtgagaagagacagctctttactggtatttgctcatccttgttcacatttctgcccttaacctctaaattcacagagcacagagaagcatttgcttagtctgtttcattcacgaagccagcattccagcttgaaggcctgttagattgcacacaggttgggattgggggatacaaaaaggaaacacccaaatttctgattatgggcggttcaaaatgtggggatgtagagtcaaatcagagtatgatgcagtgataaaagaatatcatacagcctatgcccaggctctagtctagtgcaaaggaggggcatctggtgtaacgtgggggttgggcgtagcacagaaggacttcctggaagaaatagcaactgagctgagttctgaagattgagtgggagtttgccagtctgtcagcatgcttttagctgccagtaacagaaaatgaaatcactcccaattttcaactaaaatattaccactattttggtgttttcttccagatatatgtgtgtgtatgtgtatcatacaagttacacaaatttataatcatcctgtacatgttattaactttttttgcatttgacattttagaaatattaaaacttttctcagcatattcctatcattaaatattcatttaaacattattttaaaggccagatactattttaatataaatatttcatatttaccctgttgttgaacatacatgtattgtcaaacatttgtggtctttccagtctttcaatattataaatacttttttatatctatcttactgtttatttaggaaaaattcctagacgatgacttaccgagtcaaagagtataaacattttaaagactttcaacacattcagccagattgcccttcagaaatattatgccagtttattcatcctagcggtcatgagatcatgagctttcctgagcctttgccagcacttggtattacattgttatatcatttaaatctgttaatcatttcatttttttaaccttttttgcttgggaagatcttccatagcccaagagcaaataacttttctcaacactttaatcagcctgtaattttgtttttgatgcaagaattgtggtgattttatgatattctgcccacctcccagagcagtgctggagaggtgcagagagatggcctcctatttcttgttccctccaagttctgggtctgatttagggatctactggcaagagagattcaaaacatcttcctaccttagtttaggggttgtcattgtttcaaggagcaaattatgccatgagctctcagggagatttttctccactgcttcgtctgtcttaagatgagtctgttgcagcctgattctgcaatttggccatctgatgagcttagtggtgggtcatgttaaggagtttctctctttgtctgtattctaaatttgtaggtattttattgaaagtacggaagtaattccattagaggttactagtcaggcttggcattgggttttaatatcttgtggagtaagattattctttttttactttaagattactcactactctctggcaaaatgttttatctcccatgtgcaccttcttgaagttctttatcagtccctctgtgtttttggtagtttggcattacattaaatgtgcatatcagtgagaaataatttgacatcttaaaaatagcttatttttttctgatcataaaatatttttattacagacgatttaaaaagtacagaaaagtataaaaaagaaaagtattacctttaatttcaccacttggagaaaaactgctaaccttttgctgtatgtcctttcaggccttttctcagtttatacatgtttgagcatgcataaaaacttgcattgatatgattatgatattttgtcttcctatccagaagagtagagtatgtctgtccacattccattacaaagaatcagttggattagtttatctattccactattaatctgtttctgattaacttgtttctacttttatctttattaatttttttgtcttattttttgtacattttggtttcttgactaaaattctttgttcatttaacttttttttatccttggttgataatgaaagcatttaaagttatagctttggtaaatagaggcaataaaatctggaatcttctggaataaactaaatgtaatttaaaggaaagtgtgcattttctgtagagtgcaaggcacaacatatatgtttaaaatcaaactgttattattcatgtatcctacatcttactgcatgctaactagaagtatcaaatactgatagtaagaagggaaaggtcctagctagtatttttaggtgagagtttgaggtaaagatgggggcatgctatcacatagggtttcttgtatatctatcaagaccctaggtttgtgattttgtgctgtcttatgtgcacagagactgatttgtaattgcagtggacttgtaacatactaatcttcctacccttttacattactgtagaaaaagcaaaacatagacctcctaaatggactaatactgattgtatctctaccacagactatcaagtaatctgccaacaaccatgaatttaaatgataatacttaagagactcatgtccaaaggataacaggagaagttttagcacaaaactatgatgaagggtctaacatgctggactgggtcctcttgacttacccagtgagcaatgatgtgaccttgggcaggcccctttacattgtgcaatgtcgaatagaagcgtgacggtggatggatcctggtctcgtatctaattccaagggaagcatttaacatttaattatgatgtatgttttttgtaggcatttggtacataccttttattatgttatgcaagtatttgctaagaggtgttttgtttggtggtttatttttagagacaggttctcgttttgtcacttaggctggagtgtagtggcgattatagctcactgcagccttgaactcctgggctcaagcaatcctcccacctcagcctttctgggtagctgggactgcagccaggcaccaccatgcctgactacttggcttgtttttaaaggatgaggattgaattttttctacagctaatgacgtgatctgatagtttttatgtaatcaagtttttttctcctctaacttgttagtgaggcaagttataacaacagattttctaaggtgctctagtgtaaaatcatgcttgcattcctggggtaaatcctaattcttcagttttcagtggtttcacttgactttttgctgagaacttccaaatatagctgccttcagcaggtatcggagtaactgtcctgttgagcaccaagcaacaacgtgtaccccatgagcagtgcattcatccactctaatgcttggcgaaaggtgaatattattaaaaaggatacaataagctatttacaaaaggggaaagtggtgccaaaccatcctatgatctaatagattccgtaaatctatgtaagtttcaagttaagattactcaagcaacccagataccgtcaaaagaacctataaaaagccttgaaaagtacttttttaaaaataggaggtaggtgtcttcctcaaacaataaatggaaaattggtaggatttctacactatcttgtaggctttttttcttctcatttctttttcttcattggtttgctgatttctttatttttttcaacttctctgatataccccatatgcatcttgatggccgcttaatctgtagtcacatgacatacttctgtacaactttgaggacgggtctgatttccacagaacccaaagccaccactcctatccttgccctagctagcaagcagcatggagttgtatgggattgttgtttttccagacaataacatgacccagctttaatttacttttttaccttttcagttgtttgggatcttggtttcaagttagaatatcttttctgggcttgaaacctagaagttttaaaagaaaattatctatttattcccgtgaggttgaagcttataggtggtatccttagaatcttagttctttctgcagaaacttcagtccgcttccagaagagtaaggagattataaataaccccttggcatgaatggtttgcgggagtcagcagaggtgaaatgactagtgttctgcttgtgtgggtcctagagccaaactgatttagagtggccagtggtcagagatggcagaaccagaatttgagggaaatatgtggcaaatagatgatcctgtagctgtgacattggaataggatgccttaaaggacttaagagatctggaaacctggtttaaacagtcaggtgggttggaagtgtatccaggtgatgtattgatatatgagaaactgccctcctgtcagcggcttgagccaggggacactccctccaccccggccccaagggtgggagattggctgtggctgcccatgatgcaggcccaggctgtggctggcagtgctgtggttctggacctcctgccaggggtacaggacagctcagcattgccaagcatcttggtccacctgttggcgacttggggcaggcatgtcacctggacatctgggtcctatggggagagggtttcccagagctttacctttacatctgattggtgagaactgcgtcacacagtgcccccaggccacctctcttgaaatcacagttgcagcctgattcttgaacaaaattgggattctgttaggaagaaacaaggtgggggtggcttttggtgggggatgggcacttgccccaccaggcctccactccctcaccttttcccacaaagtactcacagtgatctgatcatgtagcgccttccggtgctgcctggggcaccacatggcttcgcccagtgcccagctcccaccacacctccacttgcagtcccaccccacatccagccatattcccacccctccctccatgccaggcctggccgggccagtgactgtctggcagtcatgtttgctcagggggttttctcggcctgaagagaccccaccccattgaccattacctggtccctcctgaagctttccgcctcagttatggggtcttcagcgaggcattcagctctgcggggccctgtcccatggaacttcagactcatctcagtaaatgacattattgtcactcagccaaggtcactcatgggaatggcctgacccaccctggccctcagaggattcagatgtgcaggcaaaactctttggggccctgcagggaagctgagggaacctgctgcctgagtagccactggctgctgctggagaggtgggaaggttactgagctgaaaacatggagatttcagtcatcttcagctcacacataaggcatcccactggcaccaaatatcaactctggtgagcagaggcctgtggcttcatgctgggaaggaggcctgtcagcagctcctgtcaacagggcctgttttccagctcccctgggcaagccatgaggatgtggaagtcgaggaggcctgtggaggctgttggggagagccccacagctgttgcaccagtaagcctctgctcaaggggctgtggcctggggaaaattgccacaggcctcagcctggctgtgcagagccagtttagcattaggagcggaatcttctagagattaaactacaaagccagaatgcctgtgcagccttttattttgtgggatgtgataggcatgtggcccggaactcatggcatgtctgccaggtcctctcccgacacccccaggtctctgttcttgaagccccttgaaaaggggcagaagtttggtggagacagtcagatagtttgaggaagggtggtcttgccagttgggcagatccacagaacctgtggctccgaccccttgctcttacctgtgactccacagggggctgcttcccaatcctgcctgaccctgcttccctgcgatggacttgttttctcctggacacgttaatgccttttgtgaggtgaggcctaagcagtctcttcctttcacatgacctcaggactcatctgcgaacctggtgttgcccagcacttctctctccagtccgagttcttgggaagtacctgcgtggggccttgttgcttcgaaaggtccctaccagggtacagccactgcttctgaagcttgcctctgagttcctaaaggtgaaatacagatgtttaccctcatctttgagttttctaacagcctttctccactatacctgaagtgtaaataaactaacatttcctcctctcccttggtggagcagcattggccaaaataataataattcaactttaggccaataagaatgaactatggatgattatcagcagtgtctattcacaacagggctaagaaccgagcagagggagttttgcagtacccaagctagatgccagaacagaaacaccccactttcttactcattgaattagcccgttttcatgctgctgataaagacatacctgagactggaaagaaaaaaaggattaatgaacttaacagttccacttggctggggatgcctcacaatcatggtggaaggtgaaaggcacatctcacatggtggcagacaaaataagagagcttgtgcagggaaactcccccttatataatcatcagatctcgtgagacttatactgtcaggagaacagcacaggaaagacctgcctccctgattcaattacctcccactggggtccctcccacaacatgtgggaatacaagatgagatttaggtggggaggcagccagtctgtatcactcatggtaaatttactcaagctgtcattccaagtttatttccttttaaactatatgtaattttagcattgcaattccttccatctattaggtgttcagtaaatacttttcagacgaatgaatgaatgtcagagaaacttgcagcagaattgaggggctgctataattatattaatatgtttaaaaagtaaagtttattatattttaataacagcaactaatattttgggctatttgtatgtgctaagcagtctcagagcttttccatcatttaatcttatttatcttaattttatgctgttgattctgttgtctagtattttttcatttgagcaaacagaatgatttaagttattagtctaatggattgatgaaatgaagccagcattcaaagttgggtctgaccttagagctcttattcttttttttcttttctttttttttgagacatggtcttgctctgttgcccaggctggagtacagtggtgcgatcatagctctctgcagtctcaaattcctgggctccagtgatcctcccacctcagcttcccaagtagctggaattacaggtgtgcaacactatgcccaattttttatttttattttcatagagacaggatcttgctctgttgacaaggctgatctcaaacttatgatgatcctcccacacctcagtgcctcccaaagtgctgggattgcaggggtgagccaacgtacccagagctcttattataatcactgatttagactgctgcccagttacctgaaagcaaagaagagacagaaaaacacttaaagcagacctaagactaatagttgtcactgtcatcttaaggccaaagccctttgaagaaaaccacctttgaaagccttgttgaactaggagagttttacctgattgtaatacaatggagaaattcacagtgaaaacctgagtcatcaagaaatgttattttgtttgacctctacctgagtcttgaggggagagggggtgagttgacccctgagtgtatggggtggggactctgggaatgctgccagaagagaacagcaggtcctaaggccagaaagcctggccaccaaggaagtgatgcaggtagtttgtccttgttggagtgaacagggtggtcagtggaagtggcctggtggagacaccagccaagcagttaggattttatcctcaagacagtgggagtctctgaagaatttttttttttaaatagcagcttttattgagatatgatccatttaaatcacgtaagtctgtgggttttagtgtattcacacaattgtgcaaccatcactacaatcaattttagaacatttttatcaccccgtaaaaaaatcttaacccacagcagtcaccctccaagaccgcctccctcccagcccctggcaaccacaaatctatgttttggctctgtggacttgggtcttctggatgttttatacacatggaacccacgccctgcggcctcaagcagccctcccactttagcctcccagagtgctgaagagttctttctattctttggatacaaatcctttaccagataaatgatttgcaaatatttcctctcattctgtgggttatcttttcattgtcttgataatgccctttatggcacaaaattgtttaatttttatttttatgaagtcgaatttagttatttttctttggtggtttgtgcttttggtcggaggaattttaagagttatggaatcacatttactgttgagaaagatgacttgggccacagttaggtgagaaagaatgaaggacagaacagggagtgagttgggtgggaagatgagggctggaaagacattcattttatttacttatttatttttgagacggagtcttgctctgttatccaggctgagtgcagtggtgcatctcttcacgcactgcagcctccacctcctgggttcaagcgattctcctgcctcagcctcctgagtagctgggattacaggcacctgccaccacgcccagctaactttcctatttttagtagagacggggtttcaccatgttggccaggctggtctcaaacccctgaccttaagtgatccacccacctcaacctcccaaagtgctgggattacaggcgtgagccactgcacccggcctggaaagacatttagatgttagatgtgtagaagggaggctcagtagggtcaggtgactgatttgatgtcagggacgggcaggaggaaggcatttcagcctattcatagatctccagcttgtaggattgaatgtgcggttgtgctgcttcctgggagaggaaacacagaatgtggggcaggcttgagaagggagcgttatctgctggagctaacaaggatacccaggcctgcaagcccaggctgctgtcagcaactgccgatgcagccacagaggagatccgggagcctctgcccttccaggccaagagtcctccaaggccggggcctcgtgcctgaggtctctctttgcccctccagtacctttagaagctgtagaaatatgtctagacaggatgttccatgaatgcatttcacatatgctgaggtttgtgaggagcctccacagtgtcagaggaggttgcgactctgaagatgagcaggtgcgattctgaattcttgaccattctctgccctggtagatgatctctttttaagcactcgagaaaacttgattgaatggactatataatcactatataataaacagattaagtcaaaagccaagtaaaatgacagacttacacaagaggcagttatggggggtttatgagtcaggtatctttcttctccacttgttctgttttctaataaaactgtctgtacaactttaatgttactggaatttactcagaacttattatagtgatctcattctgtccatgtctctatagtaccatgtttttggcatgtaactatttgaatgaaagattaaatgatttctcatagccagggcataattcttcaagatactgtctttgctataaaaatttacaaaaaataactaacactgaaatgtttgagccgcattttgtctcacagaatgcttttacttgaatgtactgttttctttgttctttatatattgataatgttgggtaatctataaacctaattccttattctctttagtctacagtctctattcttatggctgctttgtgtaggagaagagcttggttcttagatatctctagcttgatttcctttctgcttttgttcatcacactaaagaaagctatatagatgccctgacagagatcttttttcagtattgtcaaattatctggtatcaaaaaacagaaacccttaagtaacttcacagcttctcacaagggcttgctgcataataacaggcagatatttttatattcactttacagattaacatatgaagagagggagaaattaaatcacttgaaaagaacaatccagcatgtatcaagtggctgagaccaaaccctacccttggtcaaaccatcacaaacagttgtttacccctccgagagaggagaatctagatgtgtgtgttgccaccagcataggagtgctcttaatatctgcagtcggggagagcatcccccccacccccaagcacttcctctttgcaggagcactcatctggagatgcccgaggcccattgcctttccttagggtgctggttaatgtctaatctaattctttgatccaagcttgtgaagtgacagtgattcttttggggagaggatggcaagtagcatgactcagcctccaggcttaactttatcttccgagtaaggagtttgggggtcctgagactttattttcctttacatgtgtctgacaagcatggtgtgggggtggggtgggtggaggaggtgacccttgataggattctagaggggtctgacttcagagctgcctgcttatcctctgggccctgcgtaggaacctctgctgccatatgccttgggcacctgatggaaaggagtggctttctctgtcctctctgcaggaacccttcttgggaagtttgtttgactctatttatagtgcaattccactggctccatatctacagaaagttgatctttgaaattgagagatgcatgagagtgattccttttttcaagggaaacgttgaaaatcacattgctgggtgtctaagagtgtgattcttgacctagagaagttaaactctaaggagctggccagtcagacatgttgggtggtctccctgtagttccagcttcagagggctgaggcaggaggatcacttgagccccggagttcagcctaagcaacatagcgagaccccatgtcttaaaaaaaagaaaaaaaaatctcaagggaaatgcaaaggagctggccagcagagagaccagcaatgtgaatagggcctggatcccctgcagtcgtggaagggtaggctttggtctcagccacttgatacatgctggattactcttttcaagtgatttaatttctccctctcttcatatgttattctgtaaaatgaatataaaaatatctgcctgttattatgtagcaagcccttgtgagaagttgtgaaatgacttaagggtttcagtttttttattgtgtgtgtgtgtgtgtgttttttttttcttgtaaatagctttctggaatatattgttaaacttgagatagttattccaacatccaagaaggatgtagtgatgtgtgcatgtgaaacaactgctgatttgcaggtcccctcccccatgccgagttacctagcttgtaacttggcgcagagcctttgagggacagcagcctcacctgcaagcagaggctttgctcagggtgctcgacctctaggctgcctcgttacatcctcagtttaattcctggcccacagttgtcccagccaaaccacatgcatgtttctagactccaggtgacaggcccttagcctgaggactctacaacatgcagccaggtagttatgcagaaggccacagtctgccccaggatgcaagactcaaaagccaccttctattgctgcttttcaaatgatttcagacatcagccttccaggatctaaaatgcattacttcttttctccttaaattcatcttctggccaggcacagcagctcatgcctgtaatcccagcacttgggaggccaagatgggaggatcacttaagcccgggagcctgggcaacatagcaagaccccacctataaaaaaaaaatgaactgggcattgtgatgcacacctatagtcctggctctgagggaggccgaagtggggagaatggcttgagccaggagatagaggctgcaatgacccgtgatcgtgccactgtgctccagcctgggcaacagagcaagaccttgtcccttgactccaaaaaaactaaaaaatagtaaagtcagcttctgtttaataaagtagctattgctaagtatatattggtctttcatgtattgtgatttttcttggtcaaactgacctgtattatattactacctagtgttgtatatataatacatagggcaattgtgagagaaagaatgactttcattgacttttactgttacatgttccaggcactatgataaactctccaagtcattatttcacttaactgcccaccccccaaccctgcattgttagattatgaaacagaggcagagggattaaggaatacaaggcttgattcactagaattggggtttaaaccctggcggtctggctccagaatatatgtccttagtcatcttgatgcatttaagcagctttcaagcttcagagcacaacctgcaatgatctattttgtattacaatccagagtctcacgcctttataattaaaacacaagcttcacagagcagtgctgacccctgagcacaggcagggctctctggctgtttcccaggctgtttctctctctcttctcctgtcctttccctccgtcccttcctcccccctcccttattctttttttctaatttttaattgttatgggtacatagtaggtatatatatttatggggtacctgagatattttgacacaggtatgcaatgctgtagtcaccctgttgtgctgtcaaataataggttttattaactatattgtatccattaaccatccctgtttccacccctgccccaccacccttcccagcctctggtaatcattctactctctatcttcatgagttcaattgttttaatttttaactcccacaaatgagtgagaatatatgaatttatctttctatgtctggcttatttcacttaacataatgatttccagttccatccatgttgttgcaaatagcaggatctcattcttttttatggctgaatactctgttgtgtatatggactatattttctttatccatttgtctgttgatggatacttaggttgattccaagtcttggctattgtaaatagtgctgcaataaacttggtgagtgcagatatctctttgatagactaatttcctttcttttgggtgtatacccagcagtgtgattgctggatcatatggtagttctatttttagtttttttgagggacttctgtactgttttccatagtggctgtactaatttactttcccgccaacagtgtacaagggtctgcttttctctgcatcttccccagcatttgtcattcatgacttttgaataaaagtcatgacttttggataaaagccattttaattggggtgagatggtatctcattgtagttttgacttgcatttgcatttctctgatgatcagtgacattcagtatgttttcatgtttctgtttgccatttgtatgtctttaaagaatgtctagtaagatcttttgcccactgtttaatcagactactagatttttttcccccattgaattgtttaagctccttatatattctggttattaattccttatcggatgggtagtttgcaagtattttctcccattctgtgggctgtctcttcactttgttgattgtttcctttgctgtgcagaagctttttaacttgatgtgatctcataggttcatttttgttttggtattctgtgcttttgggctattactcaagaaatcattgcccagatcaatgtcctggagagtttccccaatgttgttggttttttagtagttttcatagtttgaggtcttagatgtaagtctttaatccttttgatatgatttttgtatatggggggggtgtctagtttcattcttctgctcatggatatccagttttcctagcaccatttactgaagagactgtcttttcctcaatatatgttcttggcacctttgtcgaaaatgagttcatgtagatgtatggatttattcctggattctctattctatttcattattctatgtgtctgtttttatgccagtaccatgctgtttgggttactatggctctgtagtataatttgaagtcagataatgtgattcttccagttttgttctttttgctcaggatggctttggctattctgggtcttttgtggttccatatgacttttaggatttaaaaaaaattataaagaatgtcattggtattttgatagggattgctttgactgtttagattgctttgggtagtgtggacattttaacatattgacttatccagtctctacacatagagtgtctttatttttgtgtgtgtgttttcttccatttctggtgtcaatattttatagttttcattgtagagatctttcacttctttgattaagtttattcctactttattctactcacagctactataaatgggattactttcttgattcctttttcagattgttcactgttggcatataaaaatgctactgatttttgcatgttgattttgtatcctgcaacttcactgaatttatcagttcttaatagttttttttttttttttttttgtggaggctagttttttccagatatcaagtcatatcatctgcaaaccaggataatttgacttcttcctttccaatttggatgccctttatttctttcccttgtctgattgctttagctgggacttccagtactgtgtgtgaataacagtggtgacagtgggcatccttatcctgttccagatcttagaggaaaagctttcagtttttctccattcatatgatactaggtgtgggtctgttgtatatggcttttattatgttgagatatgttccttctgtacccagtttattgacagtttttatcatgaagggatgttgcattttctcaaatgttttttcagcatcagttgaaatgaccatatggtttttacctttcatttggttgataccacattgcatatgtcaaaccacctttgcatccctaggataaatcccacttggtcatgatgaataatcttttaaatattttgttgaatttggtttgctaggattttgttgaggatttttgcatcaatgttcaccagggatattggcctatagttttctttttttcatgtatctttctttgtctggttttgttatcaggataatactgctttcagaattggtttggaaacattcccttctcttctatttcttggaatagtttgaataggattggtatttttctttaaatgtttggtaaatttcagcagtgaaaccattgggtcctgggcatttctttgctgggggactttttattctggcttttatctcgttacttgttaccggtctgttcaggttttggatttcttcatgattcaatcttgttaggttgtatgtgtctaggaatttatccatttcttctaggttttccaatttattggcatatagttgctcatagtagtctctaatgatcctttgaatttcggtagtattggttgcaatatctccttttttatctttgattttatttaattgggtcttctctttttcatagtctggccaaagttttgtcaattttgtttatcttttcaaaaaccaactttttgtttgttgatcttttgtatttttttcattaaaatttcatttatttctgctttgatctttattgtttcttctcattttgggtttcatttgctcttgcttttctggttatttaagatgcattgtttgtttatttgaagtttttctctgtttttgatgtaggcgctgattgctgtaagatttcctcttagtactgcttttgctgtatctcataagctttggtatgttgtgtttccattttcatttgttttaagacattttaattttttcttcttaattccttcattgacccactggtcattcaggagtgtattacttaatttccatgtattcgtataatttccaaagttcctctttgtgatttctagttttattccatggtggtcagagaagatacctgatatgatttcagtttttttttttttttttaagttttaggagttacagggccaggcgtggtggttcaagcctgtaatcccagcgctttgggaggccgaggcgggcacatcacctgaggtcaggagtttgagaccagcctggccaacatggagaaaccctgtctctactaaaaatacaaaattagctgggtgtggtggcatgcacctgtagtcccagctacttgggagactgagacaggaaaattgcttgaacccaggaggcggaggttgcaagtgaagcgagatcgcaccaccacactccagcctgggagacagagcgagattgtgtctcgaaaaaaaaaagtttcaggaattattttgtggcctaacatgtggtctctccttgagaagaatcatgtgctgaggaaaagagtgtgtattctgcagccattagatgaaatgttctgtaaaggtctgttagttccatttgttttgttttatagtgcagattaagtctgatatttctttgttgattttctgtcttattaactttttgttgttgtctgttgtttctatttacagcttattataccatgtcttgaaaagttgtagttatttctcttgatagattcatcttttagtctttctgtttaagatacgagtagttgacacatcacaattagtgttaaaatattctgtatttgtctgtgtacttgctgttaccaatgagttttgtatgttcagatgatttctttttgtttgttaatgtccttttctttcagatcaaagaactcccatttgcatttcttgtctgctgttgatgaaatttcttaggttttgtttgtctgggaaagtctctatttctctgtcatgtttgacattttttccttcagtactttaaatatggcatgcctctctctccctggcctgtaaggtttccactgagaagtctgctcctttgtttcttttttcttgctgcttctaggatcttttcattatctttgccttttgggaatttgtttattaaaatgtcttacttgggcaaagtctgcttggtgttctataacctattgtacttgagtattaatatttttctctagatttgggaagttctctgttgttatccctttgaataaactttctaccccaatctctctctctacctcctctttaaagccaataacttactagatttgcgctttttttagactgttttgtagatcttgtatgtgtgctttattttttttaaattttgtctcctctgtatattttcaattagcctgtcttcaagctcactaatttttcttctgtttggtcagttctgctgttgagactctgatgcattcttcagtatgtcataaacttttagctccataatttctgctttatttttaaaaaattatttcaatctcggccgggtgcggtggctcatgcctgtaatcccagcactttgggaggccggagtgggcagatcacgaggtcaggagtttgagaccagcctgaccaacatggtgaaacccgtctctactaaaaatacaaaaattagccgggcgtggtagcgcctgcctgtaatcccagctactcaggaggctgaggcaggagaatcgcttgaacctgggaggcagaggttgcagtgagccgagaaagtaccactgcactccagcctgggcgacagagcaagactttgtctcaaaaaaaaaaaaaaattatttcaatctctttattaaatatatcgaaaggattctaaattctttcgctgtgttatcttgaatttcattgagcttcctcaaaacagctattttgaattttctgtctgaaagatcacatctctgtcactctgggattggtcactggtgtcttatttacttcatttgatgaggtcatgttttactggatggtcttgatgcttgtggatgttcatagatgtctgggcatggaagagtccggtatttattcagtcttcacagtctgggcttgtttgtacttgtctttcttgagaagactttccagatattcaaagggaattgagtgttaggatctaagcctttggtcactgcagctgtgtccgcattagggggcaccacaagcccagtaatgctgtgattcttgcagactcattgaggtatcaccttggtgatcctagataagatctaggagaatttcccggtttatgaggcagagtctcttgttccttttccttactttcccctaaacacacagagtctctctcttcatgctgagctgcctggagttggagcaggggtgatgcacttctgtggctaccactactgggactgtgctgggtcagacctgaagccagcccagcactgggtctcagtcaaaacttgtggtgactattgcctggctactgctgatgtttattcaaggcccaagggccgtttaattagcagatggggaatctagccaggcttgtatctttcccttcagggtgatgggttcccttctagcccagagtgggtctagaaatgctacttgggagctggggcctggagtcagcagctttagcagtctgcttggttctttattttattgtggctgagctggtatccaagttggaagacaaagccctttacccttccctctccttttctcaagccaaagggatctctgccagtggccaccgccaccccaagcctgtggcagcaccactgatgtttattcagggcccaagttctctttagtcagcaggtctggatctctcccttcaggtccacggtgggtctagaaatgctgtccaggaactaaggcctagatgggggactttaggagcctgcttggtgctttattttactgtggctgagctgtgcccaagttgcaagatgaagtcccctttactcttccctctgctttcctcaagcagaagggatctctccctgtggccaccacagctgggaatgcactgggtcacacctgaagccggtacagtgtgtggcccatgatgagtactgtgtgggtaccactgatgtttaatcaaagcccaaggactctttggtcagcaggtgatgaatgctgccaggactgggtccttcctttcatgacagtgggtttccttctggtccaggctatgtctagaaatgttatctgggagctaggacccggaatgggggcttcaggaatctgcttagtgctttattttactgtggctgagctggtatccaagttgcaagacaaagtcctctttactcttccctctccgcccagagctgtgagctgtgctgcctggggttgggggaagagtggtgcaagcactcccttggctgctccaggtggtgtctcactgggtcatgtgcactccaagtccactgtctgagcccagcacagcaccaggacttgcccagaaattgcagcccttgtggcctagcctctttcagatttacttaggactccaaagtgctttagcccacagaggtagggcttgccagaactcagattctcactggaatggaagattcccctctggctagggctggtctaaatgctccttttatgggtgctggctgaattctgtcctgtgttgctttctgctgtgatgggacagcaccaaattccaatgcaatctcacaatcattgtgctttccctcccccggggtgcacagatgctgtctctctaccatgtggttgctgccaagggatgagggagaggggatgttggagagtcaagacggtctttcctcccctctccggtgcatctttccttgatatgatgtgttaaaaccaggcactgtgatcgttcatctgatttttggttcttatgaagatgctttcttacgtggatagcagttccatttggtgttcctgcagggaagccattgctggaggatcctttttggccatgttgttctgtctccaggtctctcctcctttccttatcctttgtcacaatttcccagtgaatgatcctgcagtgctgcctcccagtgttcattcaatcattcatcaaatattcattaaatgcctcctgtgtgtgatgctgtgtagatactaggggtgcaatggtgaattaaacagacaaggtccctattcccatagagcttatagccagaaggttttgcacatgaaatgtaattggaaaaaaatttcatttcatacaaagaaaccccacccccagcgccagattacctggtaaatatacagctatttagtaatgttaattaaaggactgtagaaaagggacaatgatgtttattgcagcatttttgtaataataaaataatatagtcaaacagtggaatactatgcaccaattaaagtaatgacttagcatgatgtgtatcagtgtggatacatttcaaaaacacagttaaaatgcaggagcatagtaagcatagtattgtagaggacaaagcatattaccatgttataaatgcagaataatacagatacagtataatccactgcaaaagcacaatatagtgtagcattgtgtaaaaggacaatactatgtattgtcatggacacatgcatatatagtaaaagtgaaaaaccattcaaggattgaccacataccaattttaggataatgcttattactctctgaggtaggagggaagattgaggttttaaaaaattcttattaaagtaaaaagattttgcaaatgtgacaacatttaaccattgttaagtctgtttggtgcatgattattatttttggtgcttttctgtgtatttaaaatgtttaacaattaaaaaattgaacagatgaagcgattgtgccgtgccacttttctgcttctgtgtatgtacgtttttgtgtgccttccgccgacattctctatcacatttttgctgtgatagagcatgaatgtgatagagaatctttagagtttcctctaaagaagcattgcagccccaagtatcttatctctaagggaacctgggggtgtgcagattagcctggcttcagggttgttgttcacagctcagcagcagagggcgctgctccatagcagatgtgcggtgggggtggccacaccaggcagctctcttggtgcagggccagtgcctcccagggaagcactgctctcccagggaagcactgctctccccagctgtgggaaagaggaatatttaagtacgtgcagattccctcctgcttgtaggagggggcacagaatccagccatttggaagcatacatcgtgtttctctgactattcacagccttggctgtttctgaggctaagaatgcaagaaacagcacatgccaagggcgtctttgctactatgtccgtgagcctgctgctgacttgtggggagcttttcgtaatgttttattttagattgaagaggttcatgttcaggtttgttacatgggtatattgcatcatggtggggcttggccttctagtgtacagatcactgtgggaatttttttgttgttaactgaccaaggaaccttccttttattttaggtggaaaaggattattcatacctgaaggagatatgtgatcaccaagccgaacagctgagcagaaccagcctaaagctgcaagaaaaagcatcagagagtgatgcagagatcaaagacatgaaagaaaccatatttgaattggaagatcaggtggaacagcaccgggctgtcaagttacacaataatcaactcatcagtgagctagaaagtaagtggggtctgccaggcatggtggctcacacctataatcccagcactttgggaggctgaggcaggaggatcacctgaggtcagaagttcgagacccagcctgaccaacatggtgaaaccctgtctctactaaaaatacaaaattagccgggcgtggtggtgggcgcctgtaatcccagctactcaggaggctgaggcaggagaatcacttgaacgcaggaggcggaggttgcagtgagccgagattgcgccactgcaaaagaaagcaaatgaggtcaagcccaggagaaatgtggaatggagctgagtaggacactaaagaaaccagcagcagtgggtgacgagggggggtgggtttgactgtatgttggctggggtttatgaagtctctcatttgagtgcgctgtaatctcctaggaagaatgtcacctaagaaacaatcattaatctccagtttaaaaactagagattaagagatcaatgatcatagcagttgaaaactgggatgacagaagaacaggctgttgaacatgagtcagcagtgtgtaggtgattgcgaaaaatagaaatgcttttcattttgttttttttaagaagtcttgctctatcaccctggctggagtgcagtggtgcagttgtagctcactgcagcctcaaactcctgggctcaggtgatcctcctggcctctcaaagcactgggattacaggtgtgagccaccgtattgagctgcaaatgttttttggctgtgctggatgtgttttgtgtgagccatgctactgctgctgtctccaggcagcctgatcagcttgaaggccacatgttaggatactttagctgtgactgtgagagttcacagggacccttcctaaggatattttgcagggtaggagaaggttattcagaagaaattgcttgccagtcatcaagtactgacactgtgttatctcttgtatctgacagagatggatgataggtatcagagtggatgaacaatgtgtgctcttggtctaagggagaaaacaattcccgcatgtgtcccattggtggtaggatatcaagtaacttctagatgtttgccacttagttgctgaagagacatcagcatatggcttatttatgaactcatagtttgctttgaattgggaaagaaatttttaaaagagattaaacattaccttctttgtccaaataagccttaccaaattatcacatctaatgtgttttcttttgtaacaaaagatttaatgcacaaagcatttagtcacaccagccattactaagaatagcttggtcagttgcctgagaagttccttaccccatgcagtcgatcctccttattcacagatttcacattggtgaattcatctgcttgataaaacgtattttaaccccaaaaccaatacacagagcacttccacagtcattttcagacatgcacagagaagtgaaaaggttgtgtcatccagtgcttatgttcccaactcgggtcagacagagacacttggccttctcatactgtacatgtgtcttttttacagtctgcttaataccatgcttttaacatttttgtgcttttgtttttggtgactttgctatttaaaatggccctgagtgcagtgctgtccactgtccccaagcacagtgaggttgagacgcacctacagagaaaacacgtgtattagggaagcttcatgcagacgcaagctcttgtcccgttgtgcgtgagttcggtgttattgaatcaacaaagcgcatcaggctaagtgcagtgacctcatccctgtaatctcagcactttgggagactgaggcaggaggatcgattgagcccaggagttcgagaccagcctgggcaacatagtgagaccctgtcttgacaaaaaaataaaataaaataaaaactagccacgtgtggtggcgcatgcctttagtcccagcttctctggaggctgaggtgggaggatcccttgagcctgaaaggctgagactgcagtgaaccaagattgtgccactgcactccagcctgggcaatagagcaagactgcatctctaaaaaaataaaaaaaccaaaccaaacaaaaaagcccaatacggtgcatcagagaaagggagaagtttgacaatatgtatataaggctgccctgagacatgctaaagcgatgtgctaaagcagccaaattcatggatttgtgagatgacagccagttttaaaaagctgtgggcaatattgttgtgtggctgaaaaccaaagcaatatttgttcacatcacccagggtcaggaaaatgttaaccccttcttggctagtgctggttggctcccaagtttcaaaaggccataaagtgtgagaaaggttaaccttgcaggcaggggaggttctgcagatcaggaggctgaagaagaatttaaaaatacttgctaagtgttattcaggaagaggaaaaaaggaaagagtgggtttccatggttgatgagcctggcttgtttatagagacattggcagatacgtctatataatgcaaatggcattttagttgatgagaatgttgtgaccagaggcttgcaggaacctaacctgtatttttcctagagacaatagttcggtgtttgctgatttggtgtgcatggcaactctctgcaactaccatgattattagaattgactatgtatttcagacattgactagttggttagagtgacagttgacagcacctgccccatttctccttgaacatgacatgtagtagaactgcagaacctcagcgttcagtgtcagtgccatccaggctgttctcaggatacaactgaaaacctggacgccatcatcatcagtgtatccttccaaacccagcaccatgattgagaagaaaagtcaagacaagttctgttttgtttttgtttttgtgatattttgctgttgaaaatagggttgtattgtccctaaatccttaaaagtcagcacagacacactaagaaaaccagtgtataattaatgtccacagcaaaatttagacacatgcctgtggttatatcatcatatatccaagactgacaacaatgcaagccatcttttgaaaaacttttaaactttttaaaaggatattgaggtattgttaagatatgtttttgcacagagacctagggacacataaatccagcctagaccaatcacttcttcctataagatcctgatgggaaaggaatggactggaaaataaaaggaagttagggagtgttttctactgtgcagcattgattccagacacaaactctcagtcccactagaactagaactgctggggtaggacctgcccacagcatctttttagcctactctggtgattctgatttgcatccttcatagaaagctaatgctctaggttagagcatgaggacctattgaggaatttcagctcagtgactgacaccatcagatttaaatttgaatgactctgatagccagatggagagaattggaggcaaggagaacaaggggctgcaggtgtccttaagtagggagaggcaggcaaccacctgggaagatgttaaatgcacacatccccgggttctgtctgcccttggagattctgcctccaggtgtctggagtgtgggactagaacatcggtgcttttgaaaagcttcaccagtgatttagaggcttaactgtgattgagacccatgactctagaaagtgctttacaaatcacaggaggaataagcattcatgtgctctgttatgtgaaagcctctatctcacagcaataaaggacacttaggacgattgtgtgtgagtgcgagggaggccggactcggtatgcaagtgtgcatggccatggaggcctcttcccgtagtgctgctatttggttgtgcattctgtctgctgagactgtaacctcaatacacatcacatattttccagatcatcctgttctttatctcagaggaggctcttgtgtccattccctggtttacagggtaaattgaaattgctaaaagttgcatttagagtagaatggatggatttggatgcctgttgtggcatctggagctgcccctttctttgctacctagcgtgtcttctcttaagagtctcacagcttttctaagccctgtctgaattatttatttctaggtagtgtgatcaagctggaggaacagaagtcagacctggagaggcagctgaagactctgaccaagcagatgaaggtgagatgcgggtgggagccttcaccaccatcttcctatgaattacccgctccgaggtgtggatcactctctctatcctgctttctcttggaacgtttccacggcatggtgggccctggaactgtaaattcttgttggcaggaagtaaaatcaaaggagtcatttggtgtcaggatggagaattctcataacctgaaggtgtaattccaccagtgccttttcctagcagtgagccaccgtgtaagcagggcctcaccaagcactgatggcatttttttcttggtgaccaacacggggactctggggtccctgcccaggcactggccctggcaggcgtctgacataaggatgggctctgacattttcaggaggagaccgaggaatggaggcggttccaggcggatctgcagaccgcagtggtggtggccaatgacatcaagtgtgaggcccagcaggagctgcgcaccgtgaagaggaaactgctggaggaggaggagaagaatgcccggttgcagaaggagctgggggatgtgcagggccacggcagggtggtcaccagcagagccgcccctccgtgagtctggtgggcaccagggccgtgcttgcttctcaatcactatgtatggggctccctggtggggatgggactcttcatgtctgtgccaggttctgctatttcctttctgagatcaccctgaattactagcaccaccttaccactaggaacattctgtacagtacccagtccctgccatgctgcagcataagaggctgctaagctcctcacttacatatgaagggccagttctagccaagtatcctgctaggcttaaagaatagaagtcctgtctagaatgctccctgaatcttagtatttattaatgcaggggagtgcacactaataaatacgaatccaccaccttgtacaggtcactcccatgcagtgggagaagctggaatcactcccaaggggaggagccgccggagaaggacacattcctctgggcccaaggatgtgcctgcttattgagaacacccatgagctacgtcaaaaggccttgacataacctattttattaaaaaaggatgagagtagaaaacatgcatttggctgatgtgtgacattcccttctgctcttgatggggagaagcacacagtgtatcagcccagggagctctactaacagtgacatttaagaggaaggtattcccaaagtgaatgcaatgttaattattatctgaaatttagatggtttacagacaaatttataaacagcattttttgctttagctaatattatatttacccaatgaggaatcagtgtccttaactttgagattcttggatattaggaaatgattttgaatttttaggtgtctctcaaatatcaaacatagtctttttagatcaaatttcctgggttttgaatgttgatcaggtggccctagtgtttacatgtttccaagatcagtggctagctcctgagccttttgatctgatgtttggttatcatgaatttcatgacattggaaagaggagatttttcagaattcagctgtgattctcctgtcaattctgctccaagtaattccttatttctttgtttataacttttacataaaatggcctttggggaaggatgaagatcagatatagctagctccacaattcactgttgaaaaatcaatatcgagatcattattttatttagttatttatttttagagatgggggtctcactatgttgcccaggctggactcgaactactgagcccaggagattcttctgcctcagccttctgactaactaggactacacatgcgccagacaaggtcattactttatagacagagctctccctctggacaccaaaggatgtgaattttaagtggaggtagagggagaataggaaaactaggtttcacagtgttccctactgaaacagtagtgaggccgttctgggtggcctctgtgtctgcttttgtttcgtttgcctctgtcttgcttccctattgtctgtcattggaagaaaatccgagtcagaacttgtgttgcttcacatgtacgttattttaatgataaatggtaaaagacaagtcctgagtttctatggtggccctgaataggttcttgtatgagatgctgtgtttcttacgtatactctgagacacaggccaggttcttctatgagatgccatgtttcttatgtatattctgagacacaggccagaccatgcagcgtgaaccctgatattctaggaaatctccgcatacgtcctgccagtttaggactccctatgctgcatcctgcatcttcaatcttaacgtcacgtttttttttaagcacagaatgtttcttttttgattttccagtgatttgcaaacctacctcccaatctaacagtttaatcccttctcaaaaaacatttcaaaattttagaatggacaccaatgagaacatgtcatggtactgaaatcaggcatcagaacgtttctgtctgtcagtgcatttggcaggaagtcagacaagtgccggagatgctggtttcttgtctgattttgcacttctctggcaagctgccccttgtaaagagttgactatatggcagttagttgctggtggttcagccacttccagcacctaccccatgagcaagacttgaaaccaactcacaccctcaaagctccggaagccacctagtgtttccatcttgactgaatgagttcttgattgaaactcagtttgactttgacagtcatctagtgagaactcaaaagtcattcttggttcagccacagccaaagaacttgcagagcattctctgacgaggtcctcaaggacaactgagagaaggtaagatcacccaaaaagcacctggatccagacatgagattacctggttcttaagctctgtttgcgtccgtgggcactcacagggttggttgcagccaggctgataagcacgagatgaagcacctgggcagaaatgcaaaccagcattcattgctggaactcagtaactaaacagtgggatattatctaactcatccatgatcttcggtcctgttacactttcacagatatttttatttcagagtcagaataactgatgttaaggtatgtggggaaggaaggcggtagcctcatctttgcagtcaaccagcaatatctcattcccagtgtcatgtttgcagccaaccagtaacatctcattctcagccctgcctcttgcctctgttaaaagaggtgggaagagggggtcgtttttgaggtctctttaagctctgctgttctctggactggttggttagctgacctttccctggtgggagagtaagaaactccagtgccagccttagagttattctggtgcaatgccttgaacctctttgacacagtggcatctccatatcttagttgtggcttgggagcctgctctttctcttccagaaatgtgaacaagccagtgtgtttttagggacctaaaagtgatctgtttcattggacacatataatgtaatagatgaaaagataataactttttcagctctggctcctcccagttttgaaaactaccaattgagaaaaaggctttgaaatgaaaactctcactgaaatgaacccgtcacatctttttcctgaaaagttgagtcctgggacctggcaaaaacagaaaaaacacaggcagctcaatgtaatgatatattgtgccgcatacaagctttctaatgaaagacatggttcgtgagcagtgcatggcacaggcttctcaagcagcatcagggaaagacctctgtgtttgtggcatttgttcctcttgttctgaaacagcaaatgccattacttttagggtgacttatctgattcttactgtgtctgtcatataacaccaataaacatccatggaaaacgtctttaaaagagataattaaacacacttaatatctgtgcctaattaatgctgttggtttctaaatagaatgtctgtgattcgaatgtgtttcattttgcctataccacaagttcttgcattgtcccctcttggaggtgagcagtgtggcagcgcagcacgtgcagactccactggaattggcttaactccatgtgtgcacatccgtgtcagcctgagtgtcactgtgtgtgcctgtgctgccctctgtgttgctctgatggctctaatgggtcacagccgctcagcatgtgttctccagctaccatggagaggggaggggcggaagttggaggtatagattctttaaggtcccttttccagctgtcttgccacagatgctctgatactgagcccctctcccaggtggaggggggctgttctcctgaggattcttaagcagtttctgaacagacctcaccttagcacccatgacggcatgatggacaggggtctccagcatttaatttggcccttgatgcagaacctggtcctctcaatgtgctcttattccagctagcattatctgttccctcacctagtactctttttttcatagtttaaatgtacatttatgacattagacacacagtctataattctaaagagctgtgtctgcctccctgttctctgacccctgattttacagatttcaacaatgtggacataagcttcccttaggcctttaggatttttaggttgcagttataaaagcaagaaggtttttggccttgacagtagagagaagcatgagcctctgtaaattctggaggggcctatggtgttcatcctggacatctctgcttcaccacacagttctttgctggagaagttctggtggaggagcctagtacaggcatttgcagtctggctttttttttttttttttttatgtctgaaaacctttggcttccaaaaaattggaacagtaggacttaaaatctgttggcctatcctggacattagcttttccctgtgggacagtgtaagctggaaattcttgcgtttgtgaactaagactgtattgccttaggtaactcctttacagcctctccctcccgtttctattttcacagctccctgggctctgtcagctagcagagcatttggtggaagaaagacagcccagctcttgccatgattgggagccgcagccatctctagatgaaagggggaatgtgtagaggagaaattgcctctttataaagagcccagttgtctccttgtgacattctctgtttctcagagtcattgccgtcgagtctctgctttttgtccacattttgggatcagcttactgcatgatcaaagatgatgtttccctctttttacttttcctcagaagattgagctgtcttttatttggagaataaaatgaagttctgaaaaaaacaaagtacaagtcttatgaaaagttatttgcagctggagtgctgaaaagggcacagtggcagagcagatgcagagctgggtacagcgcaggcccgagttcttttgttttttgttgttgttgttgttgttgttttgttttgttttttttttttttttgagacagagtttcactcttgttgcccaggctggagtgcaatggtacgatctcggctcactgcaacctctgcctcccgggttcaagtgattctcttgcctcagccttccaagtagctggaattacaggcgcctgccaccacacccagctaatttttgtattgttagtagagatggggtttcaccgtgttggccaggctgctcttgaactcctgacctcaggtgatccccacctcagcctcccaaagtgctgggattacagacatgagccaccgcacccagaacctaaggcccaagttctactttttggtgttcatttctctgcttccttttgatcgtggtgtctgatcatcttggaattcacattactcaaggcaaaataggaagccatctgcgtgatgtcacattccgaagaagtcagaaggttcggcgagttggagctttactcttgttgcccaggctagagtgcagtggtgcgatcttggctcattgcaagctccgcttcctgggtttaagctattctcctgccttggcctcccaagtagctgggattacaggcatgtgccgtcactcctggctaattttgtatttttagtagagatgcaatttcaccatgttggtcaggctggtctcgaactcctgacctcaagtgatctggccgcctcagcctcccaaagtgctgggattacaggcttgagaccccatgtctggccccttctgtggggtcttgattgagccccttcacttggagtctgacttcattacctcgtctgaaacaaggtgcctccaagctttgggttgatttccagaatcttgttgggttaaacataagtagaagtttgatcataaaggatgttattaagccggataggtaagcacggtgacaatggcaatagaaatctaatggaaaacgattgaatgacaactacaccaaagtttcatggatgaaactcaccccagaaacttagtgttcaaatcagagtgatacacaattcaaaatgtgattttaaacttctggaaatatgtgtgtttgtgaagatccaaatccaattcagcaacctccatcaggcagaaaccttctgcaatcctcacatgaggaactggttcacagtgtacacagcatggagccattagtgacgttatccaaaggatgagacaagacaaaagttactgtctaataaaaggaaaattaggaacaggaatgctctttaaactcaggaagatcttttggggtgtcaaactggacagcacagaatcattagaaaaattagcttggcgtgagaagagacattgaggtcttctctgtaaaatttacttagatacttgtgaataggactgaaatttatattttgggcactctttacctcagattcagagttcttaggattatttaaaattcatttgctggatgttttcaagtataaacaataagaaaactgcaacttcaacttaaaaggcactgctgtatttgcaccctatattttgacctgtcgttaggtactgttgaatatttttatctgtaagcatttatgaagtgcaaaataaacatgttattatatagaagcgtctgctgcttagttttaatcaccagctacgtttctgcagggcctttatgtcgttttgttctacatttttttctgaatacagtttcagaacttcaaagtcacatcaagtaactagaatttgaggtagaaaaaagctggatgtaagttgtaaataggaggttgacatggaatatgaacagtttcattagtagaacaaaagggcatggagtaaaaatgctaattttgcataaatttttaaaactctagggtctcagaaaatatagcatggacttaaagtctagatgtgttttgttgacatttaaatatgaatagattgatgatttaatgtattggattttttcttaattatgaagtattatttaggtatactaataacaaaatggagacgtgtgaagaaaaatattaatctttcttctccctcagtaccacctgtgaggaaatcagtgttaacagtgtgtacatttttctttactcatgaatatgtatagggttcattttcatatttttaataaaaattggattatattcttttcagtactctgcacctttttattttatcatatcataggcatccttccaggtcaatacatagaaatctatcttattttaagagcaacatgaccttccataggaaggatatgtcctggaatattaaaatattgtcttactaatgcacaacaaggttataattttttttttatgagtaatgctataatagcagtccttattcatatagtcctatgtagttgtggttttatttttatagaatgggtttttcaaaatactattgctgctctaaagtatatgcacatttttattttaatagatgtctccaattactcacctgagtgctgtgacatttcactcttgaacatgcccatctgtatacatcctgagcagtagtggagagccttgatcatatttttgccaataggataatcaaaaaatactatcttattagcactttaatttgcatttcgctgagttttttttttttttttttttttttttttttttaaagacagggcctcactctgtcacctaggctggagtgcagtggtacagtcatggctcactgcagcctcaacctcctggacttgagcagtcctcccaccccagcctcctgagtagctgggactacaggggcacaccaccatgtccagctaattttttttttttttttttttttttttttttttggtagacacgaggtctcactgtgttgcacagagagactggtatcgaactcctgggctcaagtgatcctcccaactcagcctcccaaagtgcagggattacagccatgagccaccatgcccagccctttctaagcacatctttgtatgtttactaaccactgcattttctcttctaagaattactagttttgcaacttttccctgctttttcactgagctgattgtttttttctcatcagcttataagtcagtattttattagggatacggttgtatcccctatattatgagcctttatcatatttttcatgtgatatggctttatctttatcatagaaaattttatatttttatgtaaactgttagtgttttcctttactcttttttttaagattccttctccccagtattatacaaatgtgctattaaatgtcttcatctacttgatgcacacacatatgcaggccatttgatccacctctctttatttaatctgatgtgaggtgtggttctttttctcccactgggtagcactgtttattaccagagtcatcctttgtccactgaattgaaatcccacctttacatggtttatgtcatccacattcagagagacctgccctagatgtgctcccatttctttctcttttgagttagctctgctttaaaatattcatagattattagattgcttatattacttttaactcatcctttcatttaaaatttttattttattgaattttaaggcagacagtatcagtgttgaactctgtttccagtcatgaatttacaaacgccagtcctctcttgagtgcagtttccccttcactttgtattatgaactgtttgcatcgagcagggcatgattttgcctgtcaccttctcttgctgaagcagatccaggtgtggcagggcctgacgtttgccccaggtccgtgtctgaattctgctcagatccactgcctttgcctgacagtgcttctgatcttcttctcatgacttaaacgtgttgggaggctcttgaaggtacatttgtattacatacttggaggtacagaagcccaggtagagtagagaagggtgagtgcctagttgggaaattcacctgtacccagtttcttctctgcctggtgagcctggaacgcagagccagctctctggatctctttgcgtgcccctcatccattttaggtgcacactgtggctcttcctatcctgccccttgtcactactgccctttatgcctagggtaaaccaaccttggccttctcggatgtaaattcttcttgttcctgatcctttgccaaaacgccgtgcatctctctgggcttctcatgctcctctccagccttggccctctagggtgggggacattagttggggttttcccatatctccattttctttggaagggaattgagggaaagcccttggtattgtattttcattcccccgaccgtgtactctctattagcagaaattcttcagaatctaagccacgtcaatgatactcgactacaggacttttactatttgattcttattgttgggatttgtagattatgatgctggtgttcaaattactttcttatcctgtttgtttttattgttatatatgcttttactgaaatttgaaagtgaaatttagaagatattgtttgacacctaagagacaaagtacttcataatttctgtcttcaaatagagtgaaaaacttctgttagatttgttttatgcaaaataagtatttagaaaaaattacattccaggcaagggcatagaatgagcaaaggcacagaggcagggcataaaagtaaaaaacttcaggtgaatagtccaaaactagatgggcagaggggagtcttgggagattaactgaaagacctggggttgggctttgttcaggtgttcagtaaagagaccggcaggcgtgagcatgtggttgacatgcgacccgccctcttcacaaatattaatctgccaattgtgaaggtagcagtggtgccatacaacactacccaaatggagttaacctttgaatactttaaaaatcatcatgtacaggagctcacctgttcctggatcagaatgaacaatgacataaagtgctgtttttaggaagtaaatgctgtagaccatgactgacatttgaaaactctgttctctaacataacaaggaaagcagcaaattagagaggttaaataaaagttttaaagggaaataattagagacatgtatgtatatgtgcttaaatgacaaggtgaggcatggaaggcagaccgacattcagtgaggagggccatgtgccttgctgtgctccatggagacactgtctgcttatggagtgtgcatcacctgctgtgtgtgacacagcatcaggcggtctggcctgcaactgttgttctctagtatctggcctgcaactgttgttctctagtatgggttgccgccttttaagagcagattattgtataaagataggaacactgaaataacttggtagtattttttaaatgtacttaaaatttaggaagaaataccatcagtattatttctagaaccttgtatatctctcacagaacatttatgcattatagaaaatttgagaaatgcgtggccagagctggatttgcaccccagtttcaccattcatgaatcatgtgaccatggtcaaattttcctctaaaataagggataataatatctagttttgttgaaaattaaattagataatgcttttaagacacatggtactgtgcttggcatatacagtggagttatacacattcatatttgttttgctgaaattatcgattattatcccagttttatatgctgggagcaggtagaatacttgcttcatttttgttgttttaagcatggcccctaaacactaagcacctatttaatgtgtgatgtaactgaagaaagagccaatcatgaaatgctggagggaatgcaagtatgtgagacttctggagagttggtgtgtttgtaaacagtcatgtttacaaaagcatgtacttttgagtgactcaaattattttcatggtttatttgactacatgtgtgattattactttgcaggttgattttagaacctaacatcagccttagaggcagtagcaagccttgaacaagtgtttctccagtagtggtaccttgcagtttttcttttatttaatgctaagacatacctggctgtatacttacatatttcttaatattcattatagaatacagagtttttattcttccttggaacagaggaaatgtaagacttcatttatggctgaggctgttactaattgatcccagccaattctaaaataggctggtgtaaggattttcagcctcatttatgatttaagtacatactaataagccaatagcattcttaataaccattttctttggttattcaattcaggctatgttttgtgaatccctctcacatacacagagagacacacagacacacacacacataccactgttacataacacagtgggtatttctcttctcaaattatacagggttttctcatactgactcttattgttctggccaagtagacttagtgtttgaaataccatctttggatacctgaagcctgaggtaattgattcttgtggccttgctttttaaatttatcatttgatattttgaattgcagataaatttagataactgaaaggaataacctcagcagaatgtaggcgtctccattttgttcttattaaattatcaaagaatgaaatgtaaaatgaattatttaaaatgattgtccttgggggcctttggtactgagtcatttaaatggactggtaagaaggtggccaggcgcagtggctcatgcctgtaatcctggcactttgggaggccaaggcaggcagattgtctgagctcaggaggttgagaccagcctgggcaacatggcgaaaccccatctctactaaaaaaaaaaaatacgaaagattagcaaagtgtgctggtgcttgcctgtagtcccagcaagctacgcaggaggctgaggcattagaatcgcttgaacctgggaggtagaggttgcagtgagccaagatcacaccactgcactccagcctgggcgacagagcgagactctgtctcagaacaaaaaaaaggtggcccattttgtttgttgatgaccttcatgagaatggctagcacagaccgaggaaattattttctgctcaaacctaacctgatttctttttctttctgcatttttgccacctgattttattgtatgggaaagtatgaaaaccagttcctctcaataaaattatttaaaaattattttaaaaacccaacctcctacaatttctgaagtgcctgataatttcttccaatgaagttttcagtttactgattttttttttcactcataagaagggactgtggagtgaagattgtaaggcagtgtggtttaactgttttaagttctgtttctcttaaatttattctattcatgttatttacagagcaacagaagaaagcttagagaattaaagacaaattcaactggagaagcttatgagtagtagctagattaatttgaaaatgatcagtaaataactattttatttactgatttattttaaacttccaccgaccttattgaaatatacttccagaaacattctgtttgaactattatcataaattagtcatcttgcaaaacagctgtggcaatatgatacaatgaagagagcagtgatttagcaatgagaaggttgggagttcttgtcttggctccttcacagggagatcacatgacatgccaaagtcccctatatgaggaagccatgcattgagaggattgaggattgggtcaatgatctatcatagaatgctttctatgagtctagaagcctcatgaagaacacaccaggaaacttgggtgagagcaggagcttcacctcatgcagaattgcagtgtgattttagagtgctgttaccattcttatgcttagaagtcagagtgtctgaatcaggattctgttgtgtataatggattgcactctcgttggcttaggcagaaaggtgttaaatggtttgcagaattgttgggaaggctgagcttccaggagcagctcccaaagtctccacacacaactggaccaccagggaacctgctccctccaccaggacaggagccttaacttcagaaagctgcccacccagttggaaagctgccaccacagttgccagcaccatagcatcttgtctctgctacagtctctgtctacatagtgaatgcccggtgccctgcctctcttcctctgattcaggtcccactccaggtcttgcccaagtctttctgattggtggaacttaaatcacacccaaaatcccagctgtaggagagctgtgagatttcatctttccaaactctgtgtactgcatgggggttggagcacatgtcggcagccggtccactgcattcaccattgacagtaggtgaaatatttatggtcaataacatttgcattttttcacaaaaaatgcacaatttgcagagtagccatacacactttttatttagagctaatatcaagtcactctacatataaaaataattatttctgaccatttcccaagaaaacagctcttctaaaaattgagagcaatgcctacattatttcctaaagatgcaaactggtagagaaaacaggatgttaaattcagaatttcccttccagcttcatttattttctccacatcagttctgttttcctctgtgtctttttctcccatggggatgtcctccatcttttcaatctgatttgctctttgccatgcagacctgtggatgaagagccagagtcctctgaggtcgatgctgctggtcggtggcctggtgtctgtgttagcagaacatctccaacacccccagagtcggcaaccaccgttaagtcacttatcaagtcatttgacttgggacgcccaggtatttaatcattttttctataagcaaagctccaaattcaaactttggcccgacatttgatatgtctactatctctactccaccctggccctgtgttgttacaaccacaagggcgctttccaggtcctaccacgtgcagccactgcatgcaggagcctggctgaggctccagggaggcactgatggagagcctggctcatgaataacacaaatgcagcctcttcctctctaccgcttccttccatccagttcctgccttgctacctttcttttctgcctctcatagccattaaattcaggtcactactatttgcctttttgtcatctcatgagaattatgagggtcagctggagacttcatctcctaggaaacgagacatcacatctctgcacctggccctcttggaggcacccctggccatccccatcttgcaacctgctagacgtttttctacctggtcttgtacgtgagcacctgtgctaatctgtcactcctgatctaggtgtgttcccagcttttcctggtgttgtctgatggtctcacaattcccctttagtcatgcttatcttcctatatgagaaagatgcgtagctatacttcatacatatactgtacacataaacatagcaaatagaagaaacagaatgtgcatctgtctacagtaacaatatctttcttccccagagtgcaacaaacatgccattgtattgggagactgtagtaaaagttaatcctaggatgtacctggttgtctctgctaaaattgtttgcacctaaattagattaagactagactctacatattcaaagacatgaaagcctttcatgtctgtgaagacaggaaatgaattaacaatttgtacaagaacttttctgttccttccttctctaggcatctcattatttatacagtttctttttgctcagctatccttcatctaagactgacctccactcagctaaatcttcccttcttgtttccccaaagcagctctagtccggagaagaaaaggataatagagtaaatattacactaaacacggatactccttaagccaccaaaaaaagtaacaagaaatcaggaacaagtatatgctattttgaagtggaacaacatataaatgttcccatgttttttcttggcaggtggagctggacagaatatttctgtccataagacccccagaagtcccctaagtgggataccagtgaggactgctccagcagctgctgtctctccaatgcaggtagatgagccccagaaataaccactgcttatggtttgctgtgtatccctctagatgtttttctttacacatattagtgtccgtgtgtgtatgtgtgtgtgtagagtatgtgttttgtaaattggattgcactatgcattattccaatacttatttcactttatcatcggaatgtaagcttcatgaggtcagatatttttgttcattttgcttgctgttttatctcttgtctgtaacactggttggcacatggtcacattatagtagaagttcaataaatattaaatgaatgaaggaatatgttttcaaattttaatatttgcagaaacgattctttttataaaagattacataatatgtggtgatttatttagccactgttctactgatagaagttaggtttttttggatttaacttattacaaaaaataatacagtgaagatactgatacaaatttttgaccacttaaggggctactttttaaataagggtatatcaagattcatttgtaagtatcagagatgactgtagttaagcagaaaggaatttaatacagggattttggtactgagggctggagaaaggtctaggctgcactgagcttccaggaaaggttcccagagcatctgaaagttggcccattaaaggagcttctgtttctgccagaatcgggaagtctttctctaagtgcttacccaggactgccactgctaccaagatctaggatcagcctggtgactacactgccacaggtgcagtccatgccagaaaagcacactctgtgcctgccccatactgaccagaaaacggtggaacagaccccagaacctctgctcccctgccacagaacagcgaatgccttcccagccatgtttaccaggagaagctgcagaagggaagccttacactcccttgcaccttccagatcctctgagaaggggcctgtttgacagaagctaggccacttgatgagccaagctttaaaggagtttgccaagtacaccctttagcttcccagtcccttatagttcaataagtcgccctacaaggagatgaggatggagttgagtgagcccgtcttgagatcttctacaaattgattcctagtgaaggaaaatggagtcctagaaaaggaaatgtatttgacctgttccagcatgtcgaaaaacttgatagacacattgcccttcagtttgccctcccgcttacagtactattttccaagaattttgacactgtctataatttttgaagatcaagtaagtgaacaataatatcttgttttactttatcagtaaggtggagcacttcttcgtatgattataggccatttatctcttgtgtgtcggtgtggaaacttacatactttgcctgcttttcttttgaagtgttagtctgtttatgttttgtaagaagtattgatatattgtgctttttaacattttttcatatgtaattgtattaccttttttatcttttaatgtcatattaatagttatcttttactgaagagaaattttacatgtttgtgttgtgttttaagattttgttttgtttcctgccttaaaatgtcttttctagctattagatgattaaaatattctccctaaatatcttaaggaagtcttttatttcttcagtcttaaaacccatagaaacatgggtttggatttagatattcttcccctatcttaactgccttctggaagcagaagtaaatactctctggaggacaattacaccatctagatccttaaattatagccacattttaaaaaatacaacgttatatagtaactttaaacaataccaggcatggccaggtgcagtggctcatgcctgtaatcctagcattttgggaggccgaagcaggcagatcacgaggtcaggagttcgagaccagggtggccgacatagtgaaaccccgtctctactaaaaatacaaaaatcaactgggcatggtggtgtgtgcctgttgtcccagccactcaggaggctgaggcaggagaatcacttgaactcaggaggcagaggttgtggtaagctgagatcgcgccactgcattccagcctgggcaacagagcaagactccatcttaaaataaaataaaataaaacaaaaaaccaggcatacaaatagataataccaaatgatgaaaagccaagagaaaaaatagacaatagaaacagacacggaagattcagatattgatattattagacatagaccctaaaacaactgagattaatgctgtcaacaaaataagtgacaaggtagagaatttcagcagaaaaccacaatgtataaaaaagaatctgttagagattttatgacttaaaaataaaatacctgaattaaagactcaataaagtttagctgtagcttaaacagtttaagagaggcttaaagaactgaagacaagtcagtataaatatctgaactgaagcacagagaaaaaggataggaaatagagaaaaggacataagaaacatatgggatggaataaaaaaatctcatgtgtaattggagtccccaaaaggggagaaaaagagcagaagtgatattggaagggataatgatcaagaatttccaaaactgataaaagatgtcaagcccagattcaagaaacaataagaaccccaagtgagataagtacaaagaaaaccacccagacacatgaggttaaaactgctggaaatgaaagagaaagcatcctaaaagcacccaaaagaaaaaagatacctcaatgtccaaggaggaagagcaaaactgacatctttcttctcaagaagaatgatggaagccctgaagacaatgcagtggcatctgcaaaatgctgaaagaaaacacctgctttcctttacctcatgaaaatatgcttcaaagtgctgtacctggtgaaaatacccttcaaaggtgaacacaaaagaaagatgctttgagtccaacaaaaccagatgttttttcctaggatacttgcagtgaaaagactatttaaaggagttctgcatggagtttgttcttttaaaagactattaaaattcaaaacatctgacaagaaaagctaatgcaaaattacctgtatcaggaatttgtaaatgggtacatcactaaagatttcataattattaaagcaatagtaagagaatattatatattactactttgtgctataaattagaaaatattgatgaaatggtcaaaatcttagaaaaatgtaacgtgctaaacttacataggagagagtagtagaaaatctcaatcacctataatttatatcttttccttaaaagaaatgccagggccttatggcttcaccatgaaacctcccaaacatttaaggaagaaataatgtcaatcttacgtaaattcagagactaggaaagaggtcagcatagctttgatccctaatagttgcaagaacattaatagacaagaaaattaaaaggtctttctcacgaacctctttgcaaaaatcctgaacaaaatcttggaaaaccttattcagagacacatgaaaaagatcatgtcatgttgggtttattccaggaatggaaggtggttaatattgaagccaaccagagtaattcaccacattaacaaaggtataaaaagaatatggttggccaggtacaatggcttatgcctgtaatcccagcactttgggaggccaaggtaggtggatcactggaggccaggagttcaagaccactctggtcaccatggcgaaaccccatctctactaaaaatacaaaaattagctgggcgtggtggtgcacgcctgtaacccccagctacttgggaggctgaggcacaagaatggcttaaatccaggaggcggaggttgcagtcacctgagatcattgccattccactcctgggcgacagagtaagactctatctcaaaaaaaaaaaaaaaaagcatatggtcatcttagtaggtggtggcaggaaaatgtagtcgataaagattaatatctttcttgatggaaattcttagaaaagtaggaatagaagggaaagtctttaatctgataaagggtctgtattatatatctacagcaaacatcatacttaatggtgaaatatcggatgctttcccacaggattgtgaatgggataggaatgccccatattgtcacttttgttcagccaacttcaaaagcaagatttaaaactacttttgaaaactgtataccacgaccattatatttttgtgggatgtggatacatggaattgtgtttaatatgctatgaagtagagcctctaagagaaaataatgttctggaaagcctcagaatggccctgcacaggcaaatgtaccaggttgttcattgcagcattgttcctaatatcaatatcaacatgaatatcaatagagaatcagtaaaataaattatggtaatgaaaatagctaagatctactgaatgcttactatctgctgggctgtgttttgattgttctaactggatttaactcatttaatcctcccataaccctttgaggtaagtacgtttagtatcgttgccattttataaataaagaaaataaggcacagaaaattaagtaacccagagtctcacaggtgggtggtgccatctgtccccagagccacttacttggcctcttgtggcacttctcagaggaagctgccaagatggtgggtgatggtgggtatagaatgacttctaagatacagtaagtgaaagaagcaaaatggtgtacaaaacaatataatgctatgataacagttgtgtttttagaaaaacagagggtgtttttcaaggtttttccttgaataatatcatgcttacttgcattctgaaatgcttttttaaatggcagtaaaaaaaatacaccatgaaatctactctattaacaaatttttaagtattgttaactagaagcacaatattgtatggcaggtctctagaaaaatttttttttaaatttttaattttatttcagattcagggtgtacatgtacagatttgttacatggatatattgtgggatgctgaggtttggggtatgattgatcccatcacccaagtagtgagcatagtacccaacaggttttcagtgcttgcctccccctcctctagcactccccagtgtctcttgttgccatctttctgtcctctagaactttgttatcttgcctgactgaaactctgtatccacggaacaattccccacttcccctccctgaggcctctgggagccaccactccactgtctgcttctgtgattttgactactttagattcctcacgtacatagagttatgccgctcttgtccttcagtgactggtgtatttgacttagcataatgtctccaaaactcatttatgttgtagcatgggacaggatttccttcttttttaaggctgaataatattccattgtatattctataccacattttcttcgtccattcatctggtggtggacactggggttgcttccacgtcttggctgttgtgaattatgctgcaatgagcaagagagtgcaagtatctctttgagatcctgttttcaattttcttggataaatacctagaagtggtgttgctggatcatttggtagtactatttctaattttttgaggaacctccatactgttctgcgtaatggctgcaccattgtacattcccactaacagtacacaggagtttcattttctctacctcctcaccaatacttgttctttttcagttttttttttttgatgatggtcttcctaataaatgtgaggtggcgtgtcactgtggttttggtttgcatttccctgatgattagtgatgttgagcatcttttcatatacctattaaccattaaaaatagaatacttatacacacatccttgaatatacatagaacattccaggaaagatattcacaaagccaattaataatgattgcccttggagagaagaactgggagatgggaaggaaaaggagactttctcttcattatttgcccttttcattgcttttggggatagtgtctattgcatgtattacctattcaaataaatgagttaattaaaaactcccctggttattccactgtgtttaagaactgttgcacacacacgcatgcacacacacacatctgtgtttgtgctattcttgatgttatgagctcaccgtgctggtgtccccctggtttttacagaggcattcgacttacagcagtgtgcggccagccagcagaggggtgactcaacgcttggaccttcctgaccttcccctctcaggtaaattatgtcaacataaagaacttttgacttatctttccgtgcagttaacttttcttcatttctctgcatgaaactgagcttagaaaaataatcagtggcatttcttgcaagtgatttcaaccccgaataatgtacatatcatgaatgttagatgcagcagtgcagctgacaaaaggaaaaagtgtctcctgccagctgcacttctcagtgcccttgtgctggggagacaggcccaattttttttttcttttccttttttcagagacatggtcttgctttgtttcccaggctggtctcaaactcctggtctcaagtgatcctcctgcctcggcctcccacagtgctgggattataggtgtgagccactgtgcctggcatattgttttttaactgaacctcaagagcatattttctaatctttaaaaagtaactaagggaaaaaatcttacctgattttgaatttgtctgctacttctgcaattcttaaaatttgcccctttaaaggtatttgtcttttggtgcagtcctcttcctgttgttacaccgtgtgtgtgtgtgtgtgtgtgtgtgtgtgtgtgtgtgtgtgtatttgttttttgttttaactccaatcctggttgtaaagtggaggttgcattcagcagtcccagcagtccccatccatcacatttgcgtggcgtcatatttcctgtgtcacaggctgatgtgaagcagccctcaagaagggacacgtgggcttgagtctcagtactgctgctcagcctggctttggccccatcaccccacttctctgtgctttagtctcctcatctctaaaacggaaataatccggtccacttcctaggattgtatcaaggattgagttagcacattaaagcgccttgaacatgctgggtgtgtggcaagcactgtggaagtgtttactgtgcacatctcacctgctgttctctgctgacccagttcgcctgcccagaactaaagggacaacagtgctcaagcctagtgggaagttaaggttgtccagaatacggggcttagaacctatgtatgtgtctatgtggtgactgttaggaaataaaaaaggcaaaaagaacactgaatggactgtttactggtccctgtagaagggatagaaagccaaaagtctgggtcacatggacagaaatccttttgtttctaagcataaaataaaatttctacagctgtacttcctttagatcttggtcaaacacaatcaggcttgttcttaaaatagttgtttctatgagggaactttcccctctgaatcttctttgctttttcatggaattaaataaggattttagagttgggtaaacactgacaattgagaatttgaagatgatctgagcccattcctcgagttttacatgggagagattcaagccctacagaaattgagtgacttataaaggctacagcgattttggatggctgtggggccaggaagtctcctgattctttctaccatgtgcctcttggtgctgaggctggtgattgctcgagtaatagctttctaaagtggtgaaagtttacgtgggactccaagtcatgatagtgacttcccagcagaaggaaatgaagaccaaaggccagtgtaaagtcaagagtgtaagaacaaacagagttcagtggaggtagagaaatgagagagtacgtgctccaggagaccaggcctgagtgtcccatactaggaggggagtggaggagaccagagcacagcaggaagcccacttggctcaccatctccgtgcttgctgtgtagcacaaaagagggaataatttgatgacacgcatagtgctaggtgtggggtttttgaaaaattgtggtaaaagacacataatataaaatttaccttatcaaccatttttaagtgaactaggtaagcctttggtagataatatttgttcttctctctgttccactagccttaaagttttctattgtgtagagacaccattctttctggttttctttgagagagagtcttgctgtcacacaggcaggagtgcagtggcattatcatagctcactacagcctcaaacatctggcctcaaatgatcctcctgcttcagccttcaagtggctgggactagaggtgcatgtcaccatgcctggctaattacaaaaattttgtggggggatagagacagggtctcactaagttgcccaggctggtcttgaactcctggcctcaagcaatcctcttgccttggcctcccaaagcgctgggattacagttatgagccatcatgcctggccaagaaaccattcttttttttttttgagatgcagtcttgctctgtcacccaggctggagtgcagtggcgtgagctcggctcactgcaatctctgcctcccaggttcacaccattctcctgcctcagcctcccgagtagctgggactacaggcgcctgccaccatgcccggctaattttttgtatttttagtagagatggggtttcaccgtgttagccaggatggtctcgatctcctgacctcgtaatccacccacctcggcctcccaaagtgctgggattacaggcatgagccactgcacccggccaaaaccattcttttagttgacacggtacatactgaacttgagaccacaatagcttattgctctgcagttaatatctcattgacagccctccctacttagcccccaccaggcacctgtctgcttggatgattatatttactgttattacagcaaaggattacagtgacaattacttgcttctagcaatccccaggaattgcttgtcaacactgaggtcattggaagctgcagaaaccaaagattaatgtgctgttcttgttgttcccttggatgtaaatactgtttttctctgctatttagagctgactagcctcactcccaactttactgcccctaattggtggcagtgagctgtggaaggattactttcttctgtgactattcacaggtcatgggcggcaactgtgggctcatcctggtccctggtctgctctgtagcttagaacaaggcacttagttctctgagctccagtttcctctataaatataaactagacagtctcgaaagatgtctcctgttccgcacttttatggtcctttgagaaatatagtctggctagacatggtggtgcactttcctgtagtcccagctacttgggaggctgagacagaggatcattaggaggtcaagtccaaatccagcctgggcaacacggcaagaccctgtctctagaagagaaaaagaaaaacaagtatcatctggaggattcagttcatttcattacctgttttttgactcagactaatatgacagcagaaaggagccttgaaagagtgattcctacttcttgtttagcaagccaggccctatggctagaatggccttttctcttgtcaagtagttcttcttggttcccagcttcttgtttattgctgcctgtggtctgatcatcacttgaggcattttcctgccactctctctcagatgtctgtcagttaaaacaaaagatactacctggggacagggctggcttcgttggcacttgcacaaggcccttagaaggacacatgcttggtgtaatgctctgatgacatcatcttgaaattcacagtgatttttgagcaggaggttgatttggtgctagatgctgtaaatgatgtagtggtcctgcctgtagaatccacatccctattgcatttttattacttcagaaactatatatatgtttgcacttgaggataaaatgagaactgtattgtatttgagaatgaagtatgatggcagtcaagagctgcttctttgggaatgagtgattatgtggttgttcccacagatattctaaagggaaggactgagaccctgaagccagacccccacctccgcaagagtccctcactagagtcactgagcagacccccgtctctgggctttggggacacaagactgctgagtgcttccacccgggcatggaaaccacaaagcaaactcaggtatcgtgtttcaaacaataagaaatcagaaaaacatcgggctaatcaccttttattcttccttccgttttgtccccgtggccaatttacttctacaaatatttcctgcatgaaaatgactaagacactgtgcctgcccttggtgagtctaaaaggatgacagtggatagtagtagtgcgcaaaatggaattaagggctgtaaaaaacaatactgcataagcaaagtcttgagaggttgttagttggatcaagaagtctagagagaagtggtgtttctgccaagggctctaaaggtaccattacaagcacgctgtggaatagtgatcagggaatgtgggtggtgtcatgtgtctgaactagtctgtgggcttcctgagagccgggactctgctgtacatatgcataacaagctctctgtcagtatttgttgggtggatggataagtgactaggacattccatctggagggcatattgtaagtagtcttcattgctaaggaagaggtttgtgcattattttggtaaagcactggagtaccaccaagtttgtgggattttgtttcggattttgaggttgtacagtgagattggacctgcattttaaggaggattcatcagaaaacagtggtatataaggattgaagaggcattttgaaatcagtgtttaagaaggactgtcacagggatgtaaaggaatggttggcagagggagaggatggcaagaccagcagggtggtcactaagagcttgtctttgttcccacacctctgtcacctcctccctttccagtgcccctggtcgcccaggccacagcaaacctctttcagctgcttcctctccccttgtgacttccctgcttctctgtgttggttaattttctgatgcactgagcacatcctgctgcagaccttgcagaaatctcacatgactctgtcatctgcactcctcatcctggtcttctagatgccccacaacttagcaccaccccacccacctgccagaatggccctgttcctccctccacctgagcctgttttagtttctgcctttgtaatagaacatgaccatgtctgattgcaagtctttatgtataaggttctagcctgaatcgtttttcttttctcctttcatactccaaatactgcttctccttcaaggtcaaacctttcatgaagttgtacctaacacctggcacattgacatatcccttctctgactttggcgtcttacacttttttgggtgtttagtttttgtactgctttgtagtgtggaacactgttgcacagtacatgccattgtctccatttatgctataatttagttgacagtaaaagttcaacttacattttggtatctcttccagccccttgcattgtgcaacacacatagcatttcacttagtaaaacttacgagtgagtagatggattaatatacaaaattggctagtttaggagtaatagctttttaataaatcttataatcacaaatatgggtattatagaaggatttataaaagtctgaataaattcaggtcttgttacacctttgggtacagcatatatttggacccaaatagatgaagtcatgtgtttcagaagtttaatgtaaagccccagatactacatattgtcctgtttatgtgcaagagatttaaataatcaaaagaggttttaaggaccagaattagtgctgttctgaagttgccgttttctttatgccagaaatgcatacaaaaaggctatatgtatatgaatatgctattgatattttaccttttttaatgaaaagttaaattagtaaaattcttatttcaattttacacttacgttattgacataaacaatggcaagatatttggtgtttttaatatgcccttccaatgcacctttaaaatttattttattttattttttggagatggggtcttgctctgttgcccgggctgtagtgaagtggcacagtcatagtgcactacaaccctgaactcctggcctcaagcagtcctcccttctcagcctcctgagtagctgggattagagatgcacaccaccatgcccagctaatttttttattttttatttttttaaagatggggtctcgctatgttgcccaggctggtcttgaactcttgggctcaagagatcttcttcccttggctcgtaaagttctgggattatagatgtgggccactgcacccagccaatctaccttttacatgttatttaggtactggtttagtcttgaaacatgtagggtgtgttttgtttacgtatctttaattcaaatgatactgtacttaagtaaacaaatgaaagactagatggatgagcaacaaatggatttgaaaacaaaatgtaacaaaactctccccaaatttatgatagtcaggaagcacaatttaatttttattttatactgtgagatatcacaaaatagtaatgtgactaattcggctgtttctttagaatcttgctggataaactagacttttgcttttctaaagtaggtatttatttcttgtgtatttgagaattctaagtattagcatcttctccttaccatgtgctcttctttctaaccagtgtggaaagaaaagaccctctggcagccttggcccgggaatacggtggttccaagcgcaatgctctactgaaatggtgccagaagaagacacaaggttatgcggtaagggacaacatcagccaacttccagctgcccctgggcagtagtagtcctgtgccaatacatgttccttgtgtgcctgtgcttgatgggccaatatgcatgtaattgtcatctttctattctcctaggcagggctgccagggaatgtttgatatttgtgcactgcccaaaggcaccgtgacagaggcaaatgcaactgaaaaacggtctgcactccacccaccaaatgtatggctgcacgcagagctgcacctcccgagggaaggggacctttttctttggtcagagtgttactggccacaggttcttgggctgtcaatgcgatagaaattgtcatgaggccaaaagagttttctcaacaaggctttattggagcttatgcccttatccctcaggcatgagggaggaagcacgggagagggaggattctctggctgactccttgaaatgagctggtagggatttttttattaagcaaagtgcaggaattgatatcaacatagagaatgtgggctgggctgggtagatcatatgaggggtaggggatgtgggtcagtttatctgctggcgacggttgtcttgagtcatgggccacctagtgttctggttggtggcagcaaggctgtaaatcagttgtttagcattcttccctgagatgaggacatttgcaactttggttggatatgttggatttcctagggccagtttctggaattatttaagtaaaagaattaaacattcttttattcttttaaacattatgagagtgcggaaaaacagtatggctattttctttgcatgactgttaagcaggtatgtcagtgaagtagtggtgtgggttttgtgatcagtgggaatgcatgaaagaatgctatagtggggatgagctgaagccaagtcctgtccctgctgtctcagaagaagacacaagctccagtggctcacgcctgtaatcctagcactttgggaggccgaggtgggcagatcacgaggtcaggagatcgagaccatcctggctaacacagtgaaaccccatctctactaaaaatacaaaaaattagccgggcgtggtggcgggcgcctgtagtcacagctactcgggaggctgaggcaggagaatggtgtgaacccgggaggcgaagcttgcagtgagccaagattgcgccactgcactccaggctgggcgacagagcaagactccgtctcaaaaaaaaaaaaaaaaaaaaagcagacacaagctccccgagcagtgatgcctccacccaagaagacagcttttgctgaattaccctcctgaagaagagtgctttgcctaattcgcataaaggtcctatgtagttgggcctccaaaacttctccaaacattttgtttctattgttttgagaattgtttgcgtttagtttaagagtttttgttttctaggacagtatctgttttctgtgaatatcagaaaagggaagtaatacctgatgtaagtttaagtttttttcttgtgaaatacacaaagataaaatgcacaaaatataaatcataatttcttgaactgtgaggaagtgaaaagtcatgcagtcaccactcccatccagaagaggagcatcaccagctcccacagacccttcctatgactttcccatcatagccctcagtactccctaagataaccattgtcctcaattctccttccagatttttacaaaagtatgcatccgtaagtactatgttagtattgcttgcatttgaattttattacaaatggaataaaaaactatgtaatatttgcagctagctttttttacacggtattgagtcagtgagatttatcctcattgttgcatatagctgtaatttgttcattttcttcaccatttagtaacccattgtaggattataccattatttatccattcgattattgatggagagttgagtcatttctagtttggagctattatgaataacgctgttatgttcttgtgcgtatttcctgaaaaacatatgtgctcattcctgctggatacatgcttaagaatggaattcctgggccatagggtatgcatacaatctagtggatagtgccaaacagatgactgaagtaattgtataatttatgtctctccagcaatttatgagagatttatttctctgcattcacatcaacacttggtattgtcagtctttttactcaaggtcatgtgggtaatgtgtagtactgtctcactgtggttttggtttgcattttcctgttggctggggaggctgaacaccttttcatatgcaaatagataccctctttaaaattggcaattcctactgcattcttaacaatattttgctaaaatttcggaagattccagcaccgtaatactcccttcccaggctgaagcttttgagggaggtggggatggaaaatgaaagaagctagcaagaaaaacccagcctcagccaagatccatcccagatagtaaattagcagggctgggagtctctgtcatgtcagcagtcagatgtcttaaaaccagaatctacccagagtatgtgtatcctgtatctttgccattaccttcttttcactttatgttaaaaaagaaaaagaatcgcagcactttgagaggccgagggggcaggattgtttgcgcccaggagtttgaggctgcagtgagctgagatagcaccactgtagtgcagtgtgggtcagaaaaaagaaaagaaaaacctgtcatgctactgaccaataatagaggctcccaaagtataaactcgcctcagacccttgtttattcttcctgctaccctgtccactctgcctctgccctgtttcaaggatggaccatgccatgaaggaaggcctcttggttacagcctcccccagcccatcagccacgctgccgaggacacgggaaagaataagaagccataagaaccaatagctatgacttcttattctttcctgtgtccttggcagcgtgactgatgggctggggaggctgtaaccaaggggccttccttcatggcagttgaacaatgtgaacacttggacacaggaaggggaacatcacacacgggggcctgttgtggggtggggggaggggggaaggatagcattaggagatatacctaatgtaaatgatgagttaatgggtgcagcacaccaacatggcacatatatacatatgtaacaaacctgcacattgtgcagatgtaccatagaacttaaagtataataaaaatatattaaaagaaaataaataaatatcaagaaggagaaagaaaaaaaaagaataagaagtcagagggaggcagctgcctgcaggaggtttagcgtaaagaaaataggaatggtgatgggaaattgaagaaaacatttaaaaagagctgtcattcaagaatgactccactgatgccgcctgtgctgttccccacctgacagtaatggaccaaggcagctgccagagtgcatatgaaaagacaattcacgttttcagaaggagtggccttctatgatgtaaccttgttgtaatgcagggaagagacagacaataagatgtttccagtcaggatcacaagaacactatttcctgctggagtgatttgtgtgtgtgtgtgtgtgtgtgaacattttggattcgttttcaaaacattttacgtttgatgaaacccaaaactcattttgcctgtagtacttttcattcatcatgaaatctctgtaaaattagaaatatgaccatgtgtctgctttatttacccttcacaaaatatgtctagacctgtttgtctgagacacctcatagtcttgttctctcagaattaggaagccaaaaataactggtgaaaactttttgaaaaccgggaaccatgtgtacttgacttaaaataactttccttttatttcatcaaaatacagcgtgaaaggttatgttacatccctccatatatatatatttttatttcagctttagttatagattcagggggtgagtgggcaggtttgttacaagggtatattgcttgatgctgaggcttgagttatgggtcccgtcacccaggtagtaagcatagtactctgtaggtaggttttcaactcaggccttcttcccttcctcccttgtctagtagtccccagtatctattgttgccatccatgtggctttttttggagacggattttttttttttttttttttttttttttttttgagacagagtctcactctgtcacccagtctggggtgcagtggcacaatctcaggtcactgcaacttccacctcccaggttctagcaattctcctgccttagcctcccaagtagctgggactacaggtgcaccccaccacacctggctaatttttgtatttttagtagagacagggtttcgccatgttggctaggctggtctcgaactcctgacctcaggtgatccgcccaccttgacctcccaaagtgctgggattacaggttcacacctgtaatatacataaagggctactggatacatatacataaaaagggccactgcacctggccctttatatccatatgtactcaacgtttagctcccacttataagtgagatgtggtatttggttttctgttcctgcgttagtttgcttagaatagtggcctccagctgcatccatgtttttgttcttttatatggacatgatttttgttcttttttatggctgtgtatttccatggtgtatatttaccacattttctttatccaacccactgttggtgggtacttaggttgattttatgttttttctactgtgaacagtgctgcaatgaacatacgagtggtagaacgacttatttttctttgggtatatacctagtcatgggattgctgggtcaaatgttctatttttagtaccttgagaaatctccaaactgctttccacaggggctgaactaattttattcccaccagcagtgtataagcatttctttttctccatggcctcgctagcgtctgctattttttggctttttaataatagcctcctggctagtgttagatggtatctcattgtggttttgattcgtatttctttgaagattagggatgttgagcgtgttttcatgtttattgaatgtatatatgtcttcttttgagaggtgactgttcatttcctttgcctattttttaatggggttatttggtttttgcttgtggatttaagttcttatagattctggatattagatgcatagtttgtgaatatttcttcccattctatgggttgtctgttaactctgttgatagcttcttttgctgtgaaggaactctttagtttagttagattccacttgtcaattttttattttgctgcacttgcttttggggacttagccaaaaattctttgctaaggccaatgttgaaaaagttatttcctaggttttcttctaggatttttatagttcgaagtcttatatttaaatctgtaatccattttaagttaatttttatatgtagtgacaggtagaggtctagtttctatcttctgcgtatggtcagccagtcatcccagcagcatttgctgaatagggaattctcttcccattgcttgtttttgtcaaagatcagatgattataggtttgcagctctatttctggatactctaacttgtgtatgtgtctgtttttataccagtgccatgctgttttggttactgtagccttagaatataacatgaactcaggcaatgcgagtctccagctttgatcttcttacttaagattgctttggctattcagactctgttttggttccatatgaattttagaatagttttttctaattctttgaaaaatgacatttgtagtttgataggaataccattgaatctgtaaagtgctttgggcagtatagccatttgaatgatactgatttttccaatccatgagcatggaatgtttctccatttatttgtgtcatagctggtttctttcagcctccttccatatattgttcagctccaggtaatattgtaggtgctgggggccgggcgcggtgactcacgcctgtaatcccagcactttgggaggctgaggcgggtggatcacaaggtcgggagatcgacaccatcctggctaacatggtgaaaccccgtctctactaaaaaatacaaaaaattagccgggcgtggtggcacgcacctgtggtcccagctgctcgggaggctgaggtaggggaatggcgtgaacccgggaggcggagcttgcggtgagccgagatagcgccactgcactccagcctgggcgacagagcaagactccgtctcaaaaaatatatatatatattgtaggtcctggggattccacagtgaatgaaacaggcaacagtccctgctctcatggaacttaaatcctcatggggtctggcagttaactgaaataaaaggtaacatatgtacggtatttgaaggttgtattgccgtggagagaaataaagcagggaaggagggttgggaatgttgggtgaatggtacaatttatacatagtggtcagggagatgacatttgagcacttgctcccctctcttgaagggctttggtgtctgcatgaagctttatttcccaccaaggcctaggtgtggagggtcagagtaaggaggtcattactgtcgttactgtgccaatagaagctgaagtgacacacggtggtcgacccaggtcagcagcactgggaagtgagcatcgcagccagacccacctgccgagctccgggccaactgcctgacatctcgagtggcccaggattgagacccagtgaaaggatgtgagtttgccctcactacgaagtgaggcccagttcactaagctcaaaatggcgctcctaggaggcccttcctcacattctgctcaactcatacacactggtgtctttttggaataagtcactcctggaaaggccctctaaattactctcagtcctcaaatttcatactcctgatgtgtgttggctgttttccaagccaagggcaggcctgactcagataactcctacccctccctttctttcatctgaaagtctagtttaagctcctagttttctgttacgatggagagatttccatttgtaatttccagtaagaattctgaagggacagaaagtcgggagggtaggtgtgacaggaagaattctgaagataacccccatgactctccatggtagaatgtcctcctctttatatgacacagggagatggtctggatatgcccactaatcacaaacccctgtagaagccaagtgatgtctctggcttgtggcagaagttggggaaattcaaagcatgagaaggactctgattgttcttggtggtttgaagagggagggggcacgtgagaaggagccaagaagggccccctggctggcagccagcaggaaacagggactttctagcactaaagcattagtgctgaggtcctggccgtgcccagaaattgccatgtgggtgctctggagttttgaggttgacaactgcaagttgtgtgtagtgccaccgggtcctttgtctcctcctctgtcctgatgccctcagacctcagccaggccagggacgctcagtttgctttgccttctgctttccctcagctgggggatcttgggctggaagtcactctgatgaacatgtggaattcagctctaagtctctcctgagtcctctgttacctcccaggaggcatgatgaggcacagctacccttcacctccatgggtggcatgaagatacttgcaagtatcttttagacgaaaatatataccggtatttactgttacttgaattcctgtttggttcttgcatttcagatcaaaagaaagaagagtttagatagggatttacttgaaaatgtatctgtatctgttccacttttgaaattgtatggcaagaattcagatagcaggcgacacctacactatcattaagggacagatgacgtctttgaaccaggttttaacctgttagctcagacctatatcttcttctcttttggagaaaaaaaaatcagtctttgtgtgtccacactgaattttgctttgaatctggaaagaacacccatgttgcaggcaacttctgttgttctgtctctgagttcccacaaacaagcactaaaatctgcttagccaatagcaagcagcctctaaaatatcaggtcacttggggctctgtttcttatattcttttttgagacagatctcttgaaggctacacgcacaattcaaagaacataaagcctttgatttatttactgccatcagagtggtcctttccctgacttagatgatagagtctcaatagcagatgcgcggcactgtgggcttccactctattgaggccttttctacccactttctctgcttctgtaccgtttctgacacagtggtctgtgaagacattttcagtggcacaggtgttgtcctacaacctgtgacaacagtggagtttgtttgcaaaataaagatgcaaggctttcccatgttgtgggagacacagtcctctcctggtggccgtgtttctggttggttttctctcacgagccagtgtgctgtggggcacccgctcccactcccactctcagtggtgtgtgcatgcccagaggtatgaaacttcaaggaataaaagtggctttctgaacaaaaatatcaaagtgtgtagagacctgtcagactgttcgcacagcagatggggagggacacgttctcccaccttagtctgcacaaacaccgaagaagcagccctgacaagtctaagctgggcacatccccaattccttgggaattttggaaataaaactgagaaagattactctaaaatataaagcccagatgctattggcagccatgtttttgcctctgtgcaaaaaagacttaacccagtaggcctgggacggctctctttagcaaggctgcttgcaaggctggcccttggctggcgtctgggaactgggattacaggagggttcccattgtttccagaactgatgagaggggctcacggtgctgaaactgtttgtgcaaacacatggtatgtgctgaacagcagctttcctttggggagtctggaatgtagtatgtgctgggcagaaggggctggatgctgagtccctagtgagcttccctggttggcagcattttttcttgagatggggtttcagtcttgttgcccaggctggagtgcaatggcaccatctcggctcaccacaacctccgctcccgggttcaagattctcctgcctcagtctcccgagtagctgggattacaggcatgtgccaccacacccagctggtctcaaactcccgacctcaggtgatctgcctgcttcggcctcccaaagtgctgggattacaggtgtgagcccctgcacccggccggttggcagcatttcacacgtgttgtcatggcttgttgccaggggaattaaacatgtccgtgactgctggagagaattcttggaagcacgtgcctggtttcctcgggacttcctgccctgtgccttttccctttgctgatctggctttgtgtcctttcgcagtaataaatctgtgaatagccgtggccatgactccatgctgcgtcctgtgggtccttcccctgatcattgaacacgggctttttattgagccttaaaaaggagtaaggcactgacacaggctgcagtatgaatgttccctgaagacgtgttgccaggtgaaagagctgggtgcaaaatctacatcttgtatgagtccatttataagaaatatccagaataggcaaattcacagaaacagaaagcagatgagcggttgccagaggctgaggagagagggcaatagggactggagtggctgcttagtgggtacagggttttctgttgggtgatgaaaatgttctggaactaggtagtggtgatggttgcacaacattgggaatgtgctaaaagccactgaactatacactttaaactggtttaaaatggtgaaagtgatacattaattttaccttaattttttttaaaaaaaacagtgttatgaacagacacgatagctcatgcctgtaatccagacactttgaggggccaaggcaggaggactgctgagaccaggagttcaacaccagcctgggcaacatagcaaggccctgtctttaccaaaaaaaaaaaaaaaaaaaaaaaaaaaaaaaaaacattagccggctacgatggtgtacacctgtgattccagctattcaggaggctgaagacagagacttacttgagcccagaagttcaaggcctccgtgagctatgatcacaccactgcactccagcctgggcaacagagagagaccctgtctctggggaaaaaaaaaaaaagtgtgccatgatgatgaatatcacttaccatgcatttttatgcttatgctaaatagttgtgaaatagtgccaaatttttgtaaagtaagttcctagaagtgaatttgtttttgcaaaagggtgtgttacactttccattttaatatatattctcaaattgccttcattaaggttatttagtttacacttctctatacagtgtacaagattatacattcccaatactggatacacctactcttttgatctttttcagcctaagaggagaaaatggcatttcttttaatttttcattgcagatgaaggagaagcactttttatcaacttgttagttatttatatctttcttctgtgaattactactacagttgctttgcttgcttttctatttgtatgttcatcttttttcctcaaaatttgtgatagctctttttggttttcttttggtttttatttttatcaaagctctgcatgcccacaatcaggtatgcagagatcctgatgagcaaagcagtcagccggcctgagagctctgcttcctgctccccagagtcaagcattttcaagtcaccttgctgattttttttttgtcatttacctctacgttgctgactagcacgtttatcaactgctatttctagtttttcattttagatgttgtattttgatctcctactgtgaaagatgagggtttatttctttttcactcccaccccccccatgcttcctgtctttgcattctttcatggttgtacatatctggagttcacattaagatgctgtgagtgtcattcatagattagccatgtagtagtatacactgctgcagctttttcttttacacaacctgttacttgccttacacttaaaatcgtcttgtttttgtctgtttacttagttttgtatgtaaatgatactcattcaaccgcaactcttcatgagatatccccacacatcacaagggtcaggggttgcagctgtgttatcctgaggagatctctctggagcctctgacctcttccatcatggctgccctctatgcctggtgcacagagtccctgttagttctttgcctctctcttttttgatcttctgtatcctacatcctattcttttttttcccctttgtttttttttccctttgtttttttttcccttcagtatctccctgagaatgagttcatagatggtaaaattttatgacctcgcatctttgttttaccctgatgcttgatggtttctttaggtataagattttaggtcagaaattattttcattcataattttgtgggcatcgctccattgtcttctatttgccagtgttgcagcaagaaaagaatgattacagtcgtttgtgatttttttttcctctgcaaaagctcataggaggttctggttgtctccaggattctaaaatttcagggtgatgtgccttgctctatagcttaagttttgtgttttctatcatgctaggcactcactgcaccctttcaatatgtaattcatgactttattttctggaattatttcattggtaatttcttctactctgttttctttttctggaaatccccctggcctggccctctaattatcatattctttttttcccctatttctatctctttgcattacagttttgttttctgggaggcttccctaactttaatcttccaaattctattaaatgcttaattttgcatttttttttttgcttttgcatcatttcaattgttttttaattgtgaaatgtacataggataaaatttaccatcttaactatttttaaatgtacagttcagtatcgttgagtatgttctcattattgtgtaaccaatctctagaatgttttcattttgcaaaacttaaattctatacccattaaacactaatctgacattcccctcttcccccagcctctggcagcagccattctactttgtatcactatgaatttaaccactttaggtaccccatataaacggaatcatacagtatttgtccttttgtgtctggcatatttcacttagcatgatgtcctcaaggttcatccatgttatagcatgtgtcaaaatttccttcctttttaagactgaataaaattccgttgattatatttgctatcatatttttaacttctaggatttcttttttattccctgaaattttttatagcatcctgttcttgtttcacagatacaatgttacatatgaatttcactgaggattgtaggttgattttatcaccaaatctctctatgcagattgtttcctacagtccctttattccattggtatctttaggtctctatctttatgctggaggtttgactgctcatgtttaggtggaggctctgcaaagctgaccccctccctggcctgcgtatgaggcctgcgactatgttcctgtggcatatccatgacgaacttctggtgtcagtgtctttaggtggtccttcctcttgggcacatccattctccagagaaaggccttctagtctcctgctggaggacatcaacctggcaaccagaattgtgggacctaatcagaaaagaggcctgtgggccaggcacagtggctcacccctgtagtcccagcactttgggaggccgaggtgggtggattgcttgaggccaggagttcaagaccaggctggccaacatggtgaaacctcatctctactaaaaacattagtggggcatggtggtgcacgcctgtagtcccaactgcttgggaggctgaggcatgagagtctcttgaacctgggaggcggaggcgagatcgtgccactgcattccagcctgggtgacacagcgagactctgtcaaaaaaaaaaaaagaagaggcctgggggtggagagtgactacctcagccctcaccatgtaaattcacttaattcccttgttttcactgcatcactcatgcctccactgctcactgtcctctgggtgtgcacagaagagagaacgtttggagctttggctgctctataaacagatctccaacccattcttcctgtttttaaccaccttcattcccccacctgaagcacctcttgccaccaatttcctgtgtctttgagggattttgcaccataaatcaggttgggtctttgcccttcgccactgctggcctgggatttagtttgcttcggtctgttatgttagttatctcttgtccattgacttttcagctgccaatgttttgtctttttgctttctttcatgttccctttttccttgtctgttaatgcctttggaggaaaaattcctttctgtggttttctggggcttcacgagggggtgagattgtgaatgcatgcgtttcattgccatcagcctggaggcctcagagagctttattcctttctccttaaggatattaaccattatctgtcatagaggttccaagtaccctttacatatatactatattatatacaaatacacacacccttttgttccttctggagtgcatttgtgtttgttaggtcaagttttatttttcccccagatggatggctatttatttcagcatcacttatttcatcatctctcttgaactaactgataggcctaggtatgaatgggaactgagtggtgtctggacttgctgttcccttctgtgcctctgtgggtctggcctctgccacaggttgctgccgagcagagaaatgagagcaggacctgagtgcggcacagcgccctgggcctcagccagggtcctgtgagtgtcagtcagtgctgtggcatgcgttgttttgatgaatttaatgccctggcatttttcattatttgattatacttgttggttttctaggtaaactattacacataacaatagttttgtttcctttttttcttttttcttttttttttttttttttgagaggtagtctcaaaaaagtctcggctcactgcaatctccgcctcccaggttcaagtgattctcctgcctcagcctccctagtagctgggattacaagcacgtgccaccacacctggctaattttttgtgtttttagtagagacgaggtttcaccacattagccaggatggtcttgatctcctgaccttgtgatccacctgccttggcttcccaaagtgctaggattacacacatgagccactgtgcccagccttgtttcttctaatatttatacctcttgtactttttttggtttattgcattcatgaaagtccaggtcactgttgaataatgctattgatggtggatattcttgttttattttctgttcgtaataacagaaataagatttaataatattattaaataatttaataataatttaataatcacctaaatgagattcttgtattgttttgtgataaatactctatcaactaaaggaagcttgcatctgttttgagcttaccgggggatgttttaagtccagaaataggtaagaattatatcaaattcctttttagcttttaatgagctatccatatggtttcttctcttttgacccatttatgtaattaataacataaatacatttactagtaggggaacatttgtacatatctgggggcaaaattccaacttggtcatggtatactattcctgaaggaaactctacttgattgtggttattctttaatgtgaaatatacgattttttatactcagttattgatgagacatttggcttcttgttggttgctttggtataaatgaagttttgtctcaataaggcctgtttttgtttttgttatgatgttagtgagctctaaaaccctgtatcatctgtatatagtaaaaagtgcaataggtatttattttaccaccttctgtagtaggattaatgacagaattaattcttagccaaagagaatgttttatactctagttgcaaagttctgtccagtctgacaaatgaaaacctgaaaaccccaaaaatgttgttgggtagaagttgggaaacctttcatttaagcttcagacaatttttgtgaaaagtataagagtgaagacttaacatttttcctggaactgatgctcttttgttttgatgaaagtcctctgaaaggacttgttagttgcatagaggtaaggctaggcccctgcctattctcagggctcaaggcctgagcagccgaaggcccatcagtggtcccagttacctcagtgggagctcaagtgtcccctgtccccatgtggccacttgatctgctggattctgagtcaggtgtgttgaaatctcttactctgactgtggtttgtgtcaaaagctttgattgctgagagattatgttccagatattttgaaccatacgtaaaggtttcttgttctatcttcttggtggtttttaccttttacttcagttaatccttttgatctagaagcttacattttatataccaatattgctatttccatttatgttttctgtgcattttatgttttgcatttatgttatttgcatgatatatctttgtactttctttcctttcttctctttttttcccccagagttggagtcttgctctgttgcccaggctagagtgtagtggcacaatcatagctcactgcagcctccacctcctgggctcaagcaatcctcttttcttagcctcctaagtagctgggtctacaggtacatgacaccacacctggctaattctttaaaaaatttttttagagacagggtgttgctatgttgcccaggctgattttgaactcctgggctgaagagatcctcccacattagtctccccacttagctgggattacaagtgtggagccactttgcccagctcctttattttcagcctttcttagttggttgtttcagggttatgtcttataaatagtttggctttacatgtaatctgaaaattcctctaacagggcagcttagcctgttcacattttcttgtggctgtatgtgttttatcttcttcctctgtctcactttctatttttagtagacttctcttgctggcttccttcttactgattcccaggcacctagcagcgtggtaaggtgtgtgagttgaagaggtggaaaaacccaggcctgagactctgaggggtaaccacagtggaataatcataaagtttaaagctagagtctgtttttgttaaactggagcagaatcataaatcaaacacattttaaaaaatgcagagctacagagccggctgcattagtgagaaacagccccgtcggcccctttggggtcagaagtcagaattggaggcagggcctgggcccagttgctcttgccagggctgctttctggggtagaatggaggaagagccatgggcaagggccaagtccactggccactgtcaccaggggagcagcccgaagtcagggccgtacctgggaacaagaaggactccaaagacctggagcagatctggagcactgtgagttggaggagtcgggctcggatagcagcctgcaagggtgagggtgctgagaaagcaagatggacagagagggacagatgtggcccattcagggatccagaccagtgtctcatggcatctgatgtctagtcaccagcatgcatggggacatgcctggacacttgggctgatgcttctgcatgactgagcctcacggtagcagggtgcccctggacagaaacaaccacatgaccaagcagaactccttagcagccatttaaaaggataactggaaactctccaacctaattgggtaagatggcttaccaatttgctaagtagggcatatgcttaaagtactttttaaactttttttttaaaatgatgctgctaaatgaaagtatgtttaatttcacagggaggatctgtttttgccaaatgaagttcacttagctccttttattggtgctttggggaagagggggtgtggtctgtccctttagccttatagttcttgatctggtttttctttttttcttttttattgtaaaatacacataacatgaaatttatcattttaactattttaagtgtacagttcaggggcatgaagcacgttcacatggttgtgcaaccatcactgctttctatttccgaaatgttttcatcatcccaaactgagctctgtatgctttaaacacggggtaggggactccatattccccgccctcagcgcctaaccaccgttccgcttcgtctctgaatttacccattctagccaccttgtagacgtggacttacacagaatgtgccctttgatgaggggctgatttcactcagcacagcgtcctcaggcccacttatgttgtggcgtgtgtcagccacgctgcttctgcatccatctgtccaccttctcctctccatagtccccaccccatcctgggtcaggagttgtgatttttccttgtgtcttccagaaccaaagctgggagatcgcctgctaccatggcttgaaaacccttaacgactctgcagccagcagagttggacccatattcctggcctgtgtgaaagaccggctttttttaatgggactatttagctgtattatttgtcctcccttttctcagaggtatggaacatagctcccctccccaccctcaccacacctacctgaaaaacgggaagattagatccaccatgtccttaaggaaaagaagagagtgttttgattgccaacaatttgggctccaggcttctgtaagtcatcaaggtccatattggagaattagaagcaagagggtaacagaggcagaggataagagcagaggcttaggttgagggagagcagaggccagcgcccttggatgtggtggccgggggctgagaggtggaactgggaagactggaaactcagccaccctacaggctaagggcccacatcctccctcttctgacctgccaaattcctacaacatgcaggagaaagtgagggaactaataaggtgagcttattaatctggttaaaggttcttggctgggcacagtagctcacacctgtaatgtcaacactttggaaggttgatgcaggaagatcacttgagtatagaagtttgaggctgcagtgagctatgattgtgtcactgcattccagcctgggtgacagagtgagaccctgtctctctctctctctctctctttttttttttaaaggttcttaccatgagttagcctcgtcttctgacttcccagggtcatttgaaggaagcatctgcatcaaaactgccaatttacactttaaaattttttatataaatgttagatgttttgccagcttcaggaaggaaaaacaggattttcaaaataaaatgttataagaatgtgtcatcctcctggggactgagggtgatttaagtcccttggtcttctttcctcccatgggctgtttgtccccagctgagggcctccatgggtcaagtatgccagcagctgctgctgcagcataacactgcccaacaccaaagccatcatcttgtcaccattcagaaaaaggaggccttgatttttgctgctgttccttctccatcccccaggacagcatgtgagtctatttagataatcacagtcccaggtgaatctgcactgagcattttttccattctcttactcgtgaaatgttcatttgggaaaaagaagtaatttcatggcaagacacttatgatttcacaggctgaattcagtctttctgagggtagaaggttaacggagttgaaggttacttttctttctttttttttttttcttttttttttttttctgagatggagtttctcccttgttgcccaggctggagtgcaatggtgcgatctcagctcactgcaacctctgccccctgggttcaagcgattctcctgcctcagcctcccgagtagctgggattgcaggcatgcgccaccatgcccggctaattttgtatttttagtagagaaagggtttctccatgttggtcaggctgatcttgaactcccgacctcaggtgatccgcctgccttggcctcccaaagtgttgggattacaggtatgagccaccgcgcccagccttgaaggttacttttctagtataaactaaacttgatcttggaacaaaattccttataatcaatttttcagttattgcatattattttcttagtacaattctaattctgctgactacagagtcagaaagggtttaaaaaccatggtgacaggtggtctcccagccagagctgtggttttggaagacatgaggaagaccacaactcctgaactaggatgggggttgggatatggagaggagaaggtggacagatggatgcagaagcagagtggctgacacacgctgcaacacagatgggtctgaggatgcttcagtgagtgaaatcagcccatcaccaaagggcacgtgctgtgtggtggaggaacatagtcgcatgtgtgttgttgggaggtggagtttaaggtggaagaacctctttgagggcaatttggcagaatccatcaaaatggattccacctgtgtgcagagaggtgcatgggaggacaattatcgcagtactgtttgtgataacagaaaactggaaacaacctaaacgggctgctgtctccatccatgtgatggacctgcatgtgtcgtcagagaacaaagtagcgaatggtgatggaagtaaagctagcagtgacaaaatatttaccacgtgaccgacattgtctaagtgcatctaatcttgaccacaatctcatgagttaggcattttgtatccattttacaaatacaaaactaaggcagcaagaggctccatgactgctcagagtcacaccctagtaagggatagagctgggactgaactcctgctgttgggcccagcatccagtcccttggtctctacactgaaactgttcatccagatgtcgtgaaggacctagctctatatatcttggtaagggtgcagaacatgccaccatctgcataaaagggggaaatacacatgcatgtttgcataagtgcaagacagcactgtcctgtagaaccctctgtgatgatgggaatgttctatatctgtgctggccaatcctgtagccacaggtggctgctgagcacttaaaagattcctaatgtgactgagaaatggaattttgatattatttaattttaactaatttaaacagccacatggggctggtggctgtcgtatggggcaatgcaaggtagaatatagacagatggatgttaaagaaaagatcaccggattttgtggtttgcaatccctacttttaaaaaaccttctgcagaagcatcattggaagaacgggtttcataactgtttatttcagaaccactaatttaatctagccacttcatttgagagatgaggaaacttaaggcagaaaagttgagtcactttcctaaagtcatattcagctgcgttagtgtgaggaggaaggagcgggtcacagtttggtttggtttgttcctctttagagcatcggacattctcgtttgccaggggcttcattcaatctgatgtcagctcagttcttagcatggccggtcggttcctggaaatggcggctttgggtgaaaccatgtgctgtaagccatgggaactcaactctggcccatgtcaattagcctgcggtgaaactggttttgttatacagcgtgtcaccatttcacttaatgttacagtgtccaagaacctcccaacattaagtgaggacttactataaaagaaagaaagaaccagacttttgtctcctgggctcccagaactccatgaggaatcttgcagtggctcgccctttcctgaagccccagagttcatcctgcctcctgcacaccccaggctcaggctgtcctgcctgcctgcaccacagcatgggtgaaccatggtaggaccatgcttccctgcggtgtactcctcagcgcctcacacatggagggctttggaaatgtttgtgtggactctactcccagcctcgagggctgaaccgctagtgagttgtgcagatggctcatgaggagatttctccaacatttccttgagggagctgctggacacaggtaaacactcagcaaggagcagaatggggcttcagggggctgctagtccactgagcctgggtgactccaggaggagaggagccagcagagctatgcatgaccatgaccttttttagaagcagcaagcaaggaggaagagtggaattaatgaaaatgaggtagccaacttaacagaaaggcagaagaggaaagaaaattccagggaagtgtttccccagaggcctgagcatggtcctaggggtcagaagatggcagggaatcatctgggatccgaggtgagggcacagagaagacctgttctcaggacgccaaggaagaactgggaggcccctgctgagccgcggggcttcgcctgcgttcgggtgctgtgtgaggctagcactgccagtggaactgctgttgggctggaggaagtggacccagccagggggcaggaggtgttggccgcaggcccatgcttgcaaggcaaccagaccctgtgtcacaatgccaaagccagttaacctcggggaagaaacgccgtgggtggggacttctgagtgtttgtcaagtgaaaatggaggaagcaagaaagacagggccccagctgctcctgagatgtgtatcttctgtgattctgtctccagggagggactgtgcagcatctgcctgaacatctctgggacacagccgtcctctcgccataggaaggctcttgtccacagaggagtaaagggaagggcgctgcttcctgcaccagctcaccgtggccgctgtctccattttcgcagtctcaaaccctcggtgctttcagtgtggataaaagagtgggaggaacatttaaaaagtgaattattccaaattagtctctaaatttaatgcaattccgattaaaatcccaacagactttctttattcttgaacttaacaaagtaattaaaaattcacctggaagaataagcaactaagaagagccaaaaaagtttagagaaagagtgctgatgaaagtgggttgccctgcctgactggaaaggtgcaatgaagccacggcagaggagacccccttcacacgtcattctgcccaccgtagcgttgcagaagcaaagacacagtggaaacagccatgagcatggcccctgcagctcatgtttcagaatagtaatgacactgacttgaacgggttgaggaggtctgcatttttttaaatcttaaaagataagtagaagttgtcagatttgatttgggagataatgagccatataaaatctaaagtagaaaaataaataattggctgggtgcgtgcagtggctcacgcctgtaatcccagcactttcagaggctgaggcaggaggattgcttgacctcgggagttcaagaccagcctgggcaacatagtgagaccccatctctaagaaaagatgaaaaaaaaaattagccaggcatggtggcttccacctgtagtcccagctactctggaggctgaggtgggaggatcacttgagcacaggagattgaggctacagtgagccctgatcacactattgcactccaacctgggcagcagagccagaccctatcttagaaaaacaaacaaacaaaaaagattaaagcaataatatgaacaggagcagaaatggaaaggcattccaaggaatcccagagttattccatgagggacaaaaggtagctttccgctgccagagatgtgacttgccctttgcagcaaatataaaagaagtcacttcaggcattctgattgtctgtagctgtagagcaaaccaccccgaaacagtggattacaataacatcttcattaaccttatgaattaaatgtctttaatttttgccagtttgatgagtgaaaatgatattttaccgtttttattttctggtgagactgaacatcttttcatacatttcagactatttgtatttcctcttcagtacattacaggttcatttctctgccaatttttacttgagttgtttgtctttttctttgagacagagtcttgctctgtcaccctggctggagtgtagtggcacgatcttggctcacctcaacctctgcctcctgagctcaagcagtcctcccacctcagcctcccaagtagctgggactacagctgcatgccaccacatttggctaatttttgtatttttttggtagagatgaggtttcgccatgtttcccagactgttctcaaacccctggcctcgagcgatccacttgcctcaacctctcaaagtgctaggattataggcatgagctaccatgtctgtcctctttcttattgattacaggaatatattttgagtattagtcgtttgctatacatatattggttttaattttgtcatatagaaactttctttaagtcagatttcttaatcctttcctttatactttttgcattttgtgccttagatggctttctttccccaggattataagcctattcttctatatttttctttttataatgttataattttggtttttaagcttagccatctggaactcatctctaggaaacaagcgatgcgagactaatccctgggagaagggaaactcctgcagtgatggccagctcaccagctctctgcctgggaacaatatccacttcccagtgcagggagctggcctctgagcagagcacagcagccccactggctgaggaggcggtgatcagagaggggcagccaaagctgcacattttatggaatggggcatcagaaaggaggatgctgtgaagatagggggcccaggagtctatgtgcaggtctccacaagtcatggccaagggttgtgctgtccgtgtgcaggacgaggccactcgaggtttaccagatagtctgagatcagaacagaggtactaaaactggatgtgtgtgtacacttgtcccaggcaaggaccgaacactgaatgcacggcagggaaggagcacaggctgcatttgctgagatttcacatgaaatgttatgtgtgcatttgctttgtatcctctctgaccagaccttcaaagtaagtgtgatcctccctgggcttttattgcacatgctgagctccagtgaggaatgagctgcttttatcctctgtgatctgtaaactgttaaactttccaaaaactaaaaactcaatctgattccacagctgtgataataaagaccaattgggaaaaccccagagagattcagggagtgagactgtttagatcaccatgagcctgagacagctggttcctgcaagaatgaatgtacagcattttctaatcagtctcctgcctttttcccaagaagctttgcttttttctttttgacttttgcagttagtgtacacagagtcagttcattcacagacacctcatggaggcacctggaggtccttggtgaaggtaaagaagtactgggaatgcagccacggaatccagctgtgtcctcgattgaatttagcacagtacacaattcagtgtgtaccctgcagcttgtccccccagtgattgatgttttttaccaaatgttaataaccaaggcaaggcaagtaaccaggcaaccaaggcaagcgaaagcatcttctagaagcaaatgcgcaggctgtgtggttttgctttgccctgtcctgctgcgttattcatgagtgctgtctctacattcccccgtctgcaactttagtacaacctcaacactctgggaagatattcttggatatgcactaaaattagatttttaccttcccatgtgtaattcaatgtcttcatttttctcaaatgacttttgcttcattgaggtggacaaaattctgtatcttactttttttttttcctaaaccctcctagagacctataaccagttttggagatggttggactgttacccttttattaaacatctaagactttcatcaaaaagttccatattccactcagaaatattgctaaagtatttatatcctgggaaaagttaatttgtaattagtaactagcatttccctgggtaaaaataatcagcaagtttctttctgtttttgctccactttttcctccccaaaaatcttgtacataaattccaaatgttagtgttcagagtggacaccacactctagccccttaagacaatcagggtccttccctccttgtttccttcttccctccccctccctgtcctccctccttctctctccccttccctccctccctttctttcttccttccttcctttttttttttttgatagggtctcgctctaccacccaggttggagtgaagtgatttgatcatggctcactgcagccccagtctccccaggctcaagtgattctcctgcctcagccttcccagtagctgggattataggcatgcactatcatgcctggctaatttttacattttttgtagagacagggtcccgccatgttgcccaggctagtcttgagctcttgggcttaagcacctcctgcctcggcctcccaaagtgctgggatttgtgagccatcgcacatgacctcctttttaattgaggtataacatacacatgtgcatgggggatgctcacgaggtgacccaggtctagaaagcacagcattcagccccccagaatcctcttcatgttcccctggttaccagcttccactcaaggataacaatgatcctagtccgttttattcagggatgaatatcaaggaaaataccagaaggtaacagcctacagaatgcctgctgggctgcttttcattttcttctcatggttcttttgatgaacctctgagtctcagatgagtggtccttgggaaaagaccttaccatactaacatccctggggtggtctgtgtttcttcttagttttggctgcttctgtgagcattgaggactgtcgcgcagcagctcagccagatttcacccctctctactttaaggcctgtgccagctctagtcatcccctcgccaaaaatgagacttttcacctccatccaggggtaggtcctggagtgagttctcagcttgctccctggggtgcctaggacttgcccggccacccatgtcccacaaactgctgtttttctgcctggtgcccagtatattggccctgcccacacgagtaccttgctgccatggcttccttgacctctctggtcactgcagtgggactggatcttaacccacctacctgggacccacagaccttgcctagctcctggctgcccagggctggatgcttttccagtccaggaaaccagcccccaagagactggtgaatgatggcatgatcccatcgctgctgcctgcctcttccctccaacccccacgaactggcccccagggcccaggctgcaggagctcctggaaactgtgctagccccaagaaagtcctggctcctggaggactgatccccttgcactccttaggccatcggctgccgtcagcagcctcccctgcctcccctgggctctgctgatgagggtgcaacacactgcatagctcatagcctctgtacgtggtctgcaagggaacagtaatttaaatgacatggctttggccgggcgcgggtgctcacgcctgtaatcccagcactttgggaggccgaggcgggtggatcatgaggtcaggatatcgagaccatcctggctaacaaggtgaaaccccgtctctacgaaaaatacaaaaaattagccgggcgcggtggcgggcgcctgtagtcccagctactcgggaggctgaggcaggagaatggcgtgaacccgggaagcggagcttgcagtgagccgagattgcgccactgcagtccgcagtccggcctgggcgacagagcgagactccgtctcaaaaaaaaaaaaaaaaaaaaaaaaaaaaaaaatgacatggctttgaatgaactgagagctctgataaagcataactcaattcatctcttttctgcaagtcatcttccatccatgtggaaagtgtgaatgataccagttgtgccacattgatactgaccccctcgttcctgaaaatacaccttagagctcatgaaagcacaccccagttactggaaaggaagccacttttgttgtaagcacagcagcagagcagcctctgaggtgcacagggctctgcaggttgctgcttggccttatgtctgagtaaggcctaagtacacatagctttttttttttgttttatttctgagaaatttaattattttagttctttttttaaatcaacttttattttaaaatttcagggtacatgtgcaggatgtgcaggtttgttacataggtgtgccatggtggtttgctgcatagatcaacccatcacctaggtattaagctcaacatacattagtgattcttcctgatgctctccctcccccacccccaataggccttagtgtatgttgtttctctccatgtgtccatgtgttctcatttgttcaccttccacttataaatgagaacatactttgtttggttttctgtttctgtactagtttgctgaggaaaggggcttccagctccatccatgtccctgcaaaggacatgatcttgtttttttatggctgcatagtatggtgtatatgtaccacattttctttattcagtctatcactgatgggcatttgggttgattccttgactgtgctattgtgaatggtgctgcagtggacataacgtgtgcatgtatctttataatagaaggatttatattcatttgggtatataaccactaataggattgctgggtcaaatggtttttcttctagatctttgaggactacaaggaacttaaacaaatttagaagaaaaaaaaacaacatccccattaaaaagtgggcaaaggacatgaacagacacttctcaaaagaagacatttatgtagccaacaaatatatgaaaaaaacctcaacatcactgatcattagagaaatgtaaagcaaaatcacagtgagataccatgtcacaccagccagaatggcgattattaaaaagtcaagaaacaacagatgctggcgaggttgcagagaaaaatgaacacttttttttcttttttgagacggtatattagtccattatcatgctgttgataaagacatacctgagactgggaagaaaaagaggattaattggacttacagtttcacattgctggggaggcctcagaatcatggcaggaggtgaagggcacttctttttttttttttttttttttttttgtcccaagacggagtctcactctgttgcccaggctggagtgcagtggtgcgatctcggctaactgcaacctccgcccccccgggttcaagtgattctcctgcctcagcctcctgagtagctgggattacaggcgcctgccaccgtgcccggctaatttttgtatttttagtagagatgggatttcaccatcttggccaggctagtcttgaactcctgacctcgtgatccacccatctcagcctcccaaagtgctgggattataggcatgagccgccgtgcctggctgaaaggcacttcttacatggtggtggtggcaagagaaaaagaggacagaagcaaaagtggaaacccctgataaactcatgagatgttgtgagacttattcactatcacgagaatagcatgggaaagactggcccccatgattcagttacctccccctgggtccctcccacaacacttgagaattctgggaaatacaattcaagttgagatttgggtggggacacagccagaccatatcagatggagtcttgctctgatgtccaggctagagggcaggggcgccatctaggctcagtgcaacctctgcctcctgggttcaagtgattctcctgcctcagcctcccaagtagctggtactataggtgcacaccaccatgcctggctaattttttgtatttttagtagagatggggtttcaccatgttggccaggctggtctcaaactcctggcctcaagtgatccatccgcctaggcctcccaaaaagtgctgggattaacaagcgtgagctactgtgcctggccaaaaagggaacacttttatactgttggtgggaatgtaaattagttcagccgttgtggatgacagtgcacacggctttgaattgtcccccagctgcactggactgggagttgctggtgctcctgatgctcagctagaattagagataattttagatggcaactaggggactcggttggggttgttccactctgagatgaaagggaacgtctttatttaggagtataatgttcttggagcgagtgttatgtcacaaaccatagttgggtggcctctacctctgccaacgtcagcaataaaaagtctgaggcagggaaactttttagagagaagaagagtgtttcctgatcatgggcttgggcttgtctacctgactagatttggacttttataataattcttttttaagatggtacacattctcctttttcctgtgttgtttctctgtggtctcactgctgcagtgccaggatctgcattcaaatacggccgagcccccagagcaccaccagtgcagtctgtcctgaggcactggactctcagagctctcctgcgggtttcagtcattttgtttggtttttcaaccatggctttgatcttgccagactttagtctcaacctgtgacccatttatagttacagatcaagaactagtggtcactttggcaacatacataccaacatggaaatgatacagagaagactggcagggaccctacacaaggaaaacaaaaaaataacttttttttttttttttaaagagagtctcactctgtcacccaggctggtgtgatcatggctcactgccaccttgaatgccagggctccagtgagtctcccacctcagcttcccaagtagctgcaactacagacatgcaccaccacacttgtctgatttttatttttatgtattttatatttatttttttgagacagggtttcactctgttgccctggctggagtgtagtggcatgatctctgctcactgaaacctctgcctcctgagttcaagcaattctccctcttcagcctcctgaatagctgggattacaggcacacaccaccatgcctggctaatttttaaatttttttggtagacgtgaggtttcaccatgttgcccaggctggtctcgaactcctaacctcaagtgatctgcccaccttggcctcccaaagttctgggccaccactctgagcccaaaaactattcttgacagtgttcaatgaactagcatatgggcgccttcttggttgtgggagatggtggcattgttgagcttccggatccatctgacctctcaaatgcttctgaagattttgcagatgaagaaaaatgctgttttgtatcagaaatgatagaagatgtaagtgtgtatataatgttctcatgtttttggaaaagaaggatttagcaagtgttaaagtgaatttgggaagggagcgaggaagggtgagaaggagaacctggcccgtttggatgcacaagttccttggggcggtagcattcaccagtgcagagagcagtgccatccaccccagagtctgttcctggtgggcctggcctggcctcagaaaatggggttctagtttctttaactgacaagaaggaatcaaagtttcaccactcactcctctagaatctgccctctcccaccctcagcctttcctttcactcttgtcgaagacatgaattgagcaagctgcagggcctctttcagcagggtctgctggcagtgtccactgcaaatgggacatgtgcttcagaggcaaatggagctggcgttctggccctgactctggcgctagaaatatttctttttgttctggctttcttatctgtaaaatgggtataacactagtcaccgtgcatggctgtaaatgagaaaatgcacagtgacaggcttatcacaggcactcagcaaatgccactgcccttcccagcccaccattttttttttaaaagacggttttgctctgtcatgcaggcgggagtgcagtggcatgatcttggctcactgcaagctccgcatcctgggctcaaacgatcttcctgcttcagcctcccaagtagctggaactacaggcatgtgccaccacacccagctaatttttgtatttttagtagagatgggatttcaccatgttggcctgtccggtctcaaacccctgagctcaagtgatctgcctgcattggcctcccaaagttctggggttacagcgtgagctaccgcacccagccaagggactcatacttaaaggactttggtcttgctcattgagcatttggttttctatttaaaatgtggtctttctgttggaaacgatctagtatccgtcagcattgctcttgggaaagaacacttccaggcagggcaagcacttgccttgtgtacacagatgccttgagatcagcataatgtaaacgtcaaaacgggtttctggatctaaagcctggcttgctttcttccaggtcagcagtgcaagagatgggtttggagatagggtcgcagccagcctgtgcgtggcagaggaaggaagggggagctgagtactggcaggggccacagtgctctctgcccttcccaagaggaaagcagaaaccagaccctctgttagaggccctccttgttttcaccttcccagggtttgatgtccataacatctggtttgaatgattccagcgaactggatggggcaccccactgccccaccaccgcctgttttttcatctttttttttgggggggggacggagttaatctctgcaccccagctggagtgcagtggcgctatctcagctgactgcaacctccacctcccaggttcaagcaattctcctgcctcagcctcctgagtagcggggattacaggtaccagccaccacgcccagctaattttgtatttttagtagagttgaggtttcactacattggccaggctggtctcgaactcctgacgtcaggtgatccgctcacctcagcctctgtaacctacaaacctcttcagaaagtgtaaaatgaaagcatttccccatttctaaagcagtgtccaggtttcatcaggtagctgtcgaacccaaagagactttgaagccaagagtccacaggatcagcttcccagtggccccagaagttacaagatggggccctcccaacaaaaggcatcctcaggcttttacgtaatgctggtgtgcttagcgactgctgaaagttgactgtgcttgtgtcgtgaaagccaagatgaagagacgttattatggttgtgtgttgctttcagctagatactcctcgctggggaaatgtaactgcaaagcagactccaggacactgtcttcctgaaagccggtgcttttgggggacattctggggcccaccagggtcatcctggatgctgactggaactgagaagaggtttgctgggaagatagggacagattctttgtatctatgtcattcaggtaaaccctacatgtgacatgtgacaccatctcttttgacctcagtttcaaatgagatatttgaccaaccttattgctaagggtcaggctagcttgaaataaccctcaagaaatctagataaaaacctaaatgagattataggctttttttttttgcctaagattatttgcttccagaaccctaaggaaacttcacaggaaacatggtaccatattttagtacacatctccatcctatgcatgttctccagaacctcttcacacacactttgaggagagttccatcaaacctccttctcttattccatcttaatgtcatgcattatttctcttcatcctgcctctccttttcagttacaaattgattctgatagaaacaccctaaatgaccttcccagggcagtcagagagttaacttgttgtagggttgcatttggccatctgggcagagggaggaaacagtggtcagtgtccaccctgtgggagggaggcagcacccaccacagctttccaactttgctggcttcacatttcccaggacagggcaagaagaggaagagctcctcagtggctgtggggagagtgcaggaaggagccctagacttgcccatttcttcttgtcccaaaacccaacacagacctaaaactcagccaagcccaagctatgccccgcttctgcaatctcttgcaaggcccctgcttaaacaacctgagctcccagctttagtaggcttgggaacttgatgcttcatttgggacaaactttgtggatccagggaagaaaaccttgttggggtgagcaggtggccgacaggactgaggatctaagaggtggggatgcactggagtccccagctggcctaggggaccggtacaggagtcttcagaagccaccatctcgatgggcagggacttagaattgaattttttttgtttttgttttttttgagacagaatgtcacctaggctggagtgcagtggtgcaatctcagctcactgcaacctctgccttccaggttcaaggcatttgcctgcctcagcctcccaagtagctgggattacaggtgcccaccaccacacctggctcatttttgtatttttagtagagacggggtttaaccatgttggctaagctggtctcaaactcttgacctcaggtgatccacttgcctcggccttccaaagtgttgggaatagaggcgtgagccaccatgcccagctagagttggattttagtttccttatcactgtgtaccaagcagctgctgggggctgcacccatcccgatggaggagcttctttctccccatgcagcctcatgctccctgcttgtttggtgtgctgacggggctgctgaacaggacgggttttcttttccccctgagaagcctcctacattgtggggagaagagtgtggtaggaagagcaatccagagacagtcttgtaggtctttaagaccttctcatcttggtctgcttgttgcgaattggggttatacagagatggtgatggtggtagtgatgacggtggtggggatgatggtcatggttatgaaggtaatgacgacggtggtggggatgatggtcatggttatgaaggtactgatgatggtggtggggatgatggtcatggttatgaaggtactgatgatggtggtggtggtagtgattcctccttgaccaaataagtctgggaaatgctggcatgtacaaaactaatcaggtgggttaatttgagaataagatatctttgagcctttaatgactctcctgagggatggacagaaatcctctactgttttgagcactgaaggcttttcctcaatactattctgtgaatggatttgggcaacaccaggccattcctggtaccaaaacaaaatgtactctgagcaaatttgggaagtttattcttatgttgccttactgaaaaatccaaaggtagattcccatctattattattattattattattatactttaagttctggggtacatgtgcacaatgtgcaggtttgttacataagtatacatgtgccatgttggtgtcctgcacccattaactcatcatttacattaggtatatctcctaatgctatccctcccccctccccccaccccatgacaggccccggtgtgtgttgttccctaccctgtggccaagtgttctcattgtttagttcccacctatgagtgagaacatgcagtgtttggttttctgtccttgtgatagtttactcagtatgatggtttccagcttcatccatgtccctacaaaggacatgaactcatcctttttatggctgtatagtattcgatggtgtacatgtgccacattttcttaatccagtctatcattgatggacatttgggttggttccaggtctttgctatagtgattagtgccgcaataaacatatgtgtgcatgtgtctttatagcagcgtgatttataatcttttggatatatgcccagtaatgggatggctgggtcaaatggtatttctagttctagatccttgaggaatcaccacactgtcttccacaatggttgaactagtttacagtcccaccaacagtgtaaaagtgttcctatttctcaacatcttctccagcacctgttatttcctgactttttaatgatcaccattctaactggtgtgagatggtatctcattgaggttttgatttgcatttctctgatggccagtgatgatgagcattgtttcatgtgtctgttggcagcataaatgtcttcttttgagcagtttctgttcatatcctttgcccactttttgatggggttgtttgattttttcttgtaaatttgtttaagttctttgtaggttctggatattagccctttgccagatgggtagattataaaaattttctcccattctgtaggttgcctgttcactctgatggcagtttcttttgctgtgcagaaactctttagtttaattagatctcatttgtctattttggcttttgttgccattgcttttggtgttttagacatgaagtccttgcccatgcctatgtcctgaatggtattgcctaggttttcttctagggtttttatggttttaggtctaacatttaagtctttaatccatcttgaattaatttttgtctaaggtgtaaggaagggatccagtttcagctttctacatatggctagccagttttcccagcaccatttattaaatagggaatcctttccccgttgcttgtttttgtcaggtttgtcaaagatcagatggttgtagatgtgtggtattatttccgagggctctatgctgttccattggtctacatctctgttttggtaccagtaccatgctgttttggttgctgtagccttggagtatagtttgaagtcaggtagcgtgatgcctccagctttgtgctttttgcttaggattgtcttggcaatgcaggctcatttttggttccatatgaactttaaagtagttttttccaattctgtgaagaaagtcattggtagcttgatggggatggcattgaatctataaattaccttgggtagtatggccattttcatgatattgattcttcctatccatgagcatggaatgttcttccatttgtttgtgtcctcttttatttcgttgagcagttgtttgtagttctccttgaagaggtccttcacatcccttgtaagttggattcctaggtattttactctctttgtagcatttgtgaatgagagttcactcgtgaattcggctctctgtctgttattggtgtataggaatgcttgtgatttttgcacattgattttgtgtagattcccatcttatcacaatcttcctcatctgtgatactgcacagtttgcaatagttcttgtttattactacttttctctcctgcagaacattgacatcaccaatttcagcagcagctggagcgatggcctggccttctgtgctctgctccacacctacctgcctgcccacatcccctaccaggagctgaatagtcaggagaaagtaagtcatggccctgtcaccttggttatcctctaagaaatgcaggagtcctaattgataaaccccactgtgggagggggcttacaggcctgaagtagaagttgggatattgataccaggtacagataactcctgaatgtttgactgcaccgtggaatcccatcctcagcaaatcttcctcagtttcccttctcaggaatctcagcttcatggtttcaagaccttggccagcatttttcaaagcctattccaaagaaccagcaagcaccaacaaaaagaattccctgttcaaataagtcttggacactgtatattgcatcacattttcagagagcatggtgcctgttaacacattaaagacttcaagaagtcctacattaagaaatctatgtgactgtttaacacagcatagatcagatccacttaacctctttacttatatttgtttgttttactacaatcacacaacaagggttggcaaattttccctgttaagggccacgtaatagactcagtgggtcaggtggtccagtcacaactgttcaactctaccatcgggctaaagaggccattgatcactttgtaaatgaatgtgcatggctgtgtcccaacaaacctttatttacaaaaacaggctatgagccagatttgggacagcagtttgccaacccctgacctagaacctcctacaaaatgtcccacagagcatactttggaaaatactgtgctgggtcccgctgttggtcactcaagaatttcttgtcaagcatcgggcactatcataagaaaacaggcaacaatagagacgttctatgccctcatgagctagacagataataagcaagcgagtagacttataacaagtaaaattataaattagcaaggataagtggtctaagagcccagagagaaactcagtgctgtgagacagagtgacggggatcacatttagaccagggagactgcagcggtgatgtcagaactggtgttggggctgggcatagtggctcccgcctgtaatcccagtactttgggaggccgaagcgggtggatcacttgagttcaggagttcaagaccagcctgcccaacatggtgaaactccatctctactaaaaatacaaaaattagctgggcatggtggtgcacacctgtaatcccagctacttgggaggctgaggcaggagaattgcttgaacctgggaggcagatcgcaccactgcacttcagcctgggcaacagagcaagactcctcaaaaaaaaaaagaaaaacaaactggcattggaaggtagaggaggcagcagtgcagagccagggctatggagcagcagcagctggggaacaccttggtgttgtccaggccgtggaagaaggctggttggctggatgcagttagtggggccagagaggctgtgctgatccagggaagtggagggggcagacccccatagctgggctgatctggggagtctggggcgggagaggcgacagagcttccccacagctctggtttggcctcacccactaaccatgagggtggtagcaacgcagacggaaagacatagaaggatttgaaatatgtctcagacagaatcaactggatttagtgacagattggttgtaggggaggaggagaggaaggagtcaaagatgacgccctggtgtctagtttgaaagggccattttctgagatggggagggcatagatatgtttaaaagctctgtttcgattatcccacatcaggatttaaataaagtacaaagaaggatcatagcaatgacaaaaactgagcaaagtaatttaatttttaaggtgttagaattctccaaaaaagcagaaccaaaagagagagagagagagagagagagagagtgtgtgtgtgtgtgtgtgtgtgtatgtagagagagagagagagagaggtgggggctggggagagagatttattctaaggaactagctcgagattatagaagctagcaagtccagcatctgcagggtaagccagcaggctggagactcagggaagagctgatactacagtcccaatgtgaaggccatttgctggtggaattccctcttcttcagtgaggttagccttttcttttaaggccttcacctgattagatgaggcccacccacactaactggggtcatttgctttgccgaaagtctcctgctttaaatgttaaacttgggccatgtgtgggggctcatacttgtaatcccagcactttgggcggctgagacaggaggatcacttgagcccaggagtttaagaccagcctaggcaacataggcagacctccatttctacaaaaaaaattttttttcaattagctgagcttggtggcgcacatctgagatcccagctactcaggaggctgaggtgggagaatcacttgactctgggagtttgaggctgtagcaagccatgattgtaccactgctctccagcctgggtgacagagaccctgtctcaaaaaaaaaaaaaaaaaaaaaaaagaaaagaaaaaaaaccttcacagaaacatctagaataatatttggccaagtatctgggtgccatgcctatccaagttaacacatgcaattaaccatcacagaatgtattaaaatatttaaattacttttctgtggggtgctttgtttgtgaagcaggctgtacaggattattaaacattctgggggaaagattgtatttaaatcatgtgaagtctgaggggctgtgaaatatgcaggtggtgatggcaggcaggcgattgcacagcaaatccggagctggatgggagagcagagcttgaaacacagatctgggggtcgtccatgaagagatccatgctgtctaatgcaggttcctgggatgatgggaatgttgtgtatctgcactgcccacagggcaaccaccaaccacacctgcttttgagcacttgaaatgtggcagatgtgactgaagactgaatttttaatttcaattttcatgttaaataaccacatcatgtgtggctgccatgttggacagcatgggcacaaatggaatttaaagccattaagagtggaggagagcacccagtcccttggtcttagggaagcatacagagggaggaccgaggaacacacctgggaaccccagtgtttgttgtggaggtagaggaggaggacacagcaaaggggaccaggaaggagcagccagagaggtggcctgagctggggccacaggcttcagcggcctcacgggtcacaggtgtcatctatgcatttattccctccctgccctcttgatgtcttagtgtctgcttttctgatacgatgttggagagataactgaggaaatagtgggcataaaagcactgaaaatagtcagaaggcctttctaacactgtgctgggtgaagcccacacatgcacacacctacgtcctcctgacagtgtgtgtgcgtcactccctgcagtcatccagacagactggctgctttgtccttgaatcagcatggctgtattggaaaattatggacctaaaagtgtttgttctcaggctccaaattgtgagccttgcctcctgggccagagcccctgtgtctggccctagtctctgcgattctgagcgcagaggctccgccagctgcccaggcctcccgcagccgtggcagcatgcagtgggggcaggctgaggccatggtataggcccctgctccctacatgcagggttgaatttcttccccagaccaatcacccgaccaccagggagtgtgtaaggcagcgtgtggaagactgtgggtctgtgatgagagtctgagtcagccctggatgtctggaatttttcattttaggatctgtttggcctcacagtaatcttgaattgggttgtgtcccagagcctaggattttatttgctaattacagcccgtttgccactctctgaaggaacaaccagcctcctgtttcctaaatgccccatcctggccacactctggaggagccacagtggctgcagtgacatttcgccacttcttggtgtgtggcttgccctgggggatgctggcgttctttttggtgagagaggccatatctatcacagttacgggtgtgggttttcaaagtaacgtatcccaacaggcagactcgtaccatataaaactgagcacacggggggaatcttactagagcagagaggggaaagagcaggaaagatttcctaaaagtgtgttagaagctgggattcacagggagcaagtggatgtgaatacagcacataccttgggtcatcaggatgagaggcacatgtgtccagccccagcctggagccgtgttcccctatgtgctcagtgccagggcatttttttttttttttaatttacacttacatcagaaagggcaccaagagaagcctttaatgtttgtaaaactattaaaatcaaaatctaaaaagtatgtgatagagttgttgatagcccagaatgtatagaaattatgaggtgtccccacctggatggaagcaattaaactatgtctgacattggtattaagtagagaatttctgataaaaactaacaagcatgtcttctatgatagtaaagagatatatgatcacagggtgcgatttacagtccatgaaagattttgtcattttgttgttgttgttgctgttttgagacagagtctcactctgtcacccaggctggagcgcagtggtaccatctcagctcactgcaacctccgcctcccaagtccaagcgattctcctgcctcaacctctcgagtagctgtgactacaggcacacggcactacacctggctagtttttatatttttagtagagatggggtttcatcatgttggtcaggctggtctcaaactcctgactttaggtgatccacccgcttgggcctcccaatagttctgggattacagtggtgaatcactgtgcccagccatttttgtttttattgttttcagtaaaaagatagggcattcacttgtccgcctttgcaactctctgcttagtccagacggactcaggtagtggactggaccttgcttatgtcagtatctgaaatgaatgaagtgtgaccctgagagggggaactctaggattggcatctttctcccgtcggttttgagtgtgaggcccaacgggcccaacccctcaatccctgctggtgactaagagttttgccacaggttgggcacttaggctgtcctggaactggaaggtcccaggcctgcaccatcatcccccgaccagggcagactgaagcagtgatggcgtcaccctgcccggctcctgtgggctgagctgcatctgaagcttacagcccgtgggggaagtgaggcccttcggagctgctgcttgtctgtggcttctgcctcccaggtggcctctgcacagtggtggtgacagtgatcaaatgaaagagcattgggataataacacttggtcacagatgttctgctgctgcaaaaatgaataaaagttactgttgtgaataaaaaaccaccccctctctgtattctatgtcaccctgtatactatttcagggtattttgagacagtttttcatcaagggatcctcccacctcaggcttcagagtagctgggattacaggcatgttgccaccacgtcttgctccgcttgtgttttcacaacagatactgaacatagaagaaacagcatgcagcacactgtgaaaacacagcggtgccaggcgttgtggcaacatgcctgtaatcccagctactccagagcctgaggctgggggatcccttgagcccaggattttgaggctgcagtagtgagcccatctaaaaaaaaaaaaaaaaaaaaaaaaagaggaaagaaaacaagtggtttcattagaatcaaactagaaggtttttgcataaaacgttgagtttaaaaatgctttctcgttagaccttactagtaatcaatacaaattaaaacaataaaatatttttagcctgatacatttggcagagacagtacaggaaaatagccacttatacactattgctggagccaaaaattggggtaacgctctagaaagcaatgtttggcattacatattaaaagccataaaatatttgacttctggaataatggtggcctaaaaactggctaaaaaccaaaaggactgaagtaaacacaaagacctcaatagcaccaaaataggagattgctgccattaatttgggctaaatggaaggaagccaggagttcacagctcccctctcagcagaacagagtagtgttagggtaacaagtgtgcagtttccagcccatgcccgctcctttcctttaatttcaaggaaggggcatggcagcttgggcaggatcaccacagatcaacagctttccaaggcatgggccacagactggaagaaaatgtggtggctacatctttctgtttttttggtgacctggtgcctagagtttgcttcagtgtcagggaaaacccgtcgcttcaggctctagatgttcaagcaagggtagagagtgagagccgtgggggaaatggaaaagggtataaaatgatgtatgaaatctaaaatacataattatgtataaaatctaaacatacaaaattaagaaatttggacaggtgctgtggctcacgtctgtaatcccagcagttcggaagactttgacaggcggatcacctgaggtcaggagttcaagaccagcctggccaatgtggtgaaaacctgtctctactaaaaatacaaaaattagccaggcgtggtagtgggcgcgtgtagtcccagctactagggaggctgaggcaagggaactggttgaacccaagaggcagaggtggcagtgagccgagatcgtgccactgcactccagcctgggtgacacagcgagactccatctcaaaaaaaaaattaagaaattctactgaggaacataatggccaggtgccatagctcacacctgtaatcccagcactttgggaggctgaggtaggcagatcgcttgagcccaggagttcgaaactagcctggtcaacatgacgaaaccccttctctactaaaaatacaaaaaaaaaaaaaaaaaaaaaaaaaagccaggtgtggtggtgcatgtctataatctcagctactgaggtaactgagaaacgagaatcacttggacctgggaggcagaggttgcagtgagctgagctcaagccactacactccagcctgggtgacagggcgagattccatctcaaaaaaaggaaatttcactgaggaacttaaaactgaatatgtagagaaacatttatatctcaattatacttaatataacaatttaattttaatataatcctaataattttgaaatgaattttggaatgggagaagcatgaacaaatgattcttaggttcatctagatgaacaaacatcagagaatagccaggaagagtccccaaaagaagccacacactagggctgaatgattgtggagcactaccattaacattctaaggggaaattattttcagcctcagattccctgtccagccagcctgttaactgaacgtgatggtagaaaggagaaattttcatacatccagaaaatgtgtctccccatattctttcttaagaaggaacctaggcaatagaatgggggtaaaatccaaaaatcagtgaggttctggagggcttggggctgtagggtttcatagaatgatgagatgattaagagctcgaggctgtgataaaggagaagatgagaaactgtgcgaggaagccagggtccaactatgaggcaggccctctgtgtcagaatagaatggcggcagccacaaggagaatgttaggacttaaaagcaacagtcagaatgggcaagaggccagatgagaaggaggcacaaagcccccctcccagtaaggaaaaccccaaacaagcagaaactgtaggaaaaaaacaaacttttgaagaaaggcagggtccaaatctggggcacactaaaatgtggggtgattttgggcgactggtagagtaacagaggaactcctttaaatgatgctttgagtggctcaggtcatgatggtggagctgtagaggacacgtgcccacagctggcttctgtgatgccgcttgtggttttcagcttccagaatcattctagtcagagagcgccgaggacttaaatgtgcttccagggaaggaagcaaaggttctcagctgtgacaatgtacaacttgaccaggtggagggaagaaagggtaatttactcctgacatacaaagtagagtcaggaagtgttgtccatacccagtgggacaaaaaatagaagttcaaggatattatttaaggtcacaaacatagctaatattaatacgggcactaaaattagctatgtgtctatagtgtaaggaggaggcagatgcatggtgcctgagtcctcatatgtcctggaggaagtcagtagaaaatgccttcattttagaaatcaagtagtagtcgtattagcatattacagagatacggaaataatccataactaaacagaaattgaaaggtagttctctgaaggaccaggattgaaggaaggaacaggttttcatttgatttaaatacaatctatatatactataatatatgcatttattactttgataatttttttgatatagcatcatgattaagcaactttgttatgcaacagaatgtttatgccataaatcttgcaaagtatgaattacctaaatcttgacaaaggtaaacaaaaatttatctttgataggtgtcaatcagtaatgttagttttggtgcagttgcaacctgttgatttttttttttcttaaactgagatcaaatattgtacacttgacttactattcttcgctttataatagtgaataatctatatgggaatatcagttgatattctttcctggcaaaagctatatattttaaattactgattccagtctctttgtctttttaacttagaagaggaatctcttgttggcatttgaagcggctgaaagtgtaggcatcaaacccagcctggtacgtatcctattttgtatccttgtgatactttaattgtatgagaaatgactttatgccatctgataaacagtttctcgtagaacattgacatctgtttgccgaaagtctgttgctctcaatacctaatatagagttatccagttgatataatcacatatcaacatatgatttagagattttcaatcgcataagatttcatatggacaaatttcagttctggaaacacagtggactgaattattattagagccctcttgttcagaacacctagaaatctgaataaaatgctatgttaaaaaatatcaacacatagctaagctcttaataaagaatgggaaatacccagatgccagaaatgtaaaacaaagcagaaaccaggcacaactgagcctgcaaaactcggcaggggtgggtgggggatggtgggccaagcaagcagcaagcctgcataaagccaaggctcacaacatgctgatcttcttagtgaaagcagaaatctctaaaactccaccagccagcccagggaggtgataaggaagctggtttccacctgggattgtgtgcgcacgtgcgcgcagagagaggaaaaggagagagagaaaagagagagagtctcttgcaaggaaaggaaacagggccagatgaggtttagagtccaaatttataatatctgtgctgcatgaagcccttagtatactcttagatgcaggaagcccctgggctgatactacaatggctgctaaaaagtaacagaacacttgagaaaatgatctacttgagctagtcagcagatatagcaaacaaaaggattatctaccagaacttgagatgataaataagagactaccaaaagactatttaaacatgaaagagataaaaggaggaatagaaaccacaaggaaagaatgattctatttaaaaaagagatttgtaaaaagaatctaacacttctagaaatgaaaaattggaattaagaccacaatatgtgttgccaaactcattagatacagcagaagagagaaatactaaattggaaaataaatacagggagatcacccaaaatataaaagagacattaaaaaatataaaatataatggtaaggttgaattagtatgtgttcagcttcaagaaatggaaaacccaaccagcagttgcttaaaccataaaaatgttaattttcttaacaatagtagttttagaactggttcaccactcagtattgtaatcaaagccccagagtgtctcctctccattctcaccatctttaatctgttccttttgtccccatgcttgttctttgtggttgaaggtggctgccaaacttcagacatcacttccacctacagggcaggaagaaggggaagagagagagcaagtgcctcctatctttccctttaaagaatgaaagtgaaaggctccctgggtttctccagctcattggcagtactctgttacatggtccccagctgcaagggcatttgaggaagtgagcatatgaacagttttcagtttctttagtgggaagcctgcgagggagagagcttgggaatgactgttgggctatctaaataatagtgtctgtctcagagtttaagagacagggacaaaaaaaatcagacaatggccatgtcccatgcccagagggaattccagatgaaaaggatagaaagaatggaatggagacagtatttgaagatatgatgcctgaaaattttccagaatgatgaaaggataatgaaagagtccacagattctttatttatctcaagcaggatgaataaaacaaaatatccatctagacatattgtaatgaaactacagaaaaagcaaagacagataatctattaaaaatttctgctcaccagtaataaaaatacaacctagtaggaaattatcaaagactagaagagaaaattcacagatgatgatgatgaatggtcaatgaggatttttaaagatgttcaatctcattagggattgggaaaatctaagttgaaataaaaatgagataacaattccagctgggtgcagtggcccacacctgtaatcccagcactttgggaggctgaggtgggtggatcacctgaggtcaggagtttgagaccagcctggccaacattgtgaaagcccgtacctactaaagatacacaaaattggccaggtgtggtggcgggcacctgtaatcccagctactcgggaggctgaggcaggagaattgcttgaacccaggaggcagaggttgcagtgagccaagattgcaccattgcactccagcctgggtgacaagagcgaaactccatctcaaaaaaaaaaaaaaaaaaaaaattccataaccctcaaagcatgtggggaatctgagaaatgaaaaagtgaatgtacatctattgtgaaatcttaccaccatgaacagtgctatgccagtgtaattttgaaacagaatggacagttttctagaaaaatacaagtatgtttcttcaaatattaaatgtaaatattcctatgaaacttaagaagacataaaactttaaccattgaagaggttgaatttatgctttaaaatgtagtcacacacacaaagaaaaaatatccccatcagcccagattttgctaaatctttaagacgcagatatccctattgtgtatttacaagtctgggaaatttaaaaaggtgtgaggaaacttacacatctgaccagggtggagtagcagggatctcccttcagaaacaacaaaactaaggagtaccaacagagagatcaggtaaggataaagatacaatgagaccttgttggaagattatattttacacagaatacatttttctttgtagtgttgtaattaatatttacttctgtttaaatataatatctttttcttaattttcatctaatgtgctatagaagttagtgagctgggaagtgaatgaggtcattttgttgtcctaattgtcagagccaggggtttcattggtgtggatggtctgtgaggagctgctgacacacatgataattaatctcaaaggcacttaggagtgtttgtgagcactttcccggctttttccaccaacaaaatagaaatttcctacattcttaaatttgcttttcagtaccttgatgtggattggaaaatccagtatgttgaattacacatgacactttaaaactacacccagtcagaagtgacagcagtaatccccaaatcttcagtcaagttctgttgttagattatgccaggaaaattgtcttatatgtttatattcaagtaaatataagtttctggggtataacatattaggatgagatctttatttttataatttcaacttttattttagattcaaggagtacatgtacaggtttgttacatgggtacactggatgatgctgaggtttgggatatgagtgatcctgtcacccagataggcacatagtagccgatagtttttcagcccttgcctccctccctcctttctccctcttgtagtccccagtgtctactgtccccatctttatgtccatgactacccaatgttgagctccatttataagtgagaacatgtcttatttggttttctgtttgtgcattagtttgctgaggataatggcccctagctgaatccacgctgctgcaaaggacatgattttgttctttttatggctgcatagtattccatggtatatatgtaccacattttctttatccagtctactggttttctttctccttttcttttttttttttttttttttgagatggaatttcgccttgttgcccaagatagagtgcaatggtgcaatcttggctcactgcaacctccgacttccgggttcaagcaattcttctgcctcagcctcctgagtagctgggattataggcacgcaccaccatgcccagctaattttttgtattttttttagtagaaatggggtttcatcatgttagccaggctggtctcaaactcctgacctcaggtgatccacccacctcagcctcccaaagggctgggattacaggcatgagccactgtgcccggccctttatccagtctactgttgatggacacctaggttgatttcatgtctttgctattgtgactagcactgtgatgaacataagtgtgcatgtgtttttgatagaacgatttcttttcttctggatatatacccagtaatgatattgctgagtcaaatggtagttctgttttaagttctttgagaaatctccaaagtgccttccacagtaactgaactaatttacatttccaccaagagtgtattcccttttctccacagccttgtcagcatctgttactttttgacgttctatcaatagccattctgactggtgtgagatgatgagatctttaaaaatgaagctctatagtgttccccagatattagaaagtgttctttctcagccaccgtgtaaggagagcatcttagccagcccaattacagatgcaagcaactccccagaaaaggaattaggcgagggacgatatgtgatgtcactgtcataaaaacggccaaaacatgtgtccccagggctgctgtgtctttaccaggccatgtagtccatgagggctgttgctcactgagtgccagcatgcccaccaggacagctgctgcaggactgggtgctggcatgcccccgtggagggaggtcaccatgcagcaattcctgaggcatggctgggcctactctgcaagtgtaaacttaatgagctgtgcttaaatagctaatttgtgcttgattgtgtgacaagcattttgtttttcatatttactgtatgtatttaccattttgggcatttttcatgcaaggacttgttggaccctcatggaggtcctgcaaggtggatgcactctataagaggaaactgaggcacatggcttatgagcgggaaaggcaagaggcaaggccaggcaggcagctccagagcgcatgccgtcaaccaccctgacagctgtgtctgccttctgcacataccttgttagatttagaccttagtggggtttttttttttttttttttggtgctattgtaaatgttattgtttttcttattacaaaatccagttgttcaattggtacataggacagcaatggacttttgtatactgaccttgtatcctgagacttagctaaacctgcatgtaaatgctttgggatttttctaaacaatcatatcatctgcaaataaaggcagttttatgtctccctttccaatctgcgtgccatttgtttctttttcatgccgtttagcactagctagaacttccagtacattttttttttgtttttgtttttgtttttgtttttgagatggagtcttgctctgtcacccaggcctggggtgcaatggcatgatctcggctcactgcaacctctgcctcctgggttcaagtgattctcctgtctcagcctcctgagtaactgggattatagacacctgtcaccatgcctggctaatttttttgtatttttagtagagacggagtttcaacatgtttgccaggcctgccttgaactcctgacctcaggtgatccacccgcctcggcctcccaaagtgctgggattacagtccagtacagttttaaataggacagatgagaaaggacatccttgccttgttcatgattttacggggggaatgttcaggtctttcaccattaagtatgatgtcagctgttggttttttatacatatcctttgctaggtaaaagaggttcccttctcttcctagtttgttgagagttaccacctataaaaactatcttgattgtggaattttgtgtaatgctttttcttcatctgttgatttgatcatatggtttttcttgttcagttagttaatgtgacgaattacatcagtttacaaatgttgaaccagccttgtgttcctgggatgaacctcacttgatcatgatgtattatacttttataggttaatagattgtgtattcatgagaaattggcatgtagatttcctgtaatgtttatgtctagttttggtatcaggataatgttgggatcctggaatgagttgggaattattctctcctcttccattttttgaagagattgtgtagaattggtattatttcttccttaagtatttgatagaattcacaagtgaaatcatctgggtctggtatcttttggagggtcttaactactaattcaaacaaatgtcatgcactataagattgttactaatgcagcatactctgtcttctgaaatgtataacatcttttcacaaattctcaaatatgttaacaatgtactaaatatttttagttcagttatgaagttcaagcatgtaagattgtctgctcaaaactgaatattgattggacttcggagtcctctctgagattaaagacacaccctttccataatacagaggaaagtgtgcagtgtgccatctctcttgtgtttgtaggtatcccttcttttcccagagctcatctatgtccaaattgcatgcccaattcttcatcagttcctttctgtaagtcatgttagcaacactccttggtacggattttaggttgccaggcctcagtctgtgtgcagtcatgactacagccagtgtaggtagaaggagacattctattcttgtattctgtgaaagtttgtttttcttttaaaattgttctaggtgtacctgcacggaatgttctaccaactcttcttccactcctttcccatgactaatgataggctgataattttttagcatcaccagggagcagaataagtgaagtctgttcagattttgaatcaggggatgaatggctcattaacagcctcagccaactctgttaacccccaggaactgatgtgctaagttcagccttacttttccatggcatctctgcttctggctttacatcagggtcctttcctactattctcttttaaccacacagaatccaaattcaatcccaaagttaattattaaatatgtccagtggcacaaatttcagaaaagtttgagtgcctgacaggatgcccaccctcttgcccctccctttctggcctggatgttatgcatgctcattacaagcttacttgcaaaatgaacaaaaataaatcagtcagtaaaaaccagcaaattagcaaaagtaaaataaaaataagccaaaaaatcaccaaactgtattaaataacaaacaaacaaaaaaacacattaagtagtaacaatgctggtaaaataaatggttgcatttgaaattggttcaaggcttttgtgataatcccactcagtaatttatcttgagggactagttcgacagaaggaaacaatactgcacaaagatgctgattgcagagtctgtggtggtcacgaggtgagcgtacactggatgccatgtcccttgtggacagcagtttccctggtgagtgcacattcactagaatggcagcccgcacagtggcacagcagcacggggacccgggtgtgaaatgctcagcccacgtaatggcacagcccacgtaatagcgcgtgcagtgtgctgggagtctggggaattagaggtggattcaaatgtaatttagaaacttggaaatcattttaatagtgaaattatgggtgatttttgctttttaaaacttgtttaaatgctgtcatatggttaaaagataaaagcagtgggaggtcatgttttccgtttttggaaagggacagtatctcctgaataagtgggaggaaaagtcctttaactcatcgctttcagcaccacctgtgctggccttcacgttctgtctgtgtaagtggagggtttccaggcagtgtaagccctaacctggactgaagtccttgaggggaaggggtctgtgatgtcctgccttgtgatctgtcccccattcccttcccctgcaggaactcagcgagatgctgtacacagaccggcccgactggcagagtgtgatgcagtacgtggcccaaatctacaagtactttgagacgtaaccctggagggcctggggcagccaccattgccacctactgcagcttttcctggaagcgcctgattactgtccactgaccctgctctgcccaccacccagctgcctagacttcaaagacaggctcaatccaagtggaccaacacccaaataagaaacagagtgggtcccacgatgtacctgtctgaaatgcaaatgcagctggactgtaaattggggactctttgatctcttgtgggatgcttctaaagagggcagcctccctccttccagaccaagaccccacacccaggcttgttttgctgattatattgggtggctgaacgaacacattatctgcagaaattcagacaaagaacatctccaaatcagtcttttggttgctgttgttaaaaatatcccggctttgcctttatgaaacctttgcccttggctgggtgtggtagctcgtggctgtaatcccagcactttaggaagccaaggcagtaggatcgtttgagcccaggagttcgaggctgcagtgagctatgagcataccactgcactccagcctgtgtgaaagagccagaccctgtctcaaaaaaatgataaaacccaaaactttgcccttgtgaaccctcccttcccccctccccccccaaaaaaaaacaacaaaacacaaaaaataaacatttgttccagggcaacctggaaacgtg

SEQ ID NO: 1690 - DNA, 158767 bp, Homo sapiens
cagatgagggggcggggcccacgggcgcgggagagcagcggctccgccggcagctgctgggaactggaaggcgcccggtcctttctttgactggagcggacccgccggacgcaaccgcctcgccagccggagccagcgcgagctcggcacggtggacacccggtccgaggccggcaagccggctggtgcccgagtcggccaagcatgggcaaccactcaggacggcccgaggatccggaaccaggtctgtgcggctggcgggggtcgcgccgcagccgcaaccccaccccccctccaggcgcccttcccccaccgcctccggctcgcggcgccgactggggcgagcgaaaggctaaggtcctggggtgtgattcttgtcgttggaatgcgccgcttgggattgtgaaattacctgtgccgacgccgcgaccagaaaacgctgctcgtcctgaacgcgcacctgggcgccggggccgccgggcaggcaccgctgggtccctgccgcggggttccccactccgcgcctggcctgcgcctagaccaggtctcctgagcgcgcaggccgccctcggactttccgggcgtttgcggggagggcgtgccccgcggcctctccctgtcggccgccggccccgcagtttgtggcgcccgcggctctgcccctcacactcacgccagggctgccccgcgactgttcctaacccagaatagtccgtgcttgttctggggtgtcgggcgcgcctctggttatcccgtttttacttcctcagtcctgagtgagcttcgtggagtcagttgggccgtagttttcgtcctctggtagctcatgtcggcccccagcagagttagatgccgataagcagggttgcttttaaaaacaaaacgaaacatttctggactgtcacgtgaagcaaaagggatttagttttgcctgaaaaatggcatcttggctgataggaaagaggtggttgacctgactctggagtccttgtgggggtggggggccggtgacaggtatgtgtttctgtgggagagtcagaactgtaaatattttccaaaggcgtaatatttgaattttaatttgaatgaggactttgaggctctgagaggtgaagcgacttgtccgagtgaccttttccggagctgggtgccgtgctgtaggacgctgggtcgtcctggcctctgcgcattgcttctccttcatctcccagcgccccagccgccccaccttggccctatcctcggggtggggtggaggcgggtgcctccctgacacttggggtacattggactggtaccacagccaggatggaaaacttggacgggctgtccaagtttcttcacaggaatactatgaagaaaaatttcaggggccagcttactgcctagaggtgactttagttacacagcacttgttcagactattttttgggcagaataaccaacaataagcatattcataaaatgaaatatgcataaaataaaaataatatacttgttataaataaccctgttggtaaaggattggttcggtaaaggattggtaacattttaaaaacacttctcattagttacatgcttgtccaggtattgtgaaaacccctgtgtattatttcctttgtgttaaaattgtgaaaagagttactcttgttacagcttttaagactgattggatgcctgtgttccaatttttttagtgaccttactttttaaagcactgtgatggataggacataaaaagaatatgtttatgccagtgacttattttattgtatttttcaaagaatgcatatcatttcagaatgggaactctgatttgctgcaaatgaagataccggatttagggcatttttaagagatggtgtctcactatgttgcccagactggccttgaagtcttgggctccagcacctctcctccgtcagcctcccaagtagctgagactacagacaaatgccaccttgcctggctagaaattcgtggtaaaaactttaaatgctggattactgtctgaaagtgtaattttaactggccttctaatgctgtgatgaaatgctgtagagttcatcactgagatcctggaaattagagctttgttaaagatgcgtgggttttcagtcggctttaccacagggactgggatgaggtcgcatggccccaactggcagttgtggtacattggactagaatctcaacaagtgcttccgagggtcatcagagcaaggggaccaaaaggatataagggggaagcagaaggagaagggaggctggatgagtgatagcagcacacaagcctgagtgtcgcatggttcccgtattgtgtcagttttgtccatggagaacagacatttagaattaagaatgtatccaagacagacaatagggataggaagcagaattagaggagttcgagaccagcctgggcaaggaaagcttttgatcatgatgcagacccaacacctatgaaagggaagcgggaggcagcaggtttgggcagggagagcctcagataatgatgcagacctgaagtcttggccacttgatgggggagctccctagcaaagcccacccattagaggggtctcaggttgggcagaaaggacagtccctagtctttctgtgggtcagtcattggccagaggctactttggaagaacgtgccttcagctcagaagctaacacaagtcttgggatcctcgtggtgccaacagctggaagctgtcagccctctgcagtccttgcagatgaatggcaagttcggttttttttgttctgttttgttttttgagacaaggtctgactgtcacctggggtggagtgcagtgctgtgatcatggctcactgcagccttgaccttccaagctcaggcaatccttccacttcagccacccaagtagctaggacaacaggcccggctgtttcgtttttgttttgtttttttttgtagagatgggattttgtttttgtttttgtttttttttttgagatggaggcttgttctgccacccaggctagagtgcagtggtgtgatcttggctcactgcaacctctgcctcctgggttaaagcgatcctcccgagtagctgagactgcaggtgtgcaccactatgcccgcctaatttttgtatttttagtagaggtgggatttcaccatgttggccaggctggtcttgaactcctgacctcaagtgatctgcctgactcagcctcccacagtgctgggatcacaggtgtgagccaccatgcctggcgtagagatgggatcttgccatgttgcccaggctggtcccaaactcctgggctcaggtgatcctcttgcttcagcctcccaaagtgctgggattacaggtgtaagccactgtacctggttaagttctttcttgaaaaagggatcccagtggaacacctccatggttgactgccacaggacctcagttgcttggacagggagagtctctttaaagagtaaagaggtaaaatccccatctgagacccgctgtaggcgttgagattgcaccatcttttccagatggaagctcctcatcccctctggggtgtttctaaggcagaaggcagcttctcagctgctgctgcttttctagccctggaattggctgtggtggcagcaggattcctctgttgtggtatctgcagtcctccgagttgggacatcatgacttaacatggtattgcagaatggataagataaatagatccagtaaaagatatgaaaatttcatgtctgaaattttcagcctgggcagagaaagttggtgaccacatctcatgcttcctaaaaggtcctagttaacagtccttcagtttccaaccaggttgtcatcacctcattgtcagggctgctgggcatggttgtgcaatttgtgtactgttcaaaggcatctgcttagagagttgagtgggcctggcagggttgtagcaacccagaggaaggggtgccgttttgcaattttgcctttttatattcacacaaaggtgcccaaagtgttaaagaagtcttagaaagtgagtttagaaggttttccctagtcccagtaccagcttattatttgttttaaatttgcatgtatgaaattaaaaagttaatgcaaattacatgaaataaaagctgctcaggtgcactctgtattagttatagttaatgctaactgtggttacagataaattccaaaatagccacttaagacagttaaagttgattgctgcctcatgtcgcatctggtgtgagttgggggccatcagcaggtggttgttagagactcaggctggtggatgctcctcttcagcatatggctcccaaattgccctgaatctgccagcagtcgggagaggagaaggcgtgtggaggaccctgcccgaggttttaggggccaggcctagaagtggtgcacattatttctacttatgttccactggccagactcagtcacagagacccactgacatgccaggggactgcatcaagcagagagcatgcatattggtaaacattagtgtctctttgtagacatgatgaccattctcaaccacatttgcatcagtattttattacaaaaattttaatcagaaaaattaagacttacatagtaaacacccatgtaccaaccacctagattctaaattaatattttgctgtatttgctttatttgtacatctctatattcattcctctacccacccattagtctgtcttattttttgatgcatttcaatgaaatggtagttacctctacaattctacatgatatactatacccttattgtttcttgatttgttagttttcaagcctctctactactaacctgcactatgaaagttgaggaattaagcacattttccctgctatatattctcctcactccccgtttctgcaagtcatacttaaattttccaaatccattgttagtataaaaatgctagtggtagaatacaagtagtggtatacagaagtttactgtaaaagtccttccactttgctatatgaaaatttcattttgagaccagcctggccaacatggtgaaaccccgtctctactaaaaatacaaaaattagtcgagtgcggtggtgggcacctgtaatccgagctacttgggaggctgaggcaggagaatcgcttgagcccgggaggcggaggttgcagtgagctgagatcgcgctactgcattccaacctgggtgacagagtaagagtgtctcaaaaaagaaaaaactttaaaattctaaggtaatctattgttttccacttctatttcttgactcaccagctttaaatagtgtcctaggcttcgtcacaggtaaatgaggatgtagtgcccctaaatgtcttctgccttattctcaagagtccccctcctgcacttattcccagtctgcctctggacctttcacatggctagaacattttcattctgttccataattagtattagtaagtcttctgtgcatcatttataggttaattctaaaaatggaaggcctatcagcatttaaaatatcaggatctcatgtattatttaatggagaaccaggtagtatgtttagatttatagagaagacagtggcatcttacattgcataacgcgtgatctgtgaagacaggaggaaggagtaaggagaatggaaaggagttggtatgaatatgctctttacttttaaaattaatatgcttttatcctgttactcagtttctgtcttttgcagactgtaagagggaatttcttttttcttaaaaacaagaagctagtctgccttttcatactcagttctgtcacttctttttttctttcttttttttttttttgagacagagtctcattctgttgcctaggctggagtgcagtggagtgatctcagctccctgcaacttctgcctcccaggttcaagagattctcctgcctcagcctcttgagtacctgggactacaggtgcgtgccaccatgcctggctaatttttgtatttttagtagagacggggtttcgccatgttggccaggctggtctccaattcctgacctcaggtgatccgcccacctgggcctcccaaattgctgggattacaggcatgagccaccgtgccctgctctcatttctgtcacttctgccctcagacttcgggcaaataattttttatttttttatatatatattttttagacagagtctcgctctgtcgtccaggctggagtgcagtggcacgatctcgcctcactgcaagctccacctcccgggttcacgccattctcctgcctcagcctcccaagtagctgggactacaggcacctgccactgcgcccggctaattttttctattttttagtagacacagggtttcaccgcgttagccaggctggtctccatctcctgacattgtgatccgcccaccttggacccccaaagtgctgggattacagacgtgagccaccgcgcccggcccaggcaaataatttttcctcgagcttcaaattctttatctaggaaagggaagagtaatataacctacattgtaggattgttgtggtgattcataggttaaaacatatgaaggcttaaaatagacacacatagaaagcacctgataagttttagctgttaattcttcttaaccctccaacataatactttggtttggactggttgctttctagtcccatctcattctcaggttagttcattatttcttggatcctttttctcttttttggattctctttgcttttgtaaaagtgaagatgtggctgggtgcagtggctcacgcctgtaatcgcagcactttgggaggccaaggtgggcggatcacccgaagttgggagttcgagaccagcctgaccaacatggagaagccttgtctctactgaaaaatacaaaattagccaggcatggtggcacatgcctgtaatcccagctacttgggaggctgaggcaggagagtcccttgaacctgggaggcggaggttgcggtgagccaagattgcaccattgcactccagcttgggcaacaagagcaaaactccatctcaaaaacaaaaaacaaagtgaagatgcatacatcaaatatcaatggtaatacatagtaaaaaatctaagaaggtcaaatatatgttactgtaataaatgtcagtgggttaagctccccattaaagagcttcccctaattaagacagaaaatcaaatatatatactgcagaaaagcttgtttatacgttactttgatttttaaaattaagtcatttaaagttgtggataataaaaaagtagctcttgaaattttcaagttcaacgtcttgttattccatatgttctatttacaaatgcagtaaaatttaataagcactctttaagagcatctggttaaattgagttctgtttacaaactttgctaataaaattaacattttaatttgtgtttattaatttagtatatttaggttcttgttaaagtctgacaaaaaaatccagtttttaaagtcttataaatttaataattattctaataaacttagtgattcttaagtcctcttatatattccaaaacatttatattctctctctctcttttttttttttttgagacagtttctgtctctgtcacacaggctggagtgcagtggcagggtcagagcttactgcagccttgacctcctgggtgcaggcggtcctctcactgcagcctcccgagtagctacgactacaggagcatgtcaccacccctggctaatttttgtgttttttatagagacggggtcttgctatattgccctggctggtcttgaactcctgggctcaagctatcctcccaccttggcctcccaaagtgctgagattttataggtgtgagccacagtgcccagcctgtattctctctttatatgtgtgtatatgtagatgcaagctttccaatttaaaattacaaattaattactcagttacatattttgaattggaatcgcaaggttgaccctgtaactctttaatagatccaattctcataaacattaaaagtataattctataatgcagatatttcttaatatggaattctattactacttgtctgattcttttgattatttccccacttgttctaaatctttctaggattaaaagatgtttacataagtgttttattccaaataatattgggatttcttcccatgtaatttttttttttttttttttaaagagacaaagtcttgctctgttggccaggctggagtgcagtggtgcgatgctggcccactgcagccttgaccttcctctctgccccagcctcctgaagtagctgggactacaggcagtgccaccatgcccagctaattaaaaaaaattttttttttggtgcagacggggtctcactgtgttgcccaggctagtctccagctcctggcctcaagcggtcctctcacctaagcctcccaaagtgttgacatttgccaccatgcctggccccatataatttttggggttgtcttctcagtttgctgaggttttttttaataaacagagatctctgacagggacaaggttgggattcttaccctacccagacttcagatatcagcttgagcaacttttgctttggttggaacatattctttaacatatttggtttgagcatattcagggatattctgtgcttgttagttttctcaaccttcatctgaggataatgttttgcccttaccctttatatactttgcccgggtatagaattcttgttcaccacctttgtaatctttctgtagcatggacttcaaaacttgaagaaagaggtgtcataatactcatgtgccttagattcaaattacatttaatttgtgtagcttctaatagcctgagacccccattcgaacggccatatcacctgattagagtttacacttctttagcacttaaaatatataaatattttcccatttaactccaaagaactttgacttgatagaatactgcctggtttttttatactttctgtctcttaaagcagtatcttttttaaaaaaattaattttattttaagttaaatttattttaaaaagttaaatttattttaaggatacacgtgcatgacatgcaggtttgttacataagtaaacgtgtgccatggtggtttgctgcacagatcaacccgtcacctaggtattaaagccccacgtgcattagctgtttatcctgatgctgtccctcctactacccccgccctgacaggccccagtgtgtgttgttccccccaccccctgtgccgtttccatgtgttctcattgttaagcttccatttataagcaagaacatgcagtgtttggttttctgttcctgtgttagtttgctgaggataatggcttccagctccatccgtgtccctgcagagggcatgatcttgttcctttttatggctgcattctgttccatggtgtatatgtaccacattttctttatccactctgtcattgatggacatttggattgattccatgtctttgctattgtgaaaaatgctgcagtgaacatacaggtacatgtatctttataacagaatgatttatattcctttgggtatatattcagtaatggaattgctgagtcaaatggcatttctggttctaggtctttgaggaatcgctgcactgtcttccacaatggttgaactaatttgcattcccaccaacagtgtatttctccacagcctcaccagcgtctgttgtttcttgactttttgataatcgtcattctgactggcatgagatggtatgtcattgtggttttgatgtgcatttttctaataatcagtgatgttgaactatttttcatacgtttgttggctgcataaatattttctttagaaaagtacctgttgatgtcctttgcccactttttaatgggttttttttttcttgtaaatttgtttaagttccttgtagattctggatattagacttttgtcagatggatagcttgcaaaaatgttctcccattctgtaggtagcagtatccttcttgacagttaaaacaaaatgtgatttaattgtggatatctttcttggctttgtctatcttacaagataattctactgaaacaatagtatcagttaaaaacacaatacaccacagagtgtcttaaatgagataggaccttttatattgataaaagtacaattcaagaataaaaagtagcagttacaaagtccactcactaaatagcaaaacactggaaataactaaagcaaaacctatttgaaacacatggaaaaactcacaagtaaagtgggagaatttaactgtcttacacaaaccattttttcaaaattatcatggaatggttaatatattgatctattctaaggccaggaagaaaacgtcattactgttgttcaagggaaattttactggtcactctgtgatcgtaatgcaataaaactgtaaataatgaaagttgacattttaaaaacttattctatttggaaattttgagtcaaataggaattgaaaactacaattatagatcatttagaaaaataattatgaaatactaataaagttacaaataataagcaaatttattcctctgaaaacttttattatcaaaaaataaagaatgaaaattaagttctacacaaaggacattcaaaagaaaagaaacaacaaaagaaatctgggataaccggagggagtttttaaaaacggcagacattaatgaagtaagttacgactgtgtctgtttcactcttctctttcctcagtacctagcccagccttgtccctgtcagagatctctgtttattaaaaaaacctcagcaaactgagaagacaaccccaaaaattatatgggaccaggcatggtggcaaatgtcaacactttgggaggctgaggtgagaggaccgcttgaggccaggagttggagactagcctgggcaacacagtgagacaccatctgtacaaaaaaaaatttttttaattagctgggcatggtggcactgcttgtagtcccagctactcaggaggctggggcagaaaaagcctaagagtatgttctttgttaaacaaatgaagtaaagttttagttagactcatcaagaaataggataacacaaataccccaaattagctatatatatgtaatgtgtatatatatattatattatatataatttatattatatatagtgtatgtaatatgttagctacatatatgtgtttatatatatactatatatataatgtatataatcaggaatgttggatattttttaaaaactagaataaaaaatagaaaatcttgatgaaattaggaaaacaaaattaccaaaatcaattcataaagaaatgaaacacttggacagaaaaatattcttggaagatgtcacaaagtgacttaagaaaatagctcccagctgggcgcagtggctcacggcctgtaatcctagcactttgggaggccgagatgggcggatcaccaaagtcaggagttcgagaccagcctgaccatcatggagaaaccctatctctactaaaaacacaaaattagacgggcatagtggtgcatgcctgtaatcccaattactcgggaggctgaggcaggagaatcacttgaacccaggaggtggaggttgcagtgagctgagattgtgccattgcactccagcctgggcaacttgagtgaaactacgtctcaaaaacaaaaagaaaatacctcctcaaataatcctgaatccagatggtgttataggtaaagtttttcatatatgagaaaaatgtaatttctgtgctatttaaagttatgtggtatgtttcccaaagatattggatattacatattacagaggatataataagatatgtacagatgattatttcttaatttaataattaacatatgctagaaaaactataacttgtacatttaatctatgtctgttgcttaggatcaggttaagtcaaagaagaaattagtcaatattaagtttatgcagaaaaatattaaacacataagacagctgaatgcaaatatagccaaaattatgaaggtgatattcaaataatagaaacttgaaaaatattccaaagtacagaaaagatggaaagcattccgatttgttttgataaaagtagtactaatactgttaatactgtttctgataccaaagcttttcaaagatggtatgaacaaagaaagccacagtatattcttactaatgtagatgctctccttaactgacatatcagccacatttaatccaaccatgcatttaaaaaaacattacaccattggctaaaaagtggcttattctaagaatgcaaaaatattattatataaatagaattggaaatatcagtacatttaaagataaaaattaacatcatactgtatgtcagtaatgcatttaataaaatttaacatctacctcataaacatttaattcctgttggaatagtctggatcttttctgaagataaataaaatgctctaaaagcagcacataccatgcttaacaggaaactaaaaacatccccataaaggtcagggacaaaacagtggtgcccatacaagactgtatgacactgttttcaaatatactagccaaaccagtaagattttaaaaaaatggttattaaaaaatgagaaaaaattagcattatttgtagatactagaattctcttgttagaataaccaaggagatcaactgaaaaagcatgagaacttatggcaatttagtaaggtaaccagcttggaaatgagtatataaattcagatatatatgtgtgtgcttgtatgcttgaatgattcagatatgtatgtgtatgcttatatgatgtagatgtatatgtaacagtagttttatgttagtaatcagaaacgatggtatattttattttatttttttgaggcagggtcttgctctgtcatccaggctggagtacagtggtgctatctgggctcactgcaacctgtgccttccaggcccaggcaatccttccacctcagcttcctgagtaactgggactacaggcatgcgctaccacacccagctaatttttgtattttttgtagagacggggtttcactatgttgcccaggctggtcttgaactcctgagctcaagtgagccacccacctcagcctctcaaagtactgagattataggcgtgagccactctggccacaatggtttgttaaaaggtttcattcacactatgaacaaaatgtataaaacctgaggaagaaataagaagtgtgcaaggcctctgtgggagctataaactatctactcaggggcatagatacaaactatctcctcagaggcactggtgttgatgtggtaggtgtcctccattaagtggaggaattatcattatatattatagttctgaaaatcagaaatagctgctgaattttccaaaatgccttttgggcattcacacagatctatttttctttttagatagaatgatttgatggatttaaatatcttcaccttacaataaactgtgtcaggtttttctaaatcttccttttggaatttttttttttttaacatgaaaggtgaattaacagcattaatttttcttggtcccttattgcgttatatataaaataagggtatgtgtgcatggttagttctaaagttcctgataattttaacattctgtgatcttatggttttagacattttttcccaagagacaggggcttgctctgttgttcaggctggtctcgaactcctggcctcaagggatcctcctgccctggcctcccaaaatgctggtgtaacaggcatgagccaccgctcatggccagacttttaaacatttctaactcagagaagtgtttggattttacctcttgaatgtgttgcgccaatttgctttaggtacgggatttctagtttgttgaattctattttacttacaaaaattttttatatggctccaatcagatcaaaccagcctatgtagtatcatagaagtaacattaaaatattgagaattttgaagggttccaggtatcctgaagactttaccgtcacaggacaaaaacacttatagggctgtccttccaccagacccagcctctgctgttccattgcccttgctgccctcctccgtccagtttgtccgctaccttcttgcttagccaggatgtgtgttgtttggcatctgccttcacatggacattgtgctgcagttggttgcttctccagctaagtaagaactgtctgaggatccatgtttatctttgccatctccatggtctccaacactctgcagagtccttagcaaaatgtatggttttaatgaattgatggcagctgtcccttgtatttccaggaaagttttgaattctcaggagaaagtaggtttgatatttcaaaacgaatgtggttggccaaatgttttatattgggattaaagaaattattttagtaccacaaacttccagaaagcttgtccataagagtttttcctcaccccacaccactacaaaagtgacccagaaatcctgagccagtggaactcccaggggggtgcaggtatcactgggaccttgcccaccctactgtctcctttcatccctgtcccagagacctaacatcaccatggtctcctttccctcagtctttcataagtatttgtaaatactcttttaccaatatcattctttctctgttatttttcctttttaactgttgctcttttacttcagaaaaatttttcttttttcttttatgctcccctcatttccaacttcctgttccaaattaagcctaattatggttgagtgttaagattacggtttatgataaacctagaaagataaagtaatacatttttatgtgaaactatatctagtaaagaactggtaccaaccacctccaaagcccttgaaaatcccctttgttttatctgccagagaattcatctctttctctaattggtcctgcttttctctctagcacaagcagccaaattttaaaaaaatcttggaaggttacattataagcagtctaaccttttgatctgtaagcagataaacagagtctattcatagtggtaaaaaactgttatgaaaattatctgtttatagttatattttggcctcttttgctctcccctcagtcgtatgttatagtatgctgaagatacatggaattaatatacttccaaactggaccaaaaatgtcatataacagcctgtatttgcaggttaacaaagtatgagtgagaggggtatgtggctctgagtgctttgtttgcctgtttgtatttgtgtttctgtgttcctcctgcacaacttccctgacagcctgtgctttatgctttcatagggattttgaatcataagggaaagaagaaagattgcaaatcaagagataccagtaatcagatcaatgatgaaattttagtgtaaactatacattaaaatgacttcttctgtaaattttggtatccagaaccttatgctaaccctttcagatagaaaacagggcttgaagtatcacaaacatgcctttttcatttactgtttttttcattacttaggttattcctatttttttttgagacagagtcttgcgttgtcacccaggctggagagcagtggtgcaatcatggctcactgcagcctcgacctcccaggctcaagtgatcctcctgcctcaacctctcgggtagctaggaccacagacgtgtgccacctcacttggctaatttttttaaatttttagtagaggtagggtcttgctgtattgctcaggctggtctcatccctattaatgtgaattctggtaccagctttgactctggagatgctctggggcttcttgatggctgtggtcagcccacaccatggtcatgtgcttgccagcattctggtcattcctctcttatctgctgcctctaatctgttcctgtgtgcctggagactggtagccaaacctgccagaactgtatacagaccagaagtgcttctcctagtagtatgcaggtgtggagtttagggcacagtcattttgagcttctctggagctctcttccttttcccgctgatgacattatctcaggtagctgagtggccatagaactgagtcttagataaagtgtcactgcacaagcatgtggtcaggtgctgttcccctgccctggcacctgtggaaggtgtgtgggcctcctttctgttgctttcttgtaccacaccacaccccttctggcctcagggctcctgcatgggcttctctgtgcctggatgctcctctctcagcgtgttacagctgatcctccatgggttgactgcaaggcccagtttgcacaggatacttccagttaacacctgattgtggatcagtttactcctgttatttttactctcaaaaagtgccccaatttggaagataaaatatactgtctcctacttaaccatttcaggtctcagtccagtgtcacctcttcaggtagacctttccctttctctctcagggggcaagtctcctggtttgctgtgactgcagaataaaccccagggcttggttgggctgagccagggtttgccagcagacaaattcaggcttctttctatgtgagggcccatggcaggccagcgtgggaggacgtgagatgggaggggcagccaggtgctgggagggttgggagagacatggggaggaagagtgaggactgaagccagggggaagaaacatggaagtgtgctgtaagctctgtgcccactagcccttgatgagttttaatctgctttacccctcaaggctgtaagagtcagatctgagtgttttgaaaatgagacggtgtgtgcgattaacttgaagagaactgatacaggagagatctttggtgaggcctgattataagtggatgacaagcttcatttttcctaggtgataggttggactgttagacaaaactttggattcagagaaaaggcactctaggtgcattttgcctcctttctttaccttgatggattttcatgttggtcaaatgaagacttgggctacatctatgaaatcccttccaatttttagaagtatataattctgttgtacgctctagtgagtccagactataaagcattttgaattttactatttcttttcccctaattgtgggccagaaaggaaaatttccaaataaggatgcacagtccactctgggaaacacagggaaacaataactagaatacaagtctagcctttgccctggcatgaaaagaatgcagactgttagctgacctaaaggtttctgttttatttcacgtttaggtgaaatggtcagctttgaccattactcccaaagaagtttctctccagactttaagatatttgtgcaacattaagatggttttattatctgtgagacagctgtggtcacttttatttatcaaagtgccatgtttattgtatatgtatcaggagcagtgctggaaagctaaatttagagaaataaacctgggctcacaaatgattatggtgacattcagtatacccccaatgacactatcactataacattgctaggtcgcctcccagcagtctagccatctcaaccataaaggaatggcgaagtaatgatggcaacttgccttattggagagtgtgtagactgccgttttaaactgtaattgtcaggattagacctcaaccgtggtgaaatgttgggcataaaggtacatgaacaaagctaagtgcaaagttgtgtgaatgctgattcagtctttgtgaaagtacagtccacaggacacaaattggcaaaattcatttgccttacagtgtttaaagttttttgaattataacattttgggcctgagttctccacttgctgcagtttctgccagcccctttgttctttacttggctcttgcaaacatttatttacctatttagctctatagacagttgaagtttttggtgttttttttttttgtttttgtggagacggagttttgcttttgttgcccatgctggagtgcagtggtgtgatctcggctcactgcaatctccacctcccaggttcaagcgatcctcctgctcaacctcccaagtagctgggattacaggcatgtgccaccacatttggctaatttggtatttttagtagagacagggtttcaccacgttggtcaggctggttttgaactcctgacctcaattgatccacctgcctcagcctccaaaagtgctgtttacatgcctaagccactacacctggctggcagttgaagttttgacccctgtttaaaaaaagaaaagactattataatactggaatttaaattacaataaaggtgatttttaaataaaataaattttaaaaattaaattgatatactgtaaatatgcagttaggagataattgatcttcctggttacttcccagggaagcaggactcaagacccagatttgtgtgcagagtttatgggggttgcttctgggaacagtaccaatgagggggtgagggaagccggttgggcagagggagaagctaagatggatgcagctgcgatagctgcctcttcagtcccaggggattgagctggaatgggccttcaccgtgtcccaaatggagaccaggtggtcacatcagtctctcccccccatcagtcttggaggggagtctgcagagaatctgtttctttgccttttccagcagtcttgcccttcatttcctttatacatctcaaacactcaccgagtattttcttctttcaaaagtttattctcggggaggtggctccctggctgaccacaggtcccgccggcattcagcctggctgactcaggaggtcagcgcctagacctgactcattttcttccgctccttgccgacctcaccagggcctgcttcctggcacctcatttgaccaagccctctgccttggtcaaaatgaccaaggcaaaattttggtcaaaattttttgaaatgttagtttcaaaaaaaatcttaacctcctctttgcctgtggtgggtgggcaggccaggtcaggctcaccctgcagtgtggagggtggggtcagaggcccctggacagcctggggccgcctctgtgctccgcagctcagttttggcgggagagccctggccagttgtcaagaaagtgcgcctctgtttctggggtaatgctgtgggcccaggaccttcagcctgcagcccccagaggggatgtagtcatgccaaagctcctgatgccatcatcatcacgttagaacccctcaccaccacctccactcataagtcatttgccctaagccagcacagcacttcgaattcaggcagttgatcatcatctaagcgtgaataccattttattaatttttgcctagaaattggcactccctttaaaatcttttaatgcttttgtttactgcaagttttcttccattactttttcttctgtgtgtgccctctcctggctctctggctttcctgttatacttgtattggatcttttcagtcctctatgtctcttaaatttttaaaacttctattcatttcagtattcttagtcggtcttctcattcattgattggattttctgtagtgttcagtattgctagtgatcattattttgcaagtgacagcaatcttttctgatgtgacattttcccttttaacaaagatgtttttctttaaacatcttactgaaaattggttgactttctgaaggactattactacactggccttgctgggtatgtgggtacccatgactgttctgctcctggagattaagtactgggacttctgtagctcaggtccctagggggcctgggcctctgccgggtgggacagtgggctggatgcacatgtagggtaggctttagtgcagcattcctagtctgtgaacttctcctgtgtcatgccaagggatttgaatccaggtgtgaattcaactactcataaaagagaaccatactgacctatggcacattgagtagagagtattttttaaatgaattaggcctgatttaaactatattcagcccccttggcttatgtaaatgcgcaaatttctgcagattctctgcatagaagtttttttcttcatgctttctggagcgaaaattcttatcctggcttcctttatttactagctgtaggatcgcaggctagtttcttgcttgcttgctacattcccctcctgtgtaaaatggggctgttagtatttccttagggagttctttgaacaaagcccagaagttaataagttctcaatgaatgttaataaatgttaaataaattatcagaaaatgttagtttcaaaaaatcttaaccccttctctttttcttttgtcttctccgcctcgttttcctacttttcagtcattttacttgagggtaggcaacatttcatttctcaccaaatgcagacaggtgcttctccctacttccgtgtccctctccttctcccactacccttcttgccttctctaaggtattatttatgtagtcagggagtgtattggttcctgttgctgctataacaaataactacaaatttagtggattcaaaaacaatgcagaattatttcctggcagttctagaggttagaagtctaaagtcaaggtactggcagggctgtgttccttctggaggcttcaggggaatatcagtttccttgccttcccagcttctagaggccacaagcattcctcagcttgtggccccttcttccctcttcagagtatattgcttcaacctcttgggctgtcatcacatctcctttttccgtccctgattgtcttgcatccctgttgtaaaaccctggtgattatattgagcccagcagagaattcaggataatctctttatctcaatatccttaagcacatctgcaaaatccctttgttgtgtgacatactcacaggttctagggattaggatgtggacatatttgggggattgttattcagtgtgctgcaggaaggtagatgtgtaaaccttttatcatagcatagtgcaggtgggacttgcacagcggtaccctgagccaaaggtgtggacctcagacaaggaagcagttatttctgaggacattgggaaaagtttgatagaagagagatgtttgagctgagtcctaaaggatgaagaggccagggaagtttggaaggcttttaggctgaggaaacaacacttgctaagaaatagacttgtaaaaaaaatccagcaattttgaggaatagtgaaatctttgatgttgctaagacacagggtatattgaggagagtggtaggcaaagaaaattgtaggttaaaactagaatgtgctgtgataatgagcttctaatgtatcctgtaaagagaggggagccagtggagttgttttggtggcttttcaattataaatttttgtctgattgtgtaagtagttttcttcttctagaaaatgaagaaaccaaataaatagatcaagaaaataaaatcattcaaagccctgctactcagagataatgactgttgacatttctgtgtagtgtcattattgagccatttgtgtgtctgtttacccagttgaaacctcactgtatattaaatttcatatcttgaattctttagttaacggcatatcaacatttcttcatgtaattaaatactctcaactatccttaacatctccataatatcctattgtatatattaccataatttatttaatccttcattgttagattcaatatttttgtattttattttatttattattattttttgagacagagtctttctctgtcgcccaggctggagtgcagtggcgcgatctcggctcactgcaacctccgccttctgggtttaagcaattcttctgcctcagcctcccgagtagctgggcccacaggcatgtgccaccacgcccggctaatttttgtatttttactagagacggggtttcaccatgttggccagaatggtcttgaactcctgacctcgtgatccgcctgcctcggcctcccaaagtgctgggattaacaggcatgagccacctcacccagccatattttattttatttatttatttttgaggcagggtctgtcttgccctgtcacccaggctggggtgcagtggtacgatcactgctcactgcagccttgacttctcaggctcaagcaatcctcccacctcagcctccctagtagctgggactgcaggcatgagccaccactcccgactcctctctattttaaataatactaacacatagatctgtgtttaagtttttgaatgtttcctcagggcaggagtgcttctcctctgtttattctcttgagacgtgagatcaggtagaaatgttcccgtgtctaggtggaggagaccccagtgtgccctttcatttactcctgggctctagagtggaaacttctgtgtttttctctgtgtgatgatttgtgtgggtgccaagggccaaacccacatttagcaaagaaatagtgtgatccacttaaaagggggtttaataacttgagatggagatatcaagctgaacattcacaacaagcataactaaatcagagaggcagaagaaagcattaaccagaaaaataagtactaacttttaaagagtgattactcctgatttaaaacttttactagatgaaatacaaagggtaacagactgtgttgagaactgaattaattttctggaaggagtgtcttgtaaaacaaagatattgtgaggtgaaaaatgtaagatgcttaagggatctatgtaggagacctaataattgaatgataggattcttagaaggggacaaagtaacagatggaaaatacatcgtattataaaagaagaaacccatctgagctgaataaaatgttagacttcagattgaaaggactcatggaattcttttttaaaagacaattgctggactgcagcaataaagatagaaatcctgtcaacttctaggcaggaagataggtctgttttgagggaaattgggatgccataggaattcttacccacttcacaaagaagctagaatagagtctgtatggattattgactctaaggaactaatataaatcttctgtattcagacatatcagcctgggtttttacttgcatgccacagaagctgattttggttggctaataaatttttaaagatgttgagttgctgtgaaattgttagaagggctagagagagatgtctgcaggcactgcagccagggacagcgcatcaaatcttacacagaattggcccaggccggatgctgctgctgtgttcctgggcgtagacagtgtagcttgcaccagatgctgcaggcactaaagtctacagtgagtgccttggccactgctttctgggatcttgatcttgctgcagctaccattcttgcagtgagcattttccatcatagtccttgctttgcagcattagttcctgaatcaaagtctgggacaggtgtaaataatggcagggtcaagggggcctcctagctgcaagggggcactgagaaggcaggcagctggcatttttagcttatttaatgggaggtagaccctacctttaactgagactaataaggtgggaaagtccccaggcttaggaaagaagggttcaaaagctaggtagtcagaaagaatgtcagagatcaagtactcttgcccagatataattcagcgaaccagggcaaaagaagaatatttttagccatgagggattcatccatctcatttgaacaaatattcagatgtccaattggatgctggtaattggctcagaatagaaatatgaagatagaagaaaatgaataatataagtaacagtagagagcagtgaatgttgcagcaggaaacattgcatacataaatggaagatattaacacggctgaagattcagaatgtaagtgtaaagtaagaattcttggaaggatcgtactgccttggaacatctaggaaatagcgtggaactaaaaattctagaccatctcagcaaaatcctgaactaggattgcaggcattcagatataaaattcctctaaaaatttcatctttgttggtgtgggactggggggcatggttatttagtttggatgaaggtttaattaagagtgttagaaatggcaggtaactactaaccaagtagtaaaacatagtattcccaaaataacagggatcaaggatgatagtgagcacagaggtaagcaggccaggaaggaataaagagaagtaatatcaaattagcaaaagcgaggagaggaaaaagatgaaatgagttaacaaatagtaaacaaaatcaagtggaaacagtaaagccaaatgagcagccccacagtaaatactcatcagctaaactcacctattaaaaaacaaaggtccagaatattagtgtcagagcaagatgcaagaacaaaagcattgaacaggactaagaggtactatatattggtagaaaccaaaaatataaagtataactgcctttaagcagcaaaatgcatagaacaaacaccaggaacaaaagaatttggtaagaaacatattctactaagagatgctaattatgtgtcttttctaatttgacgggtcagctaagctaaattgccaacttggatgctcacaggggccggtgggtggcatgaatatgtgaattatatggtgagagaccagggatggtgggaattgcacagcgaactggataatgcatgtcttgcctaaaggcattgaaattcatacattttaaagcactttgccagccaaacaaaatatatttgtagcttgcttgcagcctgccagttttcaacctttgaaacaaaaaagcaaaagtatagaggttagaaacaacatatgcaacaaatgtattgcatatgttgcaaacatatttattgcgaaaatgtacagggaatgtacattttcccctaggtctagggagtatttacagaagttgatcatgtcatttatcacagaaaacaaaaagtgaaatatgaaaattttgatttttgtatgcaataacctgtcctgtcagtccagtgaaattagtggtaaaaaaaaagagatgattataacaacaacaacaaaaactaccttggagttaagagccactgttgtaaaataatctctgcaccaaaagaaaatctagacaaattataaatcatctagaaataaaagaaatagaagccttttgatatcaaaatttgtagaatagaactgaatctatagtcaggaaaaagtataatcttagatgcttttattagtataagaaaagaaagactgaaaatataagagcgaaatattcaacttatgaaactagaaaaaagtacaaaataaagagaaaggtaaaagctgaaatgaatgaaatagaaaataaaatggtagagaagataaataagaacaacactagttctttgaaaaggcaaataatggaaattattcttgattaaaggaaaaaggaaaaagtattagcaaagaagaatccattgttataggtatggaataaatgaaaaattaaatctgcagcaatatttgtgaaactctggaggaagtgggcaatttcccctcaaaatataaattcacaaattgttttctagaaaaaatataaaacctgaagtattattgctagtatttaacattgttttggtattgatgcaataaggcaaaaacattttttgttttaaatactgaaaaagaggaaaataaacttgacctaagaataagagaatttgtgattatatataagataaatataaaaacaaaataccttttttctatgccatcaataactggttagcattggaacgtgaaaaaaaaattcaattcacaaataccataaaatatctaggagtaatttaaactagaaaattataggacataaagtgaataaatattaaatcttactgtggttcataaaacaagacctgagataatggagaaactgcagtatgttccagggtgggtagatataatgttataaaattgtccttcccaagtagcctgcttaagagactaattctccccagaatttttcattaggaaaaaaggaagctccttacatttaagtcttagaaagtgtctttttaaacttggcatgttcttaataactttatttttgaataacgaagtaatacttcagacaaacctcaattttttctttttctttctttttcttttttttttggagacagggcctcactccactttcccaggctggagtgcagtggcatgaacttggttcactggagcctcatcctccagggcccaggtgattctctcacctcagcctcccaagtagctagaactacagttgcacaccaccatgtcccgctaaactttttgtatttttagtagagacaaggttttgccgtgttgctcaggctagcagcaaactcttggactcaagtaatccgccttcattggcctcccaaagtgctaggattacaggcatgacccaccacgcccaacctcttcaatttattttaaattgagttttatagaggccaccggacagaatcggtttaaaaaaagatagacaattttgttttatttagtacttattccattgggtatgatctcatagttacaagtattgttgaattgaggctttgaaagactatataacaatgcaataattggttaggttgtagagatcacaaatgtatacctacaggaagaatgtttttaaaaaaactgacctaatgtcatataagtacgtatttgtgacttagtataacattttcaatgacagcgtaatactatcattggattcagaaagtactgagtctcaagtagcttagaggatagaggaaaggggtgaagaaagagagaaccaaggtgatgcatgatacctgcactgcctgttaaagagagcttccagaaaatgcttcatccgcttggccagaacctagccatctggccacacccagctgcaaaagacgttggaagtgttctggaaccaccaagtgcccaacaaaaagttgagttaatgaggaagaaaagagaacaaataatggggtacaactagcctctacttggacataggtagtactctgggggaaaacattataaaatatgctgaaatattagtacgcttgtaaacaaataaaagtaaatgccaaaagaggtggcggtagaggtcagtaggtatagggtgatgagcaatcaagtggcaaaaaagaaaaacaaaggtgttcaacatcagtagtaatcagagaaatgcacatcaaaagaaatcacttttcgaccttcaaaaataataacttccagtggtggtaagtgtacagagaaacaattactcctatatgtctacccctgtggtgtgtgaatgattgcaatcttttttataaagcaatccggcaataattttgagattgaaaatatgtttctcttgaggaatccaggaattctgtcttgtagacataaaagcacaagtacatacttaacgttgcaaatgtaggaaaagtttgctaattgcagtactttttttgttctggcccgaatctaggaatactgaatgtccctcagtaggaattggttaaataaattatagtacagtcatcctcagtatccttgggagattcattccagaatctcctatggatactaacatccacagataactcaagtccctgatataaaatgctataaaatggcatagtatttgcatttaaactacgcacattctcccatatagtttaaatgatgtccagattacttatactacctaatacaatgtaaatgccgtgtcatttgttgttatactgtattgtttagggaataatgacaagaaaaacatgtctatatacattcagatgtacccatccctttttcccccaaatatgttctatctgtggttggtagaattctgggtggggaacccagaaatatggaaggccgactatatcattcttatgaaattttattaaataagaatgatgtcaaccgggcgtggtggctcacgcttataatcctagtactttgggaggccgaggcaggcggattgtctgagctcaggagttcgagaccagcctgggcaacacggcaaaaccccatctctacttaaaaaaaaaaaaagacaaaaaattagccaggtgtggtggcacgtgcctatcgtcccagctactcgggaggctgaggcatgagaatcgcttgaacccgggaaatggaggttgcagtgagctgagattgtgccactgcactccggcctgggtgacagagcaagactcctgtctcaaaaaaaaaaaaaaaaaaaaaagatgtagaggtaagaaatattattaaaaaggacaagtgagagctatttcctgaagctatgaccaggatgtattatcaggtgacaaatataactcacaagagagtgtttacacctttatgtcatagtgcctatgctgtgatcccaaacgaaaggctaagcatgtttgtgtcaacacagagagaatgtattcttggaagaatacattctttccaggctgttcataatgattatcccaggcaagtaggggattttgattattttgctcttagaaacagcatgtattgtttttatatgtgagggcttaggggagtttagtgattaaaagtatgaactttggagcccgcatttcctgagtttgaattccagctgaagctgtgtgatcttgggcaagttatctctactgtgcctcagtttcctccttggtaaaatatttgtagaaacaggacctactgtatatagtttcaaacaagtcagtatatgtaaagtatttggtaccgtagaagttctacatgagagttctatataagagagggccggctttattatttttaaacattttaagtattattattaaagtaagtcaagggtagaggaaaggtcattgtattctttccgtggtaaagtgctgaacatattttcatcagtcctagagcttgattttgaagaacatggtgatgcagcaaaatatttcttaattatgcctttgcctcgttttcagtggagtgaagaaacaggatcagctggcctgagaaagtgcgaagcacagagttttgtatttaacagcgagtgggctttatagctgtcttcactgtgtttttggaattggctgattgtccacagaattcacactggttcgatgtctaaacacttcagtgatgcaaaaatcagtttgggaaatagagacacttgaatgaatgggttttgagataaaaatctgtcttgtcatcctcctgaggtggagcagattgcattttccagctgaggctgtgactctcccttgtcccacatgccctcctacagtgtgactctgccacttcctctgttaagggatctacttcttgaatttgggcagccctagaaccgcttcagctggtagaagagggtggaagtgctcctctgactgctgaggctaaattataaaaggctgtgcaggcccctcttgtttgcgggggcacttgtgcttggagccgtgagccgttctgtaataagtccaaccactgtgaggctaccatgctggggagactaccacatggtgctccagcccacagtccgtggagctgtcatctcagccagggtttcggatggcaggagccacctcctagtgtctatgtaagaatggcctagccaagctcttcccaaattcctgaccggcaaaatgatcagaaaataaaacggttgtgttaagtgatgaggttatggggaaatttgctctgaaacagtggtggcaggaatgtaagggttagtaaacagcagcgactctgtgatgaaggaattcattcattcatgttggaaagacctttgcagagccaacctccactactccttgcacccagattgatggtcccatgaaccagaagcatttgtctagtgataatcacaggagtcttcaagtgtggtgtcctgttttgtatttttatttatttattttttttgaggcagagtctctctgtgttgcccaggctggagtgcaatggcacgatcttggctcactgcaacctctgcctcccaggttcaagctattcttctgcctcagcctcctgagtagctaggactacaggcgtgtgccaccacacccagctaattttggtatttttagtagaggcggggtttcaccatgttggtcaggctggtctcgaactcctgacctcaggtgatccaccctcctcggcctcccaaagtgctgggattgcaggcatgagccactgcacccagcttgtgttttgtattttttatttcacgttgcattttaactacagacacatcttggtgatgttgtgaattcagtttcagaccaccacaataaaatgaattacatgaggtttttggtttcctggtgcatacaaaaattatgtttacactatattgtagtctgttaagtgtgcaatagcattacatcttaaaaaaagcaatgtacatgccttaatttaaaaaatattgctaaaaaatgctaacgaagtaagcccattctgttggagaaatgacactgatagacttgctcgatgcagggttgccacaagccttcaatttgtaagaaatgtattatctgcaaagcacaaaaaagcaaagctcaataaagcaagtgcttgtattgtgtctcatgtatactaaaagtatgccaaatggtttacgtgatttttgtatgtatgtatctgcttatgagacagggtctcactcccatcgctcaggctgaagtgcagtggtacaatcacagcttactgcagccttgacttcccaggctcaggtgatcctcccacctcagcctctcctgagtagctagagctgcaggcagacaccaccacacctgggttttttttgtattttcagtagagatgggtgtctcactatgttgcccaggctggtttcaaactcctgggctcaagcagtgctcctgccttggcttcccaaagtgctgggattatagatcataggtgtgagccactgagcctggccaatttttgtttttaattgttgcctgatgtcccctgctgggtcctgaagtcttttgggttggtttgttttcaactggcacactacaccagttctatgtgctgtattaattatacaggtttgagtatcccttatctgaaatgcttgggaccagatgtgttttgaactttggattttttttttgtattttggaatacttgcattatacttagcaattgagcatccctaatctggaaatctgaaatactccaatgagtgtttccttttatggtcatgtcagcactcagaatgtttagggttttgtatttttttctgaattagggatgctcaacccgtaccagtatactacaccagggaactgactcggcattggtcagaccacattttgaacactttttggttgacttcccagcatttaaccccgtcttctcccaggaattctctttagctaattcccactttaaagtgagtcagcatatcaccctggtctcagtgagtcaaggatggcagagactcaatcagaatgagtgttgagtagatgttttttggggtgcctgggagagagtccccgctctttgctggatttgatggtgtgcagatgtgagccctggagctgccagtaccatcacatagccatgagggcaggcagcttattgatgaaggtgacctgtggaggaagggaggagcagaagatggagagaaattgaccctgagagaacatctttcagttgagccagacctgaagttggacttgatcctagactttcagttatgggagtcaaaacctctttttattgttgtaagcttgagttgggttttctcttgcaaccaagagatttttaactcacagaaacccacatctgcagtgtttctgagattctgggtaatatttcagagggaccttggtaaatcagaagctctctaggcagtttatccaatgaatggaccccgggacctatgaggcctggtgggaagaattaggaatgttttgagtgaagatttagaagaccaatggggaaacaaagctgcctgcagacattcagatgtcacgtggaagaggcaataaatttgttctttgtggttccagagtgtttcagaactggaatcggtgtgtgccatgttaatgaagatatagaattcagcctcatataaggaaggattgtccaactatttgagctgctcaacagtggaaggggctgtctagtggtgggtttccttttactgaaaatattcaatggtaactggaacatgagactttagtagatggcaacagaagttggatgctattgatgccactttgaatgaaaaattaggttatatgatttctgtttcttccagttctgaaataacgtgattttgtatttccttaggtatcaaaagacatccttttttttttttctttttttgggacagagtctcactttgtcacccaggctggagtgcagtggtgtgatctcggctcactgcagcctctgcctcctggattcaagtgattctcctgtctaagcctccggagtggctgggatacaggtgcgcaccaccacgcctggctaatttttgtatttttagtagagacggggtttcaccatgttggctaggctgatctcgaattcctgacctcaggtgatattcctgacctcaggtgatctgcctgccttggcctcccaaagtgctgagattacaggcgtgagccaccgtgcccggcttgtattagaagatatacttatgatgtgaccgttgggcaaattatgaagtctctcagactttgtttctttatctgtaaaataacaataataatacttttatgaactgagttttgtgtgcctcaagttaatgtatgtgaaagtgcttacaaaaccaaagtgctacacaaaggtaaagtgctgttatccttcctacatagtaaactccgattcaaaggatacggacgattccttaaatttctttgtgtgttttgacccatgggtgctttgaaaaaacaactcccacccccaaagtgatattaatagaaataaacaggattttgcgtgcccagtccatctaattatctaatttctccagttacaaattcaggtgaatttattatgttttcctggtagaacttggaagtttctcagtgatctctgtgaggtataactgaggtacacctgagccataactgtaggaagtcagggcctgattatgatctagactagactaggtggttctcacttgcatcgagcctccgtaacctggaggttagcttttcccatctgtcctgaaagtaaggctgcacgtgaatatggcagatcttttagttcactaaagcctgcaccctcagctcctccttattctcagtgtttggtgcctggagactgtgggctttattttcccacagtgctgctgggagatttctgttcagaggtgccaagctctctagttaggcaatgaggatttcatttggcctacacaatgggcaaggaagctaaggcgcagtatgcagagagaattctgggacgaagcgctcctccagccacttcagtttcaatggaaatttgatgtccctgcctgctttgcacttttcaaatggcctgtcaggagttgccctcccagagctgcttggcattctggcttctcctggagatgactaatggcagctggttgtgtgggccgcctgctagaagctagtcagaccataccattatctctcctcagaaacactgaggctttgtctgctgccctatctcccctgcatcctgacacagagcggtcactgtgtcctctccaggcctgagccccttcttagtgttagggggcttttgttcagaagctttattgtccccctctttctggagtgctgttcatagtggccgtggtacagcatgagtatttgggaaacaggaggagtagatttacaagcattttgaattctaatccaatttgctgagcaagtggagtgtgaggaaaattaattttgcattcttcccaaaaaaagtaaaatggagatgagatagaaaatgtttatccctttacaaaaatcatctttacacattgacactgctgtttgcttttaacaaaggaagtaaaatgggtgagtaatttggttcatttgcatgagtgtaggactcttttgtgtttttttccctccatttgatttgcaaagacaatttctattgacttttagtacaagttaggtatgaatctctagaaagcacaccactgagacgacccaaaagacagtccagctgtggaaaaaactacttttctgtcatagtcaaggtggggccccaagatttgataacagacttagttccttatggctgtgcatctgcttgctgaattgcctcaaacttctgttatctcatttgttctaagtccaaaggatcagtgctgcctataaagctgacggattgctaattgcctgtttccacactgtactcataaacattcatatttctttttcctaattttcattatcaaagtagtatatacaggggttaaaataatgaaccaggacaaggagcttattatgaaaagcaagactgctgctgccctgctgccctaccccttcccatttcttgtccctcttctcaaaggtaaacactttattatgcttttactgccttctaaaaaaataaacactcttttttaaagagcagttttaggcacagcaaaattgagtgaaaagtacaagttttcctatagtgtactcctgttcccaaacacactcagcctcctcattatcaacatcttccaatcagtgaacccacaccgatgtaacattgctcagagtccgtggtttacattgaggttcactcttggcattgtgcattctgtaggtttggataaatgtataatgccatgtatccaagttttttgtagagacagggccttgctgtcttgcccaggctggtctggaactcctggcctcaagcaattctcccaccttgcctccctcccttgggggtgggggatgaatgggcaggcacagtagctcacctgtgcctggctctacttattcattcctccctccccccaacccctggcaaccattgatctttttgctttagcaagcaaaaggaccatagttttacaaaactacggtctctgtagttttgtcttttgcagaatgtcatagttggaatcatactgtgtgtagctttttcagactgcttctttaacttagtaaatgcttcagttaaggttcctccatgtcttttcatggcttaatagttatttcattttaaggggtggatgatactaatagtccattatctgggtgtaccacagttggttgcttccaagttttggcagttatgagtaaagctgctgtaaagatccatgtgcaggtttttgtgtggacatatgtttttgactcatttggctaaataccaaggagtgctattgctggatcatagagaacaagtatgtttacttttctaggaaaccaccaaactgtcttccaacgtggctgaattattttgcgttcctaccagcaatgagtcccggttgctccacatcctcaccagtatttggtgttcttattgttttggattgtagccattctaatagttgtgtagtgatatctcacttttgtgttaatttgaaattgcctacggatgtatgatgtggagcagctttttttttttttttttttaattatactttaagttctggggtacatgtgcagaatgtgcaggtttgttacataggtatgcacataccatgatggtttgttgcacccatcatcaacctgtcatctacattaggtatttctcctaatgctatcccttccctagcccccccacccactgacaagccctggtgtgtgatgttcccctccctgtgtccatgtgttctcattgttcagctcctacttatgagaaagaacatgcgatgtttggttttctgtatataccccttaatgggattgctgggtcaaatggtatttctagttctagatccatgaggaattgccacactgtctgatgtagagcagcttttcatagctcattttccatctgtatttcttcttcggtgagttgtctattcaggtgtttttccatttttagtcaggtgtttcgttttccatttttttctttattgagacagtgtctcactctgttgtgcaggctggagtgcagtggtgcaattatgacttactgcagccttcacctcctgggctcaagtgatccttcttcttcagtctcctgagtagctgggactacaagtgtaagccaccatgcccagctaatttttgatttttttgatgagacgagtctcactatgcagggagaccccttgagacaggggtctcaaggctgcccagactggtcttgaacccctggacacaggtgatcctcccgccctggcctcccaaagtgtgctgtgctgggattacaggtgtgagccattacaccgagccctcattatcttactgttgagttttgagcattctttgtatattttggataacagtcctttatcggatatgtcttttgcacatattttctcccagcctgtggcttgtgttctcattcttttgatgttgctatttttttccccaattttgttgattcctcttatgatagatgaggatttaacacatggccctgcaaccctctcctagtgtcataatatcactgtttttagtttctttcttggttattgcttttagtaatgtatttcatctttatttcttgtcttgtcaactgtatatagtatctttgacaccctgtttgtaaggtgagggtggatattattgctgccatcctttttgcccactctctctgctttctcttctacctcccagtttctttcatctgtactttacctttttcactagcaaggatgacagtattcatatgttctagaaaatagtcttgcatgttctgtgtgtagtatggatattattgtgactacatatatattgtgccctgcagagtgaagttatgtgctgtgattttgttatctgtcttatacagcttatttttatgaagtttcttgttttgtgactatttttgttacaggaaagggggcccgatccagaccttaagagaggattcttggatctcgcacaagaatgaattcagggcaagtccacagtgcaaagtgaaagcaagtttagtaagaaagtaaaggaataaaagaatggctactccatagagcagccctgagggctgctggttgcccatttttatggttattttttaatgatatgctaaacaaggggtggattattcatgcctcccctttttagaccatatagggtaatttcctgaagttgctatgacatttgtaaactgtcatggcgctggcaggagtgtagtagtgaggacgaccagaggtcactcttgtggccatcttggttttggtaggatttagccagcttctttactgcagcctgttatatcagcaaggtctttatgacctgtatcttgtgccaacctgttatctcatcctgtgacttagaatgccttaactgggaatacagcccagtaggtttcagcctcattttacccagctcctattcaagatggagttgttctggttcacatgcctctgacatttcccccctcccttttataagagaacgcttaatcctaagggttgcggagggatgaagattcatcttctataactccttcaggctgaatagaggtgatgatattcctgcctgactattagggtctcttacattcagagtagagaggagcagagtcagaaagcatcagtatggtaaggtccattcataactcttgagtttcgacagagggtggtatctggaagatgaataagagtttaagaaaacattcagtaagcttgtcctgtattcctacacaaaaagtataacagcaatatattccacaagagtaaagcaaaataagtaaagttattccaagtaaactaaattagaagactttccatgaactgggcaactgttggaattaagctgatatagggttgttagctgattgtaatgtgcccagaattagaatactaatccagatttttacattatccatccctcttgtttcttctgagcagcagtcagagatcactggtaggttcacaggaataagcaggtgtagactaaattgcagaaacaaactgaaaaacagatgagactagaatttaataacaggtgtaccatagttcttgaaacatatttctctctccagttttccatttttacgaaagacaaattatggtaagactgatttgttttattatacttggcctgataatttgtataaagtgcagcaagaataattatttttcacataggctttttaattgactttaatggaactctgttttgtaagggatctcagataagactttttaaaagctgagccccatcatgggtttgtaccctcaaatacctatgagttgggtaaattcctttctttttgaggtcccaggataacttggggctcttcgacctgtgagaaagtgacattctttacttaccccaagtcagaaaccttgaacagggactgttgtagacaaggtgtgaggccagttccacacaggcttttattggctctataaatcaagtttaattccttaaaggaaaacacaccattccagtcaaaaccttggtaacataaccaatttctccaattgtgttctgttagaaaagagaacgaatttttttttttttttttttttttgagacagagtcttgctctgtcaccaggctggagtgcagtgacatgatcttggctcactgcaacctctgcctcccaggttcaagcgattcccctgcctcagccccctgagtagctgggactacaggtggcgccaccacgcctagctacttttttgtattttagtagagatggggtttcaccatgttggctaggatggtctcgatctcctgaccacgagacccacccgcctcggcctcccaaagtgctgggattacaggtgtgagccaccatgcccagccaagaaaacagattcttattgcacctttgcaaataactattttgctgtaagttaagaatactcacaactagttgccaaattctggagaaatcaggtagagagaaacaaatatgctcagaattttgtgcataggagtatataaactgttaagagctataatataaatagctcaaaaggaaagtttccttgactctgaaaaacaaaggatcagtagtgttttatgcaaagtttgaaatattacttccgttttttattggttcagtgaatttaggtaactcctgttttgcttgatattcatgaacatttcatctctccatgagagtcctgaaagtttttcctctattctgttgttacgctctccaaagttacaagaaaacatgcattgaagaacacctgttagagttctataattgattataaaccaccttctaaaggagattaaaacaagacagtcatctctggatgataaaaagctttaggacagccactattaaagccacatttgataaggaaattttgttacttctgtgatacacagaattttacataacaattataattattaataacacactaaataatattagaattataggagtttcccataactttagaatataccaataacacatttatgtaaatatagtccaaagaaagcaaaacaccatttcacattcgattatgcttcctgtatgatttttatatcaaataagccaaatgtcactgttgtattagtgcattatagatataaaacccaatttttttttttttttgagacggagtcttgctctgtcacccagtctggagtgtagtgacgctatcttggctcactgcaacctctgcctcccgggttcaaacagttctcctgcctcaacatcctgagtagctgagactacaggcaccagccaccacacccggctaatttttagtatttttagtagagatagagttttgccaattcttaataaaaccttataaataaataaatctttccaatcttaatcagtttgaccataaggtaagattctcataaactttttataaccctttacaagtttttgttaaagagcaggtcataagcaggtttttgctctaagaaaccaattttaatttatagaaaagctgaataatacccctttaatttagccaatgtccacacactggctattttaatttgctctaagaaaccaattttaatttatagaaaaactgaataatacccctttaatttagccaatgtccacacacagaatctcttttacaattaattttttacaaaccttccacaactgttcaaacctttagctttattctaacttaaagcaattctttaaccctttaggcaaaaaacccatattcccatgccttcttataatcttttaccaaaaatatattctactttccttacacaccttacaggtaaaactatttcttcaatagtctcaattacatgttacaatgttaacttttagcaacttttatttttggtgaaaaccctggttagtaagcaattttaattgtgtattaggtgtggagcctagccttaggacacgccaggcagaagtgcagataagggctgactctccagcatagctagggggcatggctaactccacatgtccccaggccttaccttacttaagcaggcaagttatacagtaagagtcatagtggcattttatgacgcatttaggaggcctaacaacctttgaattgtgcaacatttcttgcataaattttctttcaaaaatcctttcacgacttacacagaccatctgagacattcttggactttctgacttgccctaaacatccctccttttaaacaaccattttattttaggagaagaatttaccataccaagatcttttcttatataaaatctttctttataatcatctttgtatagctagggggcatggccaattccacatgtccccaggccttatctagaatctaatggctttaaggcaggtaaattgaacaatttttaaaagttaaacagtttatgaccttaaagcatttaacaaacttaatatctgacctgcataatttagactgaatgtttttattttatcagtaatttttaaagctgtttgtatttcccgaagattactaagattacatgaactaaaaggcattacagtttttgttttgctttcaaaatatttgatttaagcacttatttttgtttcagccaattagacttcttttatataaacattacacataatatgtatatagctacccagaaagaagaatattactacagtagttgtaagatttttcatttgccagtttttaagtttcttaattggattactggctttaaggtggagccgttggaagaacagggccaggaaagggggtccctggtgcctcctgtttttcccaaggagttcaggctgttagagcttgaatatctgcttttaattaaactgattttaaccatagcactctttaacaaagtctttttagaattttttatgccaaacagccaatatttctggcttttgaactttacctaaggtaacctccaaggtgcttagagaaaggaaaatttaagacagtccatggaggagaagagaatagacaaggtcacacagatattaaaccagaaacgacttcctagggaaggaatcaaacccgaactgctactgtgaaagtgcaaaaccctggcttctgagctacagcacgggacagtctctgtttcctttcctagaaggaatttagagtagttaattttgagcttgcaaaggcttttaactaatatgatttttagatctaactatgacatgaaccctaaaattcctgttccctggaaggcagagaccaaaagtactgccacatggttacaaggtcaagctcccaaggacataaacaaggtggagacttcatccacttttttgtttgtttcagggatctgtagccaagtttgttactgaccagctagcttgctggcttatcttgaaaagtgggcctgcaggtattctaagcccgtgttttatcctaaagcaccccttgacacggaaaaagaaattcatagcacaaaatacaccagcttaagactagccttagaatttttttttgcattaatcaaaacattacagaggagataaatactgatttttccccccattcattcaactgtttgcatagagagtgagaagctagaaatctgactggcaagaaattcttaccctttggccagcatgccaggcttctgggttccctttccctgagtggcactagtgatctggcttgcagcaccattgccctgggggccaagcctcatcataaaggaaaattacttttttttgttctggccagagcaaaatacatgtgataagacatagacattagccactctgcttaacacccaatatcaaactggtgaggcttaaatttgcccccaaatgggccccgtcatctttaatccagcctcagacttacgtggcctctgggcaaggtggttgccctgagtaacagaaaagataggaaaggaaaagtagagagagaaaagcattgcctgtagcagggtggggaaagcgaaatgatcagggaggtcagagaaagacccacccattgcagtgacattgaaaagttcaggtggctgctcctcagtagcaaagggatcttttccagccatcccatcagctcttaagtttccccttttagggaagaaaaagttccccatgtcccatagtcctgtacatacctgactctgtcacccacagccattagcaaagagtgcaaggcagattaatccaaagagaatagcagttaacatcccatagtgccaaacctgttcttacccaagaaggcctttactgagacgggcctctaaccccctaaatcttagaagggactctatccctcataagttggacctctaacccttgccttttattaagaggggcactttgtcctcttgaatcagagactaatttttcagacttgtttcatggatatcattttgagacttctcttgactggtttcctgtaatagagccactgctttctcttcctctttggtttcctcccttgtttttctggaacacatcctcaaataacttccttagaaagggtattaacagtttaattttctcagtttttgcatgctttaaaatgtattctacctctgtgattgatttatagttcatctgggtagagaaatctaggttgaaagtcattttccctccgaactttgaaggcttttgctttgttgccttctaggctacatatgtggtaatggaattgcaggatcttatggtagcttttttttttttttttttttttttgaaacagagtcttactctgttgcccaggctggagtgcagtagtctgatttcagctcactgcacccttcgtctcctgggttcaagcaattctcctgcctcagcctcccaagtagctggagttacaggcatgtgctgtggcgcccagctaatttttgtatttttagtagagacagggttttgccatgttggccaggctggtcttgaactcctgacctcaggtgatccacctgcctcggcctcccaaagtgctggaattacaggcgtgagccaccgtgctggtttttttttttttttttttttttttttttaaatagagacagggtctttctctggtcacccaggctggagtacagtggtgtaatctcagctcactgcagcctcaaactcctgggctcaagtgatcctcctacctcatccttccaagtggctgggaccacaggtgcatgcccccattcccaggctaatgtttaaatatttttgtgtagagatagggtctcactctgttgcccaggctgttcttgaactcctagtctctagtgatcctactgccttggccttattttaaactttttgaggaaactccatactgttctccataatggttgtactgattgacattctcaccaacagtgtacaggggttcctttttctccatatcctcaccaatacttgttatcttgtgtcttattttattttattttttgagacagagtctcgctctgttgcccaggctggcgtgcagtggcgtgatcttggctcactgcaacctccgcctcccggctttaagtgattctcttgcctcagcctcctgagtagctgggactacaggcgtttgtggcaccaccgcccggctaatttttgcatttttagtagagatggggtttcaccacgttggccaggatggtctcgatctcctgaccttgtgatccacccgccttgacctcccaaatgtagtacccattctaacagaagtgatatctcattgtggttttaatttgcatttccctgatgattagtgcatttttttcatatacagtttggctaactcctgttttctaatttattgcacagatgtaatcataaaagagaaacagtaacattactcacagaccaaccagcttaatactcagctgttctcaatatcatgtgttctgttatagtttgtgaatgcttattttatatgaattctatgaatgcttagtttgatgtactcgtgattgaccacagtataatttttcattggcatttaaaaaatgtcacacttcaaacatgtttcttctttatgattgtgttaatcttcataattatgagatggagcttgcttttatgttaacttcttggaatcagccagcctcaggaggatggtacacataagtgatgacggggtgggagcagcacaaaagatccaatggtgctggctgagccaatccctgttccactggcccttctctccactgtcccttatgtggtgctgtgtaaggaagcatggccagtctcaggacttcagagtgctttggttagcagtgaggtctgactcccactgcttcaaggaggtgtcgtaagctgtagggctgttgctctttacttttccctgtcagtacccacgaggaggtgtgtttgggctggaggcctgggctcacatggtgggtgcacaaccaagaccatcatcattggtctgatgatgaatttttagcaactctgaacctaacctgtgctctgtaacagtttctgaaatgaggtgtacagagatgggaagaatcttttggaaaacagagacagacatagtaaaaaaaaaaaaaaaggaaaaagaatagatataacaaaaatatggctggattgtacatttcataatacacatccattcataaatatactttagtttcatggttttttaaaaattcctagtagtatagataaggcagaagtaacacttatggggagaacagactgcaatttggcagcaaaaggaaggtgttaaactgtagctggaaataacagcagacttgatctgttctatattaatttttccagcttcaaaaccaacaaacaattgaaggtttaaaaaaaagaaagtggctgggcacggtggctcacgcctgtcatcctagcacttgggaggccaaggcggggagatcacctgaggtcaggagatcgagaccagcctggccaacatggtgaaaccccatctctactaaaaaaaaaaaaacaaaaaaacgaaatacagtaaattagccgagcatggtggctcgcgcctgtagttccagctattcgggatgctgaggcaggagaatcacttaaactttggaggcagaggttgcagtgagctgaggtcgcacattgcattccagcctgggcaacaagagcaaaactccatctcaaaaaaataaaaaaagaaagaaaaagtcagccttaatttagtgatgttattaagaataacaaatgccagtgtgatgatcagtcctggactctcaggtttgcctgttctgactagagttatggtgaaactttagttatcttccagtttttaatacggtccttgctgcaatgactttattctagagaactagcattactaaaacattttagtgcttagtggtttttaatacttatttcacaagaataattaaataagtcttttcctcgttgagtgtgtagtatgatgcaggttaggtatctgtgacacctataagtaaggctgacccatgaacaacactagcttgaactgtgtgggtccatttatatggagacttaaaaaaaataaatacattggaaaattatttggagagttgcaacagtttgaaaaaaattcagatgaactgggtagtctagaaatatgaaaacaattgagaaaaagttacatatgtcatgaatgcataaaatacatgtagatactaataatcagttttatcatttactaccataaaatatacacaaatctattataaaaagttaaaatttgtctaaacttatgcacacacagactgtacatggtgctattcatagttgagagaaatgtaaacaaatataaagatgcagtattataactgcatacaattaactgtagtacatacagtactcctgtaacaattctatagccacttcctgatgttgttgcagtgcgctcaagcattgggggtagctgcttggaaggtactgtgatgctaatcatctctgtgggagcagttcctctctccagtacacctcagatcgcagtaaaaagtgacctcttgagattcttgagtatgttttgttgtgtttagtgcagtaccacaaaccttgaataacactatgggacccatacaaagtgccactagtgatgctggcagtgctccctagaagccaataaaacccctgacagcattgaattgcttgctagattgaggaatggttgcctgtcgcttcagacagatgattcattttgcaaacagaccatgtaaacttatggtattgataaatacagtatggtactgcaaatgtatttcctcttccttatggttttctgaataacattttcttttttctatctcattttatcttaagaatacagtatataatacatataacacaaagtgtgtgttaactgtttatgttttcagtcaggcttccggtcaacaataggctattagtagttaagtttctggggagccaaaagttatacacagagttttgactgcatgaaaggttggcacccctaacctccaagttgttcaggggtcaactatattaaaagtctatgatatactcttggctttccagaaacttaatttgaagaagttaatttaaaaaccatagttttctatatattaatttgacagttcagcctttattaggtcaaagtttcaaaagagctcagctgttagatgtttagtaatgaatgccatcagcctttatgtcatcaggattcaggatgtttaggtgtgtgtttgctcagggctcagaaatagtcttggtggtgggtttacagctgcccatcttgttaggtgtggaacctgccttagcgctggggctgctgccagtctatgggaacattccctcccgtgcccttcctacactgtagaggcctacaggttgatgaccacttctgggacccttcattacacctctcactgaaagcatgtagagttgtgtaagtgacagcagccagccttgactcatcaaatagtctttcagtttgtaaaaaaaaaaaaaaaaaagtccaggattttattttacactgtaacatctgaggtgggtttcaattctagagcacaatggagactgatgtctgggtttcacccctagaattgtttttacattgtctgtgatatagtacagatgaaaataaaagagaattatttacaccttacatttgctgttacaagtattctgtattatgtctatatcatgtcaagtaacataggtatgttcttatttcatttattcttgtttctccatgtacacaaatgagtacatcatttccacttacggcaaaagtgatatgtcattgtatcagatccatctctcagtattatctgtatcttctgatttcttaatcaaatttatgctgtcaaaatatgttaatgatgttttttaaagtgtttattgagaaattcacaaagaacttgtattttgtcaaaaggccattgtttttgttgccaacattatcagtgcagatgtactaaattgcaagttacagaaaacccagctcaaggtgacttataggaagggtatttactggcttgcctaactgaaaggccagctataggccaaacttcagggttgatttgatttagcaacttaacaatgctattgagagtttagtttccttcttccttctctgccatctgcattcccaccttcctcttgaaagggcagggtggttgccagccattcccacacctacacattttctcactctggtcccgtggtgtttaatagcttgcccagaaaaccttccctttgtcacattgatcttaattgagttgtgtgcccatgcgtgaaccagcaactggctggggatggggtcatcctgagtagctcaggcttggagtcagcctcacccaaagtatagggctgtggggaggaagcacagaaaccacagtcagaactgggtaattagctagaggaggaggaaatggatgaagagcgacagccactgtccactgtgccatgtgatttacagtcatttgggttttgtttataagaatgcttgctttattttttcatttttttcttcttctgtctttaaggggcctttacaacaactaaacggacaggcattccagccccacgggaattttcagtaactgtctcaagagagaggtctgtgccacgtggtccctccaaccccaggaaatcagtgtccagtccaacttcttccaacactcccactcctacgaaacacctgaggaccccttccacaaagcccaagcaagagaatgaaggtggagaaaaggctgcgcttgagtcccaagttcgggaacttttggcagaagccaaagcaaaagatagtgaaattaacaggcttcgaagtgaactaaagaaatacaaagagaaaaggactctgaacgctgaggggactgatgctttgggcccaaatgtcgatggaacatcagtctccccaggtgacacggaacctatgataagagctcttgaggagaagaacaagaactttcagaaagagctttccgatctagaggaagaaaaccgggtcctgaaggagaaactgatctatcttgagcactccccaaattcagaaggggcagcaagtcacactggcgacagcagctgcccaacatccataactcaagagtcaagcttcggaagcccaactggaaatcagatgtccagtgacattgatgagtataaaaaaaacatacatggaaatgcattacggacatcaggctcctcaagtagcgatgttaccaaagcttctttgtcgccagatgcttccgactttgagcacattacagcagagacaccctcaaggcccctgtcctccaccagtaacccctttaagagttcaaagtgttctactgctgggagttccccaaacagcgtaagtgaattgtccctggcttccctcacagagaagatacaaaagatggaagaaaaccaccatagcactgcagaagaactacaggctactctacaagaattatcagaccagcaacaaatggtacaggaattgacagctgaaaatgagaagctggtggatgaaaagacgattttagagacatcctttcatcagcatcgagagagggcagagcagctaagtcaagaaaatgagaagctgatgaatcttttacaagagcgagtaaagaatgaagagcccaccactcaggaaggaaaaattattgaactggagcagaagtgcacaggtattcttgaacagggccgctttgaaagagagaagctactcaacattcagcagcagttgacctgtagcttgcggaaggttgaggaagaaaaccaaggagctttagaaatgattaaacgtctgaaggaagaaaatgaaaaactgaatgagtttctagaactggaacggcataataataacatgatggccaaaactttggaagagtgtagagttaccttggaagggctaaaaatggagaatggatctttgaagtctcatttgcagggtgagaagcagaaagccacagaggccagtgctgtggagcagacggcagagagctgcgaagttcaagaaatgttgaaagtagcccgagcagagaaagatctactggaactgtcttgcaatgagctcagacaagaattactaaaggcaaacggtgaaattaaacatgtttccagtctgctggccaaggtgagaagagacagctctttactggtatttgctcatccttgttcacatttctgcccttaacctctaaattcacagagcacagagaagcatttgcttagtctgtttcattcacgaagccagcattccagcttgaaggcctgttagattgcacacaggttgggattgggggatacaaaaaggaaacacccaaatttctgattatgggcggttcaaaatgtggggatgtagagtcaaatcagagtatgatgcagtgataaaagaatatcatacagcctatgcccaggctctagtctagtgcaaaggaggggcatctggtgtaacgtgggggttgggcgtagcacagaaggacttcctggaagaaatagcaactgagctgagttctgaagattgagtgggagtttgccagtctgtcagcatgcttttagctgccagtaacagaaaatgaaatcactcccaattttcaactaaaatattaccactattttggtgttttcttccagatatatgtgtgtgtatgtgtatcatacaagttacacaaatttataatcatcctgtacatgttattaactttttttgcatttgacattttagaaatattaaaacttttctcagcatattcctatcattaaatattcatttaaacattattttaaaggccagatactattttaatataaatatttcatatttaccctgttgttgaacatacatgtattgtcaaacatttgtggtctttccagtctttcaatattataaatacttttttatatctatcttactgtttatttaggaaaaattcctagacgatgacttaccgagtcaaagagtataaacattttaaagactttcaacacattcagccagattgcccttcagaaatattatgccagtttattcatcctagcggtcatgagatcatgagctttcctgagcctttgccagcacttggtattacattgttatatcatttaaatctgttaatcatttcatttttttaaccttttttgcttgggaagatcttccatagcccaagagcaaataacttttctcaacactttaatcagcctgtaattttgtttttgatgcaagaattgtggtgattttatgatattctgcccacctcccagagcagtgctggagaggtgcagagagatggcctcctatttcttgttccctccaagttctgggtctgatttagggatctactggcaagagagattcaaaacatcttcctaccttagtttaggggttgtcattgtttcaaggagcaaattatgccatgagctctcagggagatttttctccactgcttcgtctgtcttaagatgagtctgttgcagcctgattctgcaatttggccatctgatgagcttagtggtgggtcatgttaaggagtttctctctttgtctgtattctaaatttgtaggtattttattgaaagtacggaagtaattccattagaggttactagtcaggcttggcattgggttttaatatcttgtggagtaagattattctttttttactttaagattactcactactctctggcaaaatgttttatctcccatgtgcaccttcttgaagttctttatcagtccctctgtgtttttggtagtttggcattacattaaatgtgcatatcagtgagaaataatttgacatcttaaaaatagcttatttttttctgatcataaaatatttttattacagacgatttaaaaagtacagaaaagtataaaaaagaaaagtattacctttaatttcaccacttggagaaaaactgctaaccttttgctgtatgtcctttcaggccttttctcagtttatacatgtttgagcatgcataaaaacttgcattgatatgattatgatattttgtcttcctatccagaagagtagagtatgtctgtccacattccattacaaagaatcagttggattagtttatctattccactattaatctgtttctgattaacttgtttctacttttatctttattaatttttttgtcttattttttgtacattttggtttcttgactaaaattctttgttcatttaacttttttttatccttggttgataatgaaagcatttaaagttatagctttggtaaatagaggcaataaaatctggaatcttctggaataaactaaatgtaatttaaaggaaagtgtgcattttctgtagagtgcaaggcacaacatatatgtttaaaatcaaactgttattattcatgtatcctacatcttactgcatgctaactagaagtatcaaatactgatagtaagaagggaaaggtcctagctagtatttttaggtgagagtttgaggtaaagatgggggcatgctatcacatagggtttcttgtatatctatcaagaccctaggtttgtgattttgtgctgtcttatgtgcacagagactgatttgtaattgcagtggacttgtaacatactaatcttcctacccttttacattactgtagaaaaagcaaaacatagacctcctaaatggactaatactgattgtatctctaccacagactatcaagtaatctgccaacaaccatgaatttaaatgataatacttaagagactcatgtccaaaggataacaggagaagttttagcacaaaactatgatgaagggtctaacatgctggactgggtcctcttgacttacccagtgagcaatgatgtgaccttgggcaggcccctttacattgtgcaatgtcgaatagaagcgtgacggtggatggatcctggtctcgtatctaattccaagggaagcatttaacatttaattatgatgtatgttttttgtaggcatttggtacataccttttattatgttatgcaagtatttgctaagaggtgttttgtttggtggtttatttttagagacaggttctcgttttgtcacttaggctggagtgtagtggcgattatagctcactgcagccttgaactcctgggctcaagcaatcctcccacctcagcctttctgggtagctgggactgcagccaggcaccaccatgcctgactacttggcttgtttttaaaggatgaggattgaattttttctacagctaatgacgtgatctgatagtttttatgtaatcaagtttttttctcctctaacttgttagtgaggcaagttataacaacagattttctaaggtgctctagtgtaaaatcatgcttgcattcctggggtaaatcctaattcttcagttttcagtggtttcacttgactttttgctgagaacttccaaatatagctgccttcagcaggtatcggagtaactgtcctgttgagcaccaagcaacaacgtgtaccccatgagcagtgcattcatccactctaatgcttggcgaaaggtgaatattattaaaaaggatacaataagctatttacaaaaggggaaagtggtgccaaaccatcctatgatctaatagattccgtaaatctatgtaagtttcaagttaagattactcaagcaacccagataccgtcaaaagaacctataaaaagccttgaaaagtacttttttaaaaataggaggtaggtgtcttcctcaaacaataaatggaaaattggtaggatttctacactatcttgtaggctttttttcttctcatttctttttcttcattggtttgctgatttctttatttttttcaacttctctgatataccccatatgcatcttgatggccgcttaatctgtagtcacatgacatacttctgtacaactttgaggacgggtctgatttccacagaacccaaagccaccactcctatccttgccctagctagcaagcagcatggagttgtatgggattgttgtttttccagacaataacatgacccagctttaatttacttttttaccttttcagttgtttgggatcttggtttcaagttagaatatcttttctgggcttgaaacctagaagttttaaaagaaaattatctatttattcccgtgaggttgaagcttataggtggtatccttagaatcttagttctttctgcagaaacttcagtccgcttccagaagagtaaggagattataaataaccccttggcatgaatggtttgcgggagtcagcagaggtgaaatgactagtgttctgcttgtgtgggtcctagagccaaactgatttagagtggccagtggtcagagatggcagaaccagaatttgagggaaatatgtggcaaatagatgatcctgtagctgtgacattggaataggatgccttaaaggacttaagagatctggaaacctggtttaaacagtcaggtgggttggaagtgtatccaggtgatgtattgatatatgagaaactgccctcctgtcagcggcttgagccaggggacactccctccaccccggccccaagggtgggagattggctgtggctgcccatgatgcaggcccaggctgtggctggcagtgctgtggttctggacctcctgccaggggtacaggacagctcagcattgccaagcatcttggtccacctgttggcgacttggggcaggcatgtcacctggacatctgggtcctatggggagagggtttcccagagctttacctttacatctgattggtgagaactgcgtcacacagtgcccccaggccacctctcttgaaatcacagttgcagcctgattcttgaacaaaattgggattctgttaggaagaaacaaggtgggggtggcttttggtgggggatgggcacttgccccaccaggcctccactccctcaccttttcccacaaagtactcacagtgatctgatcatgtagcgccttccggtgctgcctggggcaccacatggcttcgcccagtgcccagctcccaccacacctccacttgcagtcccaccccacatccagccatattcccacccctccctccatgccaggcctggccgggccagtgactgtctggcagtcatgtttgctcagggggttttctcggcctgaagagaccccaccccattgaccattacctggtccctcctgaagctttccgcctcagttatggggtcttcagcgaggcattcagctctgcggggccctgtcccatggaacttcagactcatctcagtaaatgacattattgtcactcagccaaggtcactcatgggaatggcctgacccaccctggccctcagaggattcagatgtgcaggcaaaactctttggggccctgcagggaagctgagggaacctgctgcctgagtagccactggctgctgctggagaggtgggaaggttactgagctgaaaacatggagatttcagtcatcttcagctcacacataaggcatcccactggcaccaaatatcaactctggtgagcagaggcctgtggcttcatgctgggaaggaggcctgtcagcagctcctgtcaacagggcctgttttccagctcccctgggcaagccatgaggatgtggaagtcgaggaggcctgtggaggctgttggggagagccccacagctgttgcaccagtaagcctctgctcaaggggctgtggcctggggaaaattgccacaggcctcagcctggctgtgcagagccagtttagcattaggagcggaatcttctagagattaaactacaaagccagaatgcctgtgcagccttttattttgtgggatgtgataggcatgtggcccggaactcatggcatgtctgccaggtcctctcccgacacccccaggtctctgttcttgaagccccttgaaaaggggcagaagtttggtggagacagtcagatagtttgaggaagggtggtcttgccagttgggcagatccacagaacctgtggctccgaccccttgctcttacctgtgactccacagggggctgcttcccaatcctgcctgaccctgcttccctgcgatggacttgttttctcctggacacgttaatgccttttgtgaggtgaggcctaagcagtctcttcctttcacatgacctcaggactcatctgcgaacctggtgttgcccagcacttctctctccagtccgagttcttgggaagtacctgcgtggggccttgttgcttcgaaaggtccctaccagggtacagccactgcttctgaagcttgcctctgagttcctaaaggtgaaatacagatgtttaccctcatctttgagttttctaacagcctttctccactatacctgaagtgtaaataaactaacatttcctcctctcccttggtggagcagcattggccaaaataataataattcaactttaggccaataagaatgaactatggatgattatcagcagtgtctattcacaacagggctaagaaccgagcagagggagttttgcagtacccaagctagatgccagaacagaaacaccccactttcttactcattgaattagcccgttttcatgctgctgataaagacatacctgagactggaaagaaaaaaaggattaatgaacttaacagttccacttggctggggatgcctcacaatcatggtggaaggtgaaaggcacatctcacatggtggcagacaaaataagagagcttgtgcagggaaactcccccttatataatcatcagatctcgtgagacttatactgtcaggagaacagcacaggaaagacctgcctccctgattcaattacctcccactggggtccctcccacaacatgtgggaatacaagatgagatttaggtggggaggcagccagtctgtatcactcatggtaaatttactcaagctgtcattccaagtttatttccttttaaactatatgtaattttagcattgcaattccttccatctattaggtgttcagtaaatacttttcagacgaatgaatgaatgtcagagaaacttgcagcagaattgaggggctgctataattatattaatatgtttaaaaagtaaagtttattatattttaataacagcaactaatattttgggctatttgtatgtgctaagcagtctcagagcttttccatcatttaatcttatttatcttaattttatgctgttgattctgttgtctagtattttttcatttgagcaaacagaatgatttaagttattagtctaatggattgatgaaatgaagccagcattcaaagttgggtctgaccttagagctcttattcttttttttcttttctttttttttgagacatggtcttgctctgttgcccaggctggagtacagtggtgcgatcatagctctctgcagtctcaaattcctgggctccagtgatcctcccacctcagcttcccaagtagctggaattacaggtgtgcaacactatgcccaattttttatttttattttcatagagacaggatcttgctctgttgacaaggctgatctcaaacttatgatgatcctcccacacctcagtgcctcccaaagtgctgggattgcaggggtgagccaacgtacccagagctcttattataatcactgatttagactgctgcccagttacctgaaagcaaagaagagacagaaaaacacttaaagcagacctaagactaatagttgtcactgtcatcttaaggccaaagccctttgaagaaaaccacctttgaaagccttgttgaactaggagagttttacctgattgtaatacaatggagaaattcacagtgaaaacctgagtcatcaagaaatgttattttgtttgacctctacctgagtcttgaggggagagggggtgagttgacccctgagtgtatggggtggggactctgggaatgctgccagaagagaacagcaggtcctaaggccagaaagcctggccaccaaggaagtgatgcaggtagtttgtccttgttggagtgaacagggtggtcagtggaagtggcctggtggagacaccagccaagcagttaggattttatcctcaagacagtgggagtctctgaagaatttttttttttaaatagcagcttttattgagatatgatccatttaaatcacgtaagtctgtgggttttagtgtattcacacaattgtgcaaccatcactacaatcaattttagaacatttttatcaccccgtaaaaaaatcttaacccacagcagtcaccctccaagaccgcctccctcccagcccctggcaaccacaaatctatgttttggctctgtggacttgggtcttctggatgttttatacacatggaacccacgccctgcggcctcaagcagccctcccactttagcctcccagagtgctgaagagttctttctattctttggatacaaatcctttaccagataaatgatttgcaaatatttcctctcattctgtgggttatcttttcattgtcttgataatgccctttatggcacaaaattgtttaatttttatttttatgaagtcgaatttagttatttttctttggtggtttgtgcttttggtcggaggaattttaagagttatggaatcacatttactgttgagaaagatgacttgggccacagttaggtgagaaagaatgaaggacagaacagggagtgagttgggtgggaagatgagggctggaaagacattcattttatttacttatttatttttgagacggagtcttgctctgttatccaggctgagtgcagtggtgcatctcttcacgcactgcagcctccacctcctgggttcaagcgattctcctgcctcagcctcctgagtagctgggattacaggcacctgccaccacgcccagctaactttcctatttttagtagagacggggtttcaccatgttggccaggctggtctcaaacccctgaccttaagtgatccacccacctcaacctcccaaagtgctgggattacaggcgtgagccactgcacccggcctggaaagacatttagatgttagatgtgtagaagggaggctcagtagggtcaggtgactgatttgatgtcagggacgggcaggaggaaggcatttcagcctattcatagatctccagcttgtaggattgaatgtgcggttgtgctgcttcctgggagaggaaacacagaatgtggggcaggcttgagaagggagcgttatctgctggagctaacaaggatacccaggcctgcaagcccaggctgctgtcagcaactgccgatgcagccacagaggagatccgggagcctctgcccttccaggccaagagtcctccaaggccggggcctcgtgcctgaggtctctctttgcccctccagtacctttagaagctgtagaaatatgtctagacaggatgttccatgaatgcatttcacatatgctgaggtttgtgaggagcctccacagtgtcagaggaggttgcgactctgaagatgagcaggtgcgattctgaattcttgaccattctctgccctggtagatgatctctttttaagcactcgagaaaacttgattgaatggactatataatcactatataataaacagattaagtcaaaagccaagtaaaatgacagacttacacaagaggcagttatggggggtttatgagtcaggtatctttcttctccacttgttctgttttctaataaaactgtctgtacaactttaatgttactggaatttactcagaacttattatagtgatctcattctgtccatgtctctatagtaccatgtttttggcatgtaactatttgaatgaaagattaaatgatttctcatagccagggcataattcttcaagatactgtctttgctataaaaatttacaaaaaataactaacactgaaatgtttgagccgcattttgtctcacagaatgcttttacttgaatgtactgttttctttgttctttatatattgataatgttgggtaatctataaacctaattccttattctctttagtctacagtctctattcttatggctgctttgtgtaggagaagagcttggttcttagatatctctagcttgatttcctttctgcttttgttcatcacactaaagaaagctatatagatgccctgacagagatcttttttcagtattgtcaaattatctggtatcaaaaaacagaaacccttaagtaacttcacagcttctcacaagggcttgctgcataataacaggcagatatttttatattcactttacagattaacatatgaagagagggagaaattaaatcacttgaaaagaacaatccagcatgtatcaagtggctgagaccaaaccctacccttggtcaaaccatcacaaacagttgtttacccctccgagagaggagaatctagatgtgtgtgttgccaccagcataggagtgctcttaatatctgcagtcggggagagcatcccccccacccccaagcacttcctctttgcaggagcactcatctggagatgcccgaggcccattgcctttccttagggtgctggttaatgtctaatctaattctttgatccaagcttgtgaagtgacagtgattcttttggggagaggatggcaagtagcatgactcagcctccaggcttaactttatcttccgagtaaggagtttgggggtcctgagactttattttcctttacatgtgtctgacaagcatggtgtgggggtggggtgggtggaggaggtgacccttgataggattctagaggggtctgacttcagagctgcctgcttatcctctgggccctgcgtaggaacctctgctgccatatgccttgggcacctgatggaaaggagtggctttctctgtcctctctgcaggaacccttcttgggaagtttgtttgactctatttatagtgcaattccactggctccatatctacagaaagttgatctttgaaattgagagatgcatgagagtgattccttttttcaagggaaacgttgaaaatcacattgctgggtgtctaagagtgtgattcttgacctagagaagttaaactctaaggagctggccagtcagacatgttgggtggtctccctgtagttccagcttcagagggctgaggcaggaggatcacttgagccccggagttcagcctaagcaacatagcgagaccccatgtcttaaaaaaaagaaaaaaaaatctcaagggaaatgcaaaggagctggccagcagagagaccagcaatgtgaatagggcctggatcccctgcagtcgtggaagggtaggctttggtctcagccacttgatacatgctggattactcttttcaagtgatttaatttctccctctcttcatatgttattctgtaaaatgaatataaaaatatctgcctgttattatgtagcaagcccttgtgagaagttgtgaaatgacttaagggtttcagtttttttattgtgtgtgtgtgtgtgtgttttttttttcttgtaaatagctttctggaatatattgttaaacttgagatagttattccaacatccaagaaggatgtagtgatgtgtgcatgtgaaacaactgctgatttgcaggtcccctcccccatgccgagttacctagcttgtaacttggcgcagagcctttgagggacagcagcctcacctgcaagcagaggctttgctcagggtgctcgacctctaggctgcctcgttacatcctcagtttaattcctggcccacagttgtcccagccaaaccacatgcatgtttctagactccaggtgacaggcccttagcctgaggactctacaacatgcagccaggtagttatgcagaaggccacagtctgccccaggatgcaagactcaaaagccaccttctattgctgcttttcaaatgatttcagacatcagccttccaggatctaaaatgcattacttcttttctccttaaattcatcttctggccaggcacagcagctcatgcctgtaatcccagcacttgggaggccaagatgggaggatcacttaagcccgggagcctgggcaacatagcaagaccccacctataaaaaaaaaatgaactgggcattgtgatgcacacctatagtcctggctctgagggaggccgaagtggggagaatggcttgagccaggagatagaggctgcaatgacccgtgatcgtgccactgtgctccagcctgggcaacagagcaagaccttgtcccttgactccaaaaaaactaaaaaatagtaaagtcagcttctgtttaataaagtagctattgctaagtatatattggtctttcatgtattgtgatttttcttggtcaaactgacctgtattatattactacctagtgttgtatatataatacatagggcaattgtgagagaaagaatgactttcattgacttttactgttacatgttccaggcactatgataaactctccaagtcattatttcacttaactgcccaccccccaaccctgcattgttagattatgaaacagaggcagagggattaaggaatacaaggcttgattcactagaattggggtttaaaccctggcggtctggctccagaatatatgtccttagtcatcttgatgcatttaagcagctttcaagcttcagagcacaacctgcaatgatctattttgtattacaatccagagtctcacgcctttataattaaaacacaagcttcacagagcagtgctgacccctgagcacaggcagggctctctggctgtttcccaggctgtttctctctctcttctcctgtcctttccctccgtcccttcctcccccctcccttattctttttttctaatttttaattgttatgggtacatagtaggtatatatatttatggggtacctgagatattttgacacaggtatgcaatgctgtagtcaccctgttgtgctgtcaaataataggttttattaactatattgtatccattaaccatccctgtttccacccctgccccaccacccttcccagcctctggtaatcattctactctctatcttcatgagttcaattgttttaatttttaactcccacaaatgagtgagaatatatgaatttatctttctatgtctggcttatttcacttaacataatgatttccagttccatccatgttgttgcaaatagcaggatctcattcttttttatggctgaatactctgttgtgtatatggactatattttctttatccatttgtctgttgatggatacttaggttgattccaagtcttggctattgtaaatagtgctgcaataaacttggtgagtgcagatatctctttgatagactaatttcctttcttttgggtgtatacccagcagtgtgattgctggatcatatggtagttctatttttagtttttttgagggacttctgtactgttttccatagtggctgtactaatttactttcccgccaacagtgtacaagggtctgcttttctctgcatcttccccagcatttgtcattcatgacttttgaataaaagtcatgacttttggataaaagccattttaattggggtgagatggtatctcattgtagttttgacttgcatttgcatttctctgatgatcagtgacattcagtatgttttcatgtttctgtttgccatttgtatgtctttaaagaatgtctagtaagatcttttgcccactgtttaatcagactactagatttttttcccccattgaattgtttaagctccttatatattctggttattaattccttatcggatgggtagtttgcaagtattttctcccattctgtgggctgtctcttcactttgttgattgtttcctttgctgtgcagaagctttttaacttgatgtgatctcataggttcatttttgttttggtattctgtgcttttgggctattactcaagaaatcattgcccagatcaatgtcctggagagtttccccaatgttgttggttttttagtagttttcatagtttgaggtcttagatgtaagtctttaatccttttgatatgatttttgtatatggggggggtgtctagtttcattcttctgctcatggatatccagttttcctagcaccatttactgaagagactgtcttttcctcaatatatgttcttggcacctttgtcgaaaatgagttcatgtagatgtatggatttattcctggattctctattctatttcattattctatgtgtctgtttttatgccagtaccatgctgtttgggttactatggctctgtagtataatttgaagtcagataatgtgattcttccagttttgttctttttgctcaggatggctttggctattctgggtcttttgtggttccatatgacttttaggatttaaaaaaaattataaagaatgtcattggtattttgatagggattgctttgactgtttagattgctttgggtagtgtggacattttaacatattgacttatccagtctctacacatagagtgtctttatttttgtgtgtgtgttttcttccatttctggtgtcaatattttatagttttcattgtagagatctttcacttctttgattaagtttattcctactttattctactcacagctactataaatgggattactttcttgattcctttttcagattgttcactgttggcatataaaaatgctactgatttttgcatgttgattttgtatcctgcaacttcactgaatttatcagttcttaatagttttttttttttttttttttgtggaggctagttttttccagatatcaagtcatatcatctgcaaaccaggataatttgacttcttcctttccaatttggatgccctttatttctttcccttgtctgattgctttagctgggacttccagtactgtgtgtgaataacagtggtgacagtgggcatccttatcctgttccagatcttagaggaaaagctttcagtttttctccattcatatgatactaggtgtgggtctgttgtatatggcttttattatgttgagatatgttccttctgtacccagtttattgacagtttttatcatgaagggatgttgcattttctcaaatgttttttcagcatcagttgaaatgaccatatggtttttacctttcatttggttgataccacattgcatatgtcaaaccacctttgcatccctaggataaatcccacttggtcatgatgaataatcttttaaatattttgttgaatttggtttgctaggattttgttgaggatttttgcatcaatgttcaccagggatattggcctatagttttctttttttcatgtatctttctttgtctggttttgttatcaggataatactgctttcagaattggtttggaaacattcccttctcttctatttcttggaatagtttgaataggattggtatttttctttaaatgtttggtaaatttcagcagtgaaaccattgggtcctgggcatttctttgctgggggactttttattctggcttttatctcgttacttgttaccggtctgttcaggttttggatttcttcatgattcaatcttgttaggttgtatgtgtctaggaatttatccatttcttctaggttttccaatttattggcatatagttgctcatagtagtctctaatgatcctttgaatttcggtagtattggttgcaatatctccttttttatctttgattttatttaattgggtcttctctttttcatagtctggccaaagttttgtcaattttgtttatcttttcaaaaaccaactttttgtttgttgatcttttgtatttttttcattaaaatttcatttatttctgctttgatctttattgtttcttctcattttgggtttcatttgctcttgcttttctggttatttaagatgcattgtttgtttatttgaagtttttctctgtttttgatgtaggcgctgattgctgtaagatttcctcttagtactgcttttgctgtatctcataagctttggtatgttgtgtttccattttcatttgttttaagacattttaattttttcttcttaattccttcattgacccactggtcattcaggagtgtattacttaatttccatgtattcgtataatttccaaagttcctctttgtgatttctagttttattccatggtggtcagagaagatacctgatatgatttcagtttttttttttttttttaagttttaggagttacagggccaggcgtggtggttcaagcctgtaatcccagcgctttgggaggccgaggcgggcacatcacctgaggtcaggagtttgagaccagcctggccaacatggagaaaccctgtctctactaaaaatacaaaattagctgggtgtggtggcatgcacctgtagtcccagctacttgggagactgagacaggaaaattgcttgaacccaggaggcggaggttgcaagtgaagcgagatcgcaccaccacactccagcctgggagacagagcgagattgtgtctcgaaaaaaaaaagtttcaggaattattttgtggcctaacatgtggtctctccttgagaagaatcatgtgctgaggaaaagagtgtgtattctgcagccattagatgaaatgttctgtaaaggtctgttagttccatttgttttgttttatagtgcagattaagtctgatatttctttgttgattttctgtcttattaactttttgttgttgtctgttgtttctatttacagcttattataccatgtcttgaaaagttgtagttatttctcttgatagattcatcttttagtctttctgtttaagatacgagtagttgacacatcacaattagtgttaaaatattctgtatttgtctgtgtacttgctgttaccaatgagttttgtatgttcagatgatttctttttgtttgttaatgtccttttctttcagatcaaagaactcccatttgcatttcttgtctgctgttgatgaaatttcttaggttttgtttgtctgggaaagtctctatttctctgtcatgtttgacattttttccttcagtactttaaatatggcatgcctctctctccctggcctgtaaggtttccactgagaagtctgctcctttgtttcttttttcttgctgcttctaggatcttttcattatctttgccttttgggaatttgtttattaaaatgtcttacttgggcaaagtctgcttggtgttctataacctattgtacttgagtattaatatttttctctagatttgggaagttctctgttgttatccctttgaataaactttctaccccaatctctctctctacctcctctttaaagccaataacttactagatttgcgctttttttagactgttttgtagatcttgtatgtgtgctttattttttttaaattttgtctcctctgtatattttcaattagcctgtcttcaagctcactaatttttcttctgtttggtcagttctgctgttgagactctgatgcattcttcagtatgtcataaacttttagctccataatttctgctttatttttaaaaaattatttcaatctcggccgggtgcggtggctcatgcctgtaatcccagcactttgggaggccggagtgggcagatcacgaggtcaggagtttgagaccagcctgaccaacatggtgaaacccgtctctactaaaaatacaaaaattagccgggcgtggtagcgcctgcctgtaatcccagctactcaggaggctgaggcaggagaatcgcttgaacctgggaggcagaggttgcagtgagccgagaaagtaccactgcactccagcctgggcgacagagcaagactttgtctcaaaaaaaaaaaaaaattatttcaatctctttattaaatatatcgaaaggattctaaattctttcgctgtgttatcttgaatttcattgagcttcctcaaaacagctattttgaattttctgtctgaaagatcacatctctgtcactctgggattggtcactggtgtcttatttacttcatttgatgaggtcatgttttactggatggtcttgatgcttgtggatgttcatagatgtctgggcatggaagagtccggtatttattcagtcttcacagtctgggcttgtttgtacttgtctttcttgagaagactttccagatattcaaagggaattgagtgttaggatctaagcctttggtcactgcagctgtgtccgcattagggggcaccacaagcccagtaatgctgtgattcttgcagactcattgaggtatcaccttggtgatcctagataagatctaggagaatttcccggtttatgaggcagagtctcttgttccttttccttactttcccctaaacacacagagtctctctcttcatgctgagctgcctggagttggagcaggggtgatgcacttctgtggctaccactactgggactgtgctgggtcagacctgaagccagcccagcactgggtctcagtcaaaacttgtggtgactattgcctggctactgctgatgtttattcaaggcccaagggccgtttaattagcagatggggaatctagccaggcttgtatctttcccttcagggtgatgggttcccttctagcccagagtgggtctagaaatgctacttgggagctggggcctggagtcagcagctttagcagtctgcttggttctttattttattgtggctgagctggtatccaagttggaagacaaagccctttacccttccctctccttttctcaagccaaagggatctctgccagtggccaccgccaccccaagcctgtggcagcaccactgatgtttattcagggcccaagttctctttagtcagcaggtctggatctctcccttcaggtccacggtgggtctagaaatgctgtccaggaactaaggcctagatgggggactttaggagcctgcttggtgctttattttactgtggctgagctgtgcccaagttgcaagatgaagtcccctttactcttccctctgctttcctcaagcagaagggatctctccctgtggccaccacagctgggaatgcactgggtcacacctgaagccggtacagtgtgtggcccatgatgagtactgtgtgggtaccactgatgtttaatcaaagcccaaggactctttggtcagcaggtgatgaatgctgccaggactgggtccttcctttcatgacagtgggtttccttctggtccaggctatgtctagaaatgttatctgggagctaggacccggaatgggggcttcaggaatctgcttagtgctttattttactgtggctgagctggtatccaagttgcaagacaaagtcctctttactcttccctctccgcccagagctgtgagctgtgctgcctggggttgggggaagagtggtgcaagcactcccttggctgctccaggtggtgtctcactgggtcatgtgcactccaagtccactgtctgagcccagcacagcaccaggacttgcccagaaattgcagcccttgtggcctagcctctttcagatttacttaggactccaaagtgctttagcccacagaggtagggcttgccagaactcagattctcactggaatggaagattcccctctggctagggctggtctaaatgctccttttatgggtgctggctgaattctgtcctgtgttgctttctgctgtgatgggacagcaccaaattccaatgcaatctcacaatcattgtgctttccctcccccggggtgcacagatgctgtctctctaccatgtggttgctgccaagggatgagggagaggggatgttggagagtcaagacggtctttcctcccctctccggtgcatctttccttgatatgatgtgttaaaaccaggcactgtgatcgttcatctgatttttggttcttatgaagatgctttcttacgtggatagcagttccatttggtgttcctgcagggaagccattgctggaggatcctttttggccatgttgttctgtctccaggtctctcctcctttccttatcctttgtcacaatttcccagtgaatgatcctgcagtgctgcctcccagtgttcattcaatcattcatcaaatattcattaaatgcctcctgtgtgtgatgctgtgtagatactaggggtgcaatggtgaattaaacagacaaggtccctattcccatagagcttatagccagaaggttttgcacatgaaatgtaattggaaaaaaatttcatttcatacaaagaaaccccacccccagcgccagattacctggtaaatatacagctatttagtaatgttaattaaaggactgtagaaaagggacaatgatgtttattgcagcatttttgtaataataaaataatatagtcaaacagtggaatactatgcaccaattaaagtaatgacttagcatgatgtgtatcagtgtggatacatttcaaaaacacagttaaaatgcaggagcatagtaagcatagtattgtagaggacaaagcatattaccatgttataaatgcagaataatacagatacagtataatccactgcaaaagcacaatatagtgtagcattgtgtaaaaggacaatactatgtattgtcatggacacatgcatatatagtaaaagtgaaaaaccattcaaggattgaccacataccaattttaggataatgcttattactctctgaggtaggagggaagattgaggttttaaaaaattcttattaaagtaaaaagattttgcaaatgtgacaacatttaaccattgttaagtctgtttggtgcatgattattatttttggtgcttttctgtgtatttaaaatgtttaacaattaaaaaattgaacagatgaagcgattgtgccgtgccacttttctgcttctgtgtatgtacgtttttgtgtgccttccgccgacattctctatcacatttttgctgtgatagagcatgaatgtgatagagaatctttagagtttcctctaaagaagcattgcagccccaagtatcttatctctaagggaacctgggggtgtgcagattagcctggcttcagggttgttgttcacagctcagcagcagagggcgctgctccatagcagatgtgcggtgggggtggccacaccaggcagctctcttggtgcagggccagtgcctcccagggaagcactgctctcccagggaagcactgctctccccagctgtgggaaagaggaatatttaagtacgtgcagattccctcctgcttgtaggagggggcacagaatccagccatttggaagcatacatcgtgtttctctgactattcacagccttggctgtttctgaggctaagaatgcaagaaacagcacatgccaagggcgtctttgctactatgtccgtgagcctgctgctgacttgtggggagcttttcgtaatgttttattttagattgaagaggttcatgttcaggtttgttacatgggtatattgcatcatggtggggcttggccttctagtgtacagatcactgtgggaatttttttgttgttaactgaccaaggaaccttccttttattttaggtggaaaaggattattcatacctgaaggagatatgtgatcaccaagccgaacagctgagcagaaccagcctaaagctgcaagaaaaagcatcagagagtgatgcagagatcaaagacatgaaagaaaccatatttgaattggaagatcaggtggaacagcaccgggctgtcaagttacacaataatcaactcatcagtgagctagaaagtaagtggggtctgccaggcatggtggctcacacctataatcccagcactttgggaggctgaggcaggaggatcacctgaggtcagaagttcgagacccagcctgaccaacatggtgaaaccctgtctctactaaaaatacaaaattagccgggcgtggtggtgggcgcctgtaatcccagctactcaggaggctgaggcaggagaatcacttgaacgcaggaggcggaggttgcagtgagccgagattgcgccactgcaaaagaaagcaaatgaggtcaagcccaggagaaatgtggaatggagctgagtaggacactaaagaaaccagcagcagtgggtgacgagggggggtgggtttgactgtatgttggctggggtttatgaagtctctcatttgagtgcgctgtaatctcctaggaagaatgtcacctaagaaacaatcattaatctccagtttaaaaactagagattaagagatcaatgatcatagcagttgaaaactgggatgacagaagaacaggctgttgaacatgagtcagcagtgtgtaggtgattgcgaaaaatagaaatgcttttcattttgttttttttaagaagtcttgctctatcaccctggctggagtgcagtggtgcagttgtagctcactgcagcctcaaactcctgggctcaggtgatcctcctggcctctcaaagcactgggattacaggtgtgagccaccgtattgagctgcaaatgttttttggctgtgctggatgtgttttgtgtgagccatgctactgctgctgtctccaggcagcctgatcagcttgaaggccacatgttaggatactttagctgtgactgtgagagttcacagggacccttcctaaggatattttgcagggtaggagaaggttattcagaagaaattgcttgccagtcatcaagtactgacactgtgttatctcttgtatctgacagagatggatgataggtatcagagtggatgaacaatgtgtgctcttggtctaagggagaaaacaattcccgcatgtgtcccattggtggtaggatatcaagtaacttctagatgtttgccacttagttgctgaagagacatcagcatatggcttatttatgaactcatagtttgctttgaattgggaaagaaatttttaaaagagattaaacattaccttctttgtccaaataagccttaccaaattatcacatctaatgtgttttcttttgtaacaaaagatttaatgcacaaagcatttagtcacaccagccattactaagaatagcttggtcagttgcctgagaagttccttaccccatgcagtcgatcctccttattcacagatttcacattggtgaattcatctgcttgataaaacgtattttaaccccaaaaccaatacacagagcacttccacagtcattttcagacatgcacagagaagtgaaaaggttgtgtcatccagtgcttatgttcccaactcgggtcagacagagacacttggccttctcatactgtacatgtgtcttttttacagtctgcttaataccatgcttttaacatttttgtgcttttgtttttggtgactttgctatttaaaatggccctgagtgcagtgctgtccactgtccccaagcacagtgaggttgagacgcacctacagagaaaacacgtgtattagggaagcttcatgcagacgcaagctcttgtcccgttgtgcgtgagttcggtgttattgaatcaacaaagcgcatcaggctaagtgcagtgacctcatccctgtaatctcagcactttgggagactgaggcaggaggatcgattgagcccaggagttcgagaccagcctgggcaacatagtgagaccctgtcttgacaaaaaaataaaataaaataaaaactagccacgtgtggtggcgcatgcctttagtcccagcttctctggaggctgaggtgggaggatcccttgagcctgaaaggctgagactgcagtgaaccaagattgtgccactgcactccagcctgggcaatagagcaagactgcatctctaaaaaaataaaaaaaccaaaccaaacaaaaaagcccaatacggtgcatcagagaaagggagaagtttgacaatatgtatataaggctgccctgagacatgctaaagcgatgtgctaaagcagccaaattcatggatttgtgagatgacagccagttttaaaaagctgtgggcaatattgttgtgtggctgaaaaccaaagcaatatttgttcacatcacccagggtcaggaaaatgttaaccccttcttggctagtgctggttggctcccaagtttcaaaaggccataaagtgtgagaaaggttaaccttgcaggcaggggaggttctgcagatcaggaggctgaagaagaatttaaaaatacttgctaagtgttattcaggaagaggaaaaaaggaaagagtgggtttccatggttgatgagcctggcttgtttatagagacattggcagatacgtctatataatgcaaatggcattttagttgatgagaatgttgtgaccagaggcttgcaggaacctaacctgtatttttcctagagacaatagttcggtgtttgctgatttggtgtgcatggcaactctctgcaactaccatgattattagaattgactatgtatttcagacattgactagttggttagagtgacagttgacagcacctgccccatttctccttgaacatgacatgtagtagaactgcagaacctcagcgttcagtgtcagtgccatccaggctgttctcaggatacaactgaaaacctggacgccatcatcatcagtgtatccttccaaacccagcaccatgattgagaagaaaagtcaagacaagttctgttttgtttttgtttttgtgatattttgctgttgaaaatagggttgtattgtccctaaatccttaaaagtcagcacagacacactaagaaaaccagtgtataattaatgtccacagcaaaatttagacacatgcctgtggttatatcatcatatatccaagactgacaacaatgcaagccatcttttgaaaaacttttaaactttttaaaaggatattgaggtattgttaagatatgtttttgcacagagacctagggacacataaatccagcctagaccaatcacttcttcctataagatcctgatgggaaaggaatggactggaaaataaaaggaagttagggagtgttttctactgtgcagcattgattccagacacaaactctcagtcccactagaactagaactgctggggtaggacctgcccacagcatctttttagcctactctggtgattctgatttgcatccttcatagaaagctaatgctctaggttagagcatgaggacctattgaggaatttcagctcagtgactgacaccatcagatttaaatttgaatgactctgatagccagatggagagaattggaggcaaggagaacaaggggctgcaggtgtccttaagtagggagaggcaggcaaccacctgggaagatgttaaatgcacacatccccgggttctgtctgcccttggagattctgcctccaggtgtctggagtgtgggactagaacatcggtgcttttgaaaagcttcaccagtgatttagaggcttaactgtgattgagacccatgactctagaaagtgctttacaaatcacaggaggaataagcattcatgtgctctgttatgtgaaagcctctatctcacagcaataaaggacacttaggacgattgtgtgtgagtgcgagggaggccggactcggtatgcaagtgtgcatggccatggaggcctcttcccgtagtgctgctatttggttgtgcattctgtctgctgagactgtaacctcaatacacatcacatattttccagatcatcctgttctttatctcagaggaggctcttgtgtccattccctggtttacagggtaaattgaaattgctaaaagttgcatttagagtagaatggatggatttggatgcctgttgtggcatctggagctgcccctttctttgctacctagcgtgtcttctcttaagagtctcacagcttttctaagccctgtctgaattatttatttctaggtagtgtgatcaagctggaggaacagaagtcagacctggagaggcagctgaagactctgaccaagcagatgaaggtgagatgcgggtgggagccttcaccaccatcttcctatgaattacccgctccgaggtgtggatcactctctctatcctgctttctcttggaacgtttccacggcatggtgggccctggaactgtaaattcttgttggcaggaagtaaaatcaaaggagtcatttggtgtcaggatggagaattctcataacctgaaggtgtaattccaccagtgccttttcctagcagtgagccaccgtgtaagcagggcctcaccaagcactgatggcatttttttcttggtgaccaacacggggactctggggtccctgcccaggcactggccctggcaggcgtctgacataaggatgggctctgacattttcaggaggagaccgaggaatggaggcggttccaggcggatctgcagaccgcagtggtggtggccaatgacatcaagtgtgaggcccagcaggagctgcgcaccgtgaagaggaaactgctggaggaggaggagaagaatgcccggttgcagaaggagctgggggatgtgcagggccacggcagggtggtcaccagcagagccgcccctccgtgagtctggtgggcaccagggccgtgcttgcttctcaatcactatgtatggggctccctggtggggatgggactcttcatgtctgtgccaggttctgctatttcctttctgagatcaccctgaattactagcaccaccttaccactaggaacattctgtacagtacccagtccctgccatgctgcagcataagaggctgctaagctcctcacttacatatgaagggccagttctagccaagtatcctgctaggcttaaagaatagaagtcctgtctagaatgctccctgaatcttagtatttattaatgcaggggagtgcacactaataaatacgaatccaccaccttgtacaggtcactcccatgcagtgggagaagctggaatcactcccaaggggaggagccgccggagaaggacacattcctctgggcccaaggatgtgcctgcttattgagaacacccatgagctacgtcaaaaggccttgacataacctattttattaaaaaaggatgagagtagaaaacatgcatttggctgatgtgtgacattcccttctgctcttgatggggagaagcacacagtgtatcagcccagggagctctactaacagtgacatttaagaggaaggtattcccaaagtgaatgcaatgttaattattatctgaaatttagatggtttacagacaaatttataaacagcattttttgctttagctaatattatatttacccaatgaggaatcagtgtccttaactttgagattcttggatattaggaaatgattttgaatttttaggtgtctctcaaatatcaaacatagtctttttagatcaaatttcctgggttttgaatgttgatcaggtggccctagtgtttacatgtttccaagatcagtggctagctcctgagccttttgatctgatgtttggttatcatgaatttcatgacattggaaagaggagatttttcagaattcagctgtgattctcctgtcaattctgctccaagtaattccttatttctttgtttataacttttacataaaatggcctttggggaaggatgaagatcagatatagctagctccacaattcactgttgaaaaatcaatatcgagatcattattttatttagttatttatttttagagatgggggtctcactatgttgcccaggctggactcgaactactgagcccaggagattcttctgcctcagccttctgactaactaggactacacatgcgccagacaaggtcattactttatagacagagctctccctctggacaccaaaggatgtgaattttaagtggaggtagagggagaataggaaaactaggtttcacagtgttccctactgaaacagtagtgaggccgttctgggtggcctctgtgtctgcttttgtttcgtttgcctctgtcttgcttccctattgtctgtcattggaagaaaatccgagtcagaacttgtgttgcttcacatgtacgttattttaatgataaatggtaaaagacaagtcctgagtttctatggtggccctgaataggttcttgtatgagatgctgtgtttcttacgtatactctgagacacaggccaggttcttctatgagatgccatgtttcttatgtatattctgagacacaggccagaccatgcagcgtgaaccctgatattctaggaaatctccgcatacgtcctgccagtttaggactccctatgctgcatcctgcatcttcaatcttaacgtcacgtttttttttaagcacagaatgtttcttttttgattttccagtgatttgcaaacctacctcccaatctaacagtttaatcccttctcaaaaaacatttcaaaattttagaatggacaccaatgagaacatgtcatggtactgaaatcaggcatcagaacgtttctgtctgtcagtgcatttggcaggaagtcagacaagtgccggagatgctggtttcttgtctgattttgcacttctctggcaagctgccccttgtaaagagttgactatatggcagttagttgctggtggttcagccacttccagcacctaccccatgagcaagacttgaaaccaactcacaccctcaaagctccggaagccacctagtgtttccatcttgactgaatgagttcttgattgaaactcagtttgactttgacagtcatctagtgagaactcaaaagtcattcttggttcagccacagccaaagaacttgcagagcattctctgacgaggtcctcaaggacaactgagagaaggtaagatcacccaaaaagcacctggatccagacatgagattacctggttcttaagctctgtttgcgtccgtgggcactcacagggttggttgcagccaggctgataagcacgagatgaagcacctgggcagaaatgcaaaccagcattcattgctggaactcagtaactaaacagtgggatattatctaactcatccatgatcttcggtcctgttacactttcacagatatttttatttcagagtcagaataactgatgttaaggtatgtggggaaggaaggcggtagcctcatctttgcagtcaaccagcaatatctcattcccagtgtcatgtttgcagccaaccagtaacatctcattctcagccctgcctcttgcctctgttaaaagaggtgggaagagggggtcgtttttgaggtctctttaagctctgctgttctctggactggttggttagctgacctttccctggtgggagagtaagaaactccagtgccagccttagagttattctggtgcaatgccttgaacctctttgacacagtggcatctccatatcttagttgtggcttgggagcctgctctttctcttccagaaatgtgaacaagccagtgtgtttttagggacctaaaagtgatctgtttcattggacacatataatgtaatagatgaaaagataataactttttcagctctggctcctcccagttttgaaaactaccaattgagaaaaaggctttgaaatgaaaactctcactgaaatgaacccgtcacatctttttcctgaaaagttgagtcctgggacctggcaaaaacagaaaaaacacaggcagctcaatgtaatgatatattgtgccgcatacaagctttctaatgaaagacatggttcgtgagcagtgcatggcacaggcttctcaagcagcatcagggaaagacctctgtgtttgtggcatttgttcctcttgttctgaaacagcaaatgccattacttttagggtgacttatctgattcttactgtgtctgtcatataacaccaataaacatccatggaaaacgtctttaaaagagataattaaacacacttaatatctgtgcctaattaatgctgttggtttctaaatagaatgtctgtgattcgaatgtgtttcattttgcctataccacaagttcttgcattgtcccctcttggaggtgagcagtgtggcagcgcagcacgtgcagactccactggaattggcttaactccatgtgtgcacatccgtgtcagcctgagtgtcactgtgtgtgcctgtgctgccctctgtgttgctctgatggctctaatgggtcacagccgctcagcatgtgttctccagctaccatggagaggggaggggcggaagttggaggtatagattctttaaggtcccttttccagctgtcttgccacagatgctctgatactgagcccctctcccaggtggaggggggctgttctcctgaggattcttaagcagtttctgaacagacctcaccttagcacccatgacggcatgatggacaggggtctccagcatttaatttggcccttgatgcagaacctggtcctctcaatgtgctcttattccagctagcattatctgttccctcacctagtactctttttttcatagtttaaatgtacatttatgacattagacacacagtctataattctaaagagctgtgtctgcctccctgttctctgacccctgattttacagatttcaacaatgtggacataagcttcccttaggcctttaggatttttaggttgcagttataaaagcaagaaggtttttggccttgacagtagagagaagcatgagcctctgtaaattctggaggggcctatggtgttcatcctggacatctctgcttcaccacacagttctttgctggagaagttctggtggaggagcctagtacaggcatttgcagtctggctttttttttttttttttttatgtctgaaaacctttggcttccaaaaaattggaacagtaggacttaaaatctgttggcctatcctggacattagcttttccctgtgggacagtgtaagctggaaattcttgcgtttgtgaactaagactgtattgccttaggtaactcctttacagcctctccctcccgtttctattttcacagctccctgggctctgtcagctagcagagcatttggtggaagaaagacagcccagctcttgccatgattgggagccgcagccatctctagatgaaagggggaatgtgtagaggagaaattgcctctttataaagagcccagttgtctccttgtgacattctctgtttctcagagtcattgccgtcgagtctctgctttttgtccacattttgggatcagcttactgcatgatcaaagatgatgtttccctctttttacttttcctcagaagattgagctgtcttttatttggagaataaaatgaagttctgaaaaaaacaaagtacaagtcttatgaaaagttatttgcagctggagtgctgaaaagggcacagtggcagagcagatgcagagctgggtacagcgcaggcccgagttcttttgttttttgttgttgttgttgttgttgttttgttttgttttttttttttttttgagacagagtttcactcttgttgcccaggctggagtgcaatggtacgatctcggctcactgcaacctctgcctcccgggttcaagtgattctcttgcctcagccttccaagtagctggaattacaggcgcctgccaccacacccagctaatttttgtattgttagtagagatggggtttcaccgtgttggccaggctgctcttgaactcctgacctcaggtgatccccacctcagcctcccaaagtgctgggattacagacatgagccaccgcacccagaacctaaggcccaagttctactttttggtgttcatttctctgcttccttttgatcgtggtgtctgatcatcttggaattcacattactcaaggcaaaataggaagccatctgcgtgatgtcacattccgaagaagtcagaaggttcggcgagttggagctttactcttgttgcccaggctagagtgcagtggtgcgatcttggctcattgcaagctccgcttcctgggtttaagctattctcctgccttggcctcccaagtagctgggattacaggcatgtgccgtcactcctggctaattttgtatttttagtagagatgcaatttcaccatgttggtcaggctggtctcgaactcctgacctcaagtgatctggccgcctcagcctcccaaagtgctgggattacaggcttgagaccccatgtctggccccttctgtggggtcttgattgagccccttcacttggagtctgacttcattacctcgtctgaaacaaggtgcctccaagctttgggttgatttccagaatcttgttgggttaaacataagtagaagtttgatcataaaggatgttattaagccggataggtaagcacggtgacaatggcaatagaaatctaatggaaaacgattgaatgacaactacaccaaagtttcatggatgaaactcaccccagaaacttagtgttcaaatcagagtgatacacaattcaaaatgtgattttaaacttctggaaatatgtgtgtttgtgaagatccaaatccaattcagcaacctccatcaggcagaaaccttctgcaatcctcacatgaggaactggttcacagtgtacacagcatggagccattagtgacgttatccaaaggatgagacaagacaaaagttactgtctaataaaaggaaaattaggaacaggaatgctctttaaactcaggaagatcttttggggtgtcaaactggacagcacagaatcattagaaaaattagcttggcgtgagaagagacattgaggtcttctctgtaaaatttacttagatacttgtgaataggactgaaatttatattttgggcactctttacctcagattcagagttcttaggattatttaaaattcatttgctggatgttttcaagtataaacaataagaaaactgcaacttcaacttaaaaggcactgctgtatttgcaccctatattttgacctgtcgttaggtactgttgaatatttttatctgtaagcatttatgaagtgcaaaataaacatgttattatatagaagcgtctgctgcttagttttaatcaccagctacgtttctgcagggcctttatgtcgttttgttctacatttttttctgaatacagtttcagaacttcaaagtcacatcaagtaactagaatttgaggtagaaaaaagctggatgtaagttgtaaataggaggttgacatggaatatgaacagtttcattagtagaacaaaagggcatggagtaaaaatgctaattttgcataaatttttaaaactctagggtctcagaaaatatagcatggacttaaagtctagatgtgttttgttgacatttaaatatgaatagattgatgatttaatgtattggattttttcttaattatgaagtattatttaggtatactaataacaaaatggagacgtgtgaagaaaaatattaatctttcttctccctcagtaccacctgtgaggaaatcagtgttaacagtgtgtacatttttctttactcatgaatatgtatagggttcattttcatatttttaataaaaattggattatattcttttcagtactctgcacctttttattttatcatatcataggcatccttccaggtcaatacatagaaatctatcttattttaagagcaacatgaccttccataggaaggatatgtcctggaatattaaaatattgtcttactaatgcacaacaaggttataattttttttttatgagtaatgctataatagcagtccttattcatatagtcctatgtagttgtggttttatttttatagaatgggtttttcaaaatactattgctgctctaaagtatatgcacatttttattttaatagatgtctccaattactcacctgagtgctgtgacatttcactcttgaacatgcccatctgtatacatcctgagcagtagtggagagccttgatcatatttttgccaataggataatcaaaaaatactatcttattagcactttaatttgcatttcgctgagttttttttttttttttttttttttttttttttaaagacagggcctcactctgtcacctaggctggagtgcagtggtacagtcatggctcactgcagcctcaacctcctggacttgagcagtcctcccaccccagcctcctgagtagctgggactacaggggcacaccaccatgtccagctaattttttttttttttttttttttttttttttttggtagacacgaggtctcactgtgttgcacagagagactggtatcgaactcctgggctcaagtgatcctcccaactcagcctcccaaagtgcagggattacagccatgagccaccatgcccagccctttctaagcacatctttgtatgtttactaaccactgcattttctcttctaagaattactagttttgcaacttttccctgctttttcactgagctgattgtttttttctcatcagcttataagtcagtattttattagggatacggttgtatcccctatattatgagcctttatcatatttttcatgtgatatggctttatctttatcatagaaaattttatatttttatgtaaactgttagtgttttcctttactcttttttttaagattccttctccccagtattatacaaatgtgctattaaatgtcttcatctacttgatgcacacacatatgcaggccatttgatccacctctctttatttaatctgatgtgaggtgtggttctttttctcccactgggtagcactgtttattaccagagtcatcctttgtccactgaattgaaatcccacctttacatggtttatgtcatccacattcagagagacctgccctagatgtgctcccatttctttctcttttgagttagctctgctttaaaatattcatagattattagattgcttatattacttttaactcatcctttcatttaaaatttttattttattgaattttaaggcagacagtatcagtgttgaactctgtttccagtcatgaatttacaaacgccagtcctctcttgagtgcagtttccccttcactttgtattatgaactgtttgcatcgagcagggcatgattttgcctgtcaccttctcttgctgaagcagatccaggtgtggcagggcctgacgtttgccccaggtccgtgtctgaattctgctcagatccactgcctttgcctgacagtgcttctgatcttcttctcatgacttaaacgtgttgggaggctcttgaaggtacatttgtattacatacttggaggtacagaagcccaggtagagtagagaagggtgagtgcctagttgggaaattcacctgtacccagtttcttctctgcctggtgagcctggaacgcagagccagctctctggatctctttgcgtgcccctcatccattttaggtgcacactgtggctcttcctatcctgccccttgtcactactgccctttatgcctagggtaaaccaaccttggccttctcggatgtaaattcttcttgttcctgatcctttgccaaaacgccgtgcatctctctgggcttctcatgctcctctccagccttggccctctagggtgggggacattagttggggttttcccatatctccattttctttggaagggaattgagggaaagcccttggtattgtattttcattcccccgaccgtgtactctctattagcagaaattcttcagaatctaagccacgtcaatgatactcgactacaggacttttactatttgattcttattgttgggatttgtagattatgatgctggtgttcaaattactttcttatcctgtttgtttttattgttatatatgcttttactgaaatttgaaagtgaaatttagaagatattgtttgacacctaagagacaaagtacttcataatttctgtcttcaaatagagtgaaaaacttctgttagatttgttttatgcaaaataagtatttagaaaaaattacattccaggcaagggcatagaatgagcaaaggcacagaggcagggcataaaagtaaaaaacttcaggtgaatagtccaaaactagatgggcagaggggagtcttgggagattaactgaaagacctggggttgggctttgttcaggtgttcagtaaagagaccggcaggcgtgagcatgtggttgacatgcgacccgccctcttcacaaatattaatctgccaattgtgaaggtagcagtggtgccatacaacactacccaaatggagttaacctttgaatactttaaaaatcatcatgtacaggagctcacctgttcctggatcagaatgaacaatgacataaagtgctgtttttaggaagtaaatgctgtagaccatgactgacatttgaaaactctgttctctaacataacaaggaaagcagcaaattagagaggttaaataaaagttttaaagggaaataattagagacatgtatgtatatgtgcttaaatgacaaggtgaggcatggaaggcagaccgacattcagtgaggagggccatgtgccttgctgtgctccatggagacactgtctgcttatggagtgtgcatcacctgctgtgtgtgacacagcatcaggcggtctggcctgcaactgttgttctctagtatctggcctgcaactgttgttctctagtatgggttgccgccttttaagagcagattattgtataaagataggaacactgaaataacttggtagtattttttaaatgtacttaaaatttaggaagaaataccatcagtattatttctagaaccttgtatatctctcacagaacatttatgcattatagaaaatttgagaaatgcgtggccagagctggatttgcaccccagtttcaccattcatgaatcatgtgaccatggtcaaattttcctctaaaataagggataataatatctagttttgttgaaaattaaattagataatgcttttaagacacatggtactgtgcttggcatatacagtggagttatacacattcatatttgttttgctgaaattatcgattattatcccagttttatatgctgggagcaggtagaatacttgcttcatttttgttgttttaagcatggcccctaaacactaagcacctatttaatgtgtgatgtaactgaagaaagagccaatcatgaaatgctggagggaatgcaagtatgtgagacttctggagagttggtgtgtttgtaaacagtcatgtttacaaaagcatgtacttttgagtgactcaaattattttcatggtttatttgactacatgtgtgattattactttgcaggttgattttagaacctaacatcagccttagaggcagtagcaagccttgaacaagtgtttctccagtagtggtaccttgcagtttttcttttatttaatgctaagacatacctggctgtatacttacatatttcttaatattcattatagaatacagagtttttattcttccttggaacagaggaaatgtaagacttcatttatggctgaggctgttactaattgatcccagccaattctaaaataggctggtgtaaggattttcagcctcatttatgatttaagtacatactaataagccaatagcattcttaataaccattttctttggttattcaattcaggctatgttttgtgaatccctctcacatacacagagagacacacagacacacacacacataccactgttacataacacagtgggtatttctcttctcaaattatacagggttttctcatactgactcttattgttctggccaagtagacttagtgtttgaaataccatctttggatacctgaagcctgaggtaattgattcttgtggccttgctttttaaatttatcatttgatattttgaattgcagataaatttagataactgaaaggaataacctcagcagaatgtaggcgtctccattttgttcttattaaattatcaaagaatgaaatgtaaaatgaattatttaaaatgattgtccttgggggcctttggtactgagtcatttaaatggactggtaagaaggtggccaggcgcagtggctcatgcctgtaatcctggcactttgggaggccaaggcaggcagattgtctgagctcaggaggttgagaccagcctgggcaacatggcgaaaccccatctctactaaaaaaaaaaaatacgaaagattagcaaagtgtgctggtgcttgcctgtagtcccagcaagctacgcaggaggctgaggcattagaatcgcttgaacctgggaggtagaggttgcagtgagccaagatcacaccactgcactccagcctgggcgacagagcgagactctgtctcagaacaaaaaaaaggtggcccattttgtttgttgatgaccttcatgagaatggctagcacagaccgaggaaattattttctgctcaaacctaacctgatttctttttctttctgcatttttgccacctgattttattgtatgggaaagtatgaaaaccagttcctctcaataaaattatttaaaaattattttaaaaacccaacctcctacaatttctgaagtgcctgataatttcttccaatgaagttttcagtttactgattttttttttcactcataagaagggactgtggagtgaagattgtaaggcagtgtggtttaactgttttaagttctgtttctcttaaatttattctattcatgttatttacagagcaacagaagaaagcttagagaattaaagacaaattcaactggagaagcttatgagtagtagctagattaatttgaaaatgatcagtaaataactattttatttactgatttattttaaacttccaccgaccttattgaaatatacttccagaaacattctgtttgaactattatcataaattagtcatcttgcaaaacagctgtggcaatatgatacaatgaagagagcagtgatttagcaatgagaaggttgggagttcttgtcttggctccttcacagggagatcacatgacatgccaaagtcccctatatgaggaagccatgcattgagaggattgaggattgggtcaatgatctatcatagaatgctttctatgagtctagaagcctcatgaagaacacaccaggaaacttgggtgagagcaggagcttcacctcatgcagaattgcagtgtgattttagagtgctgttaccattcttatgcttagaagtcagagtgtctgaatcaggattctgttgtgtataatggattgcactctcgttggcttaggcagaaaggtgttaaatggtttgcagaattgttgggaaggctgagcttccaggagcagctcccaaagtctccacacacaactggaccaccagggaacctgctccctccaccaggacaggagccttaacttcagaaagctgcccacccagttggaaagctgccaccacagttgccagcaccatagcatcttgtctctgctacagtctctgtctacatagtgaatgcccggtgccctgcctctcttcctctgattcaggtcccactccaggtcttgcccaagtctttctgattggtggaacttaaatcacacccaaaatcccagctgtaggagagctgtgagatttcatctttccaaactctgtgtactgcatgggggttggagcacatgtcggcagccggtccactgcattcaccattgacagtaggtgaaatatttatggtcaataacatttgcattttttcacaaaaaatgcacaatttgcagagtagccatacacactttttatttagagctaatatcaagtcactctacatataaaaataattatttctgaccatttcccaagaaaacagctcttctaaaaattgagagcaatgcctacattatttcctaaagatgcaaactggtagagaaaacaggatgttaaattcagaatttcccttccagcttcatttattttctccacatcagttctgttttcctctgtgtctttttctcccatggggatgtcctccatcttttcaatctgatttgctctttgccatgcagacctgtggatgaagagccagagtcctctgaggtcgatgctgctggtcggtggcctggtgtctgtgttagcagaacatctccaacacccccagagtcggcaaccaccgttaagtcacttatcaagtcatttgacttgggacgcccaggtatttaatcattttttctataagcaaagctccaaattcaaactttggcccgacatttgatatgtctactatctctactccaccctggccctgtgttgttacaaccacaagggcgctttccaggtcctaccacgtgcagccactgcatgcaggagcctggctgaggctccagggaggcactgatggagagcctggctcatgaataacacaaatgcagcctcttcctctctaccgcttccttccatccagttcctgccttgctacctttcttttctgcctctcatagccattaaattcaggtcactactatttgcctttttgtcatctcatgagaattatgagggtcagctggagacttcatctcctaggaaacgagacatcacatctctgcacctggccctcttggaggcacccctggccatccccatcttgcaacctgctagacgtttttctacctggtcttgtacgtgagcacctgtgctaatctgtcactcctgatctaggtgtgttcccagcttttcctggtgttgtctgatggtctcacaattcccctttagtcatgcttatcttcctatatgagaaagatgcgtagctatacttcatacatatactgtacacataaacatagcaaatagaagaaacagaatgtgcatctgtctacagtaacaatatctttcttccccagagtgcaacaaacatgccattgtattgggagactgtagtaaaagttaatcctaggatgtacctggttgtctctgctaaaattgtttgcacctaaattagattaagactagactctacatattcaaagacatgaaagcctttcatgtctgtgaagacaggaaatgaattaacaatttgtacaagaacttttctgttccttccttctctaggcatctcattatttatacagtttctttttgctcagctatccttcatctaagactgacctccactcagctaaatcttcccttcttgtttccccaaagcagctctagtccggagaagaaaaggataatagagtaaatattacactaaacacggatactccttaagccaccaaaaaaagtaacaagaaatcaggaacaagtatatgctattttgaagtggaacaacatataaatgttcccatgttttttcttggcaggtggagctggacagaatatttctgtccataagacccccagaagtcccctaagtgggataccagtgaggactgctccagcagctgctgtctctccaatgcaggtagatgagccccagaaataaccactgcttatggtttgctgtgtatccctctagatgtttttctttacacatattagtgtccgtgtgtgtatgtgtgtgtgtagagtatgtgttttgtaaattggattgcactatgcattattccaatacttatttcactttatcatcggaatgtaagcttcatgaggtcagatatttttgttcattttgcttgctgttttatctcttgtctgtaacactggttggcacatggtcacattatagtagaagttcaataaatattaaatgaatgaaggaatatgttttcaaattttaatatttgcagaaacgattctttttataaaagattacataatatgtggtgatttatttagccactgttctactgatagaagttaggtttttttggatttaacttattacaaaaaataatacagtgaagatactgatacaaatttttgaccacttaaggggctactttttaaataagggtatatcaagattcatttgtaagtatcagagatgactgtagttaagcagaaaggaatttaatacagggattttggtactgagggctggagaaaggtctaggctgcactgagcttccaggaaaggttcccagagcatctgaaagttggcccattaaaggagcttctgtttctgccagaatcgggaagtctttctctaagtgcttacccaggactgccactgctaccaagatctaggatcagcctggtgactacactgccacaggtgcagtccatgccagaaaagcacactctgtgcctgccccatactgaccagaaaacggtggaacagaccccagaacctctgctcccctgccacagaacagcgaatgccttcccagccatgtttaccaggagaagctgcagaagggaagccttacactcccttgcaccttccagatcctctgagaaggggcctgtttgacagaagctaggccacttgatgagccaagctttaaaggagtttgccaagtacaccctttagcttcccagtcccttatagttcaataagtcgccctacaaggagatgaggatggagttgagtgagcccgtcttgagatcttctacaaattgattcctagtgaaggaaaatggagtcctagaaaaggaaatgtatttgacctgttccagcatgtcgaaaaacttgatagacacattgcccttcagtttgccctcccgcttacagtactattttccaagaattttgacactgtctataatttttgaagatcaagtaagtgaacaataatatcttgttttactttatcagtaaggtggagcacttcttcgtatgattataggccatttatctcttgtgtgtcggtgtggaaacttacatactttgcctgcttttcttttgaagtgttagtctgtttatgttttgtaagaagtattgatatattgtgctttttaacattttttcatatgtaattgtattaccttttttatcttttaatgtcatattaatagttatcttttactgaagagaaattttacatgtttgtgttgtgttttaagattttgttttgtttcctgccttaaaatgtcttttctagctattagatgattaaaatattctccctaaatatcttaaggaagtcttttatttcttcagtcttaaaacccatagaaacatgggtttggatttagatattcttcccctatcttaactgccttctggaagcagaagtaaatactctctggaggacaattacaccatctagatccttaaattatagccacattttaaaaaatacaacgttatatagtaactttaaacaataccaggcatggccaggtgcagtggctcatgcctgtaatcctagcattttgggaggccgaagcaggcagatcacgaggtcaggagttcgagaccagggtggccgacatagtgaaaccccgtctctactaaaaatacaaaaatcaactgggcatggtggtgtgtgcctgttgtcccagccactcaggaggctgaggcaggagaatcacttgaactcaggaggcagaggttgtggtaagctgagatcgcgccactgcattccagcctgggcaacagagcaagactccatcttaaaataaaataaaataaaacaaaaaaccaggcatacaaatagataataccaaatgatgaaaagccaagagaaaaaatagacaatagaaacagacacggaagattcagatattgatattattagacatagaccctaaaacaactgagattaatgctgtcaacaaaataagtgacaaggtagagaatttcagcagaaaaccacaatgtataaaaaagaatctgttagagattttatgacttaaaaataaaatacctgaattaaagactcaataaagtttagctgtagcttaaacagtttaagagaggcttaaagaactgaagacaagtcagtataaatatctgaactgaagcacagagaaaaaggataggaaatagagaaaaggacataagaaacatatgggatggaataaaaaaatctcatgtgtaattggagtccccaaaaggggagaaaaagagcagaagtgatattggaagggataatgatcaagaatttccaaaactgataaaagatgtcaagcccagattcaagaaacaataagaaccccaagtgagataagtacaaagaaaaccacccagacacatgaggttaaaactgctggaaatgaaagagaaagcatcctaaaagcacccaaaagaaaaaagatacctcaatgtccaaggaggaagagcaaaactgacatctttcttctcaagaagaatgatggaagccctgaagacaatgcagtggcatctgcaaaatgctgaaagaaaacacctgctttcctttacctcatgaaaatatgcttcaaagtgctgtacctggtgaaaatacccttcaaaggtgaacacaaaagaaagatgctttgagtccaacaaaaccagatgttttttcctaggatacttgcagtgaaaagactatttaaaggagttctgcatggagtttgttcttttaaaagactattaaaattcaaaacatctgacaagaaaagctaatgcaaaattacctgtatcaggaatttgtaaatgggtacatcactaaagatttcataattattaaagcaatagtaagagaatattatatattactactttgtgctataaattagaaaatattgatgaaatggtcaaaatcttagaaaaatgtaacgtgctaaacttacataggagagagtagtagaaaatctcaatcacctataatttatatcttttccttaaaagaaatgccagggccttatggcttcaccatgaaacctcccaaacatttaaggaagaaataatgtcaatcttacgtaaattcagagactaggaaagaggtcagcatagctttgatccctaatagttgcaagaacattaatagacaagaaaattaaaaggtctttctcacgaacctctttgcaaaaatcctgaacaaaatcttggaaaaccttattcagagacacatgaaaaagatcatgtcatgttgggtttattccaggaatggaaggtggttaatattgaagccaaccagagtaattcaccacattaacaaaggtataaaaagaatatggttggccaggtacaatggcttatgcctgtaatcccagcactttgggaggccaaggtaggtggatcactggaggccaggagttcaagaccactctggtcaccatggcgaaaccccatctctactaaaaatacaaaaattagctgggcgtggtggtgcacgcctgtaacccccagctacttgggaggctgaggcacaagaatggcttaaatccaggaggcggaggttgcagtcacctgagatcattgccattccactcctgggcgacagagtaagactctatctcaaaaaaaaaaaaaaaaagcatatggtcatcttagtaggtggtggcaggaaaatgtagtcgataaagattaatatctttcttgatggaaattcttagaaaagtaggaatagaagggaaagtctttaatctgataaagggtctgtattatatatctacagcaaacatcatacttaatggtgaaatatcggatgctttcccacaggattgtgaatgggataggaatgccccatattgtcacttttgttcagccaacttcaaaagcaagatttaaaactacttttgaaaactgtataccacgaccattatatttttgtgggatgtggatacatggaattgtgtttaatatgctatgaagtagagcctctaagagaaaataatgttctggaaagcctcagaatggccctgcacaggcaaatgtaccaggttgttcattgcagcattgttcctaatatcaatatcaacatgaatatcaatagagaatcagtaaaataaattatggtaatgaaaatagctaagatctactgaatgcttactatctgctgggctgtgttttgattgttctaactggatttaactcatttaatcctcccataaccctttgaggtaagtacgtttagtatcgttgccattttataaataaagaaaataaggcacagaaaattaagtaacccagagtctcacaggtgggtggtgccatctgtccccagagccacttacttggcctcttgtggcacttctcagaggaagctgccaagatggtgggtgatggtgggtatagaatgacttctaagatacagtaagtgaaagaagcaaaatggtgtacaaaacaatataatgctatgataacagttgtgtttttagaaaaacagagggtgtttttcaaggtttttccttgaataatatcatgcttacttgcattctgaaatgcttttttaaatggcagtaaaaaaaatacaccatgaaatctactctattaacaaatttttaagtattgttaactagaagcacaatattgtatggcaggtctctagaaaaatttttttttaaatttttaattttatttcagattcagggtgtacatgtacagatttgttacatggatatattgtgggatgctgaggtttggggtatgattgatcccatcacccaagtagtgagcatagtacccaacaggttttcagtgcttgcctccccctcctctagcactccccagtgtctcttgttgccatctttctgtcctctagaactttgttatcttgcctgactgaaactctgtatccacggaacaattccccacttcccctccctgaggcctctgggagccaccactccactgtctgcttctgtgattttgactactttagattcctcacgtacatagagttatgccgctcttgtccttcagtgactggtgtatttgacttagcataatgtctccaaaactcatttatgttgtagcatgggacaggatttccttcttttttaaggctgaataatattccattgtatattctataccacattttcttcgtccattcatctggtggtggacactggggttgcttccacgtcttggctgttgtgaattatgctgcaatgagcaagagagtgcaagtatctctttgagatcctgttttcaattttcttggataaatacctagaagtggtgttgctggatcatttggtagtactatttctaattttttgaggaacctccatactgttctgcgtaatggctgcaccattgtacattcccactaacagtacacaggagtttcattttctctacctcctcaccaatacttgttctttttcagttttttttttttgatgatggtcttcctaataaatgtgaggtggcgtgtcactgtggttttggtttgcatttccctgatgattagtgatgttgagcatcttttcatatacctattaaccattaaaaatagaatacttatacacacatccttgaatatacatagaacattccaggaaagatattcacaaagccaattaataatgattgcccttggagagaagaactgggagatgggaaggaaaaggagactttctcttcattatttgcccttttcattgcttttggggatagtgtctattgcatgtattacctattcaaataaatgagttaattaaaaactcccctggttattccactgtgtttaagaactgttgcacacacacgcatgcacacacacacatctgtgtttgtgctattcttgatgttatgagctcaccgtgctggtgtccccctggtttttacagaggcattcgacttacagcagtgtgcggccagccagcagaggggtgactcaacgcttggaccttcctgaccttcccctctcaggtaaattatgtcaacataaagaacttttgacttatctttccgtgcagttaacttttcttcatttctctgcatgaaactgagcttagaaaaataatcagtggcatttcttgcaagtgatttcaaccccgaataatgtacatatcatgaatgttagatgcagcagtgcagctgacaaaaggaaaaagtgtctcctgccagctgcacttctcagtgcccttgtgctggggagacaggcccaattttttttttcttttccttttttcagagacatggtcttgctttgtttcccaggctggtctcaaactcctggtctcaagtgatcctcctgcctcggcctcccacagtgctgggattataggtgtgagccactgtgcctggcatattgttttttaactgaacctcaagagcatattttctaatctttaaaaagtaactaagggaaaaaatcttacctgattttgaatttgtctgctacttctgcaattcttaaaatttgcccctttaaaggtatttgtcttttggtgcagtcctcttcctgttgttacaccgtgtgtgtgtgtgtgtgtgtgtgtgtgtgtgtgtgtgtgtgtatttgttttttgttttaactccaatcctggttgtaaagtggaggttgcattcagcagtcccagcagtccccatccatcacatttgcgtggcgtcatatttcctgtgtcacaggctgatgtgaagcagccctcaagaagggacacgtgggcttgagtctcagtactgctgctcagcctggctttggccccatcaccccacttctctgtgctttagtctcctcatctctaaaacggaaataatccggtccacttcctaggattgtatcaaggattgagttagcacattaaagcgccttgaacatgctgggtgtgtggcaagcactgtggaagtgtttactgtgcacatctcacctgctgttctctgctgacccagttcgcctgcccagaactaaagggacaacagtgctcaagcctagtgggaagttaaggttgtccagaatacggggcttagaacctatgtatgtgtctatgtggtgactgttaggaaataaaaaaggcaaaaagaacactgaatggactgtttactggtccctgtagaagggatagaaagccaaaagtctgggtcacatggacagaaatccttttgtttctaagcataaaataaaatttctacagctgtacttcctttagatcttggtcaaacacaatcaggcttgttcttaaaatagttgtttctatgagggaactttcccctctgaatcttctttgctttttcatggaattaaataaggattttagagttgggtaaacactgacaattgagaatttgaagatgatctgagcccattcctcgagttttacatgggagagattcaagccctacagaaattgagtgacttataaaggctacagcgattttggatggctgtggggccaggaagtctcctgattctttctaccatgtgcctcttggtgctgaggctggtgattgctcgagtaatagctttctaaagtggtgaaagtttacgtgggactccaagtcatgatagtgacttcccagcagaaggaaatgaagaccaaaggccagtgtaaagtcaagagtgtaagaacaaacagagttcagtggaggtagagaaatgagagagtacgtgctccaggagaccaggcctgagtgtcccatactaggaggggagtggaggagaccagagcacagcaggaagcccacttggctcaccatctccgtgcttgctgtgtagcacaaaagagggaataatttgatgacacgcatagtgctaggtgtggggtttttgaaaaattgtggtaaaagacacataatataaaatttaccttatcaaccatttttaagtgaactaggtaagcctttggtagataatatttgttcttctctctgttccactagccttaaagttttctattgtgtagagacaccattctttctggttttctttgagagagagtcttgctgtcacacaggcaggagtgcagtggcattatcatagctcactacagcctcaaacatctggcctcaaatgatcctcctgcttcagccttcaagtggctgggactagaggtgcatgtcaccatgcctggctaattacaaaaattttgtggggggatagagacagggtctcactaagttgcccaggctggtcttgaactcctggcctcaagcaatcctcttgccttggcctcccaaagcgctgggattacagttatgagccatcatgcctggccaagaaaccattcttttttttttttgagatgcagtcttgctctgtcacccaggctggagtgcagtggcgtgagctcggctcactgcaatctctgcctcccaggttcacaccattctcctgcctcagcctcccgagtagctgggactacaggcgcctgccaccatgcccggctaattttttgtatttttagtagagatggggtttcaccgtgttagccaggatggtctcgatctcctgacctcgtaatccacccacctcggcctcccaaagtgctgggattacaggcatgagccactgcacccggccaaaaccattcttttagttgacacggtacatactgaacttgagaccacaatagcttattgctctgcagttaatatctcattgacagccctccctacttagcccccaccaggcacctgtctgcttggatgattatatttactgttattacagcaaaggattacagtgacaattacttgcttctagcaatccccaggaattgcttgtcaacactgaggtcattggaagctgcagaaaccaaagattaatgtgctgttcttgttgttcccttggatgtaaatactgtttttctctgctatttagagctgactagcctcactcccaactttactgcccctaattggtggcagtgagctgtggaaggattactttcttctgtgactattcacaggtcatgggcggcaactgtgggctcatcctggtccctggtctgctctgtagcttagaacaaggcacttagttctctgagctccagtttcctctataaatataaactagacagtctcgaaagatgtctcctgttccgcacttttatggtcctttgagaaatatagtctggctagacatggtggtgcactttcctgtagtcccagctacttgggaggctgagacagaggatcattaggaggtcaagtccaaatccagcctgggcaacacggcaagaccctgtctctagaagagaaaaagaaaaacaagtatcatctggaggattcagttcatttcattacctgttttttgactcagactaatatgacagcagaaaggagccttgaaagagtgattcctacttcttgtttagcaagccaggccctatggctagaatggccttttctcttgtcaagtagttcttcttggttcccagcttcttgtttattgctgcctgtggtctgatcatcacttgaggcattttcctgccactctctctcagatgtctgtcagttaaaacaaaagatactacctggggacagggctggcttcgttggcacttgcacaaggcccttagaaggacacatgcttggtgtaatgctctgatgacatcatcttgaaattcacagtgatttttgagcaggaggttgatttggtgctagatgctgtaaatgatgtagtggtcctgcctgtagaatccacatccctattgcatttttattacttcagaaactatatatatgtttgcacttgaggataaaatgagaactgtattgtatttgagaatgaagtatgatggcagtcaagagctgcttctttgggaatgagtgattatgtggttgttcccacagatattctaaagggaaggactgagaccctgaagccagacccccacctccgcaagagtccctcactagagtcactgagcagacccccgtctctgggctttggggacacaagactgctgagtgcttccacccgggcatggaaaccacaaagcaaactcaggtatcgtgtttcaaacaataagaaatcagaaaaacatcgggctaatcaccttttattcttccttccgttttgtccccgtggccaatttacttctacaaatatttcctgcatgaaaatgactaagacactgtgcctgcccttggtgagtctaaaaggatgacagtggatagtagtagtgcgcaaaatggaattaagggctgtaaaaaacaatactgcataagcaaagtcttgagaggttgttagttggatcaagaagtctagagagaagtggtgtttctgccaagggctctaaaggtaccattacaagcacgctgtggaatagtgatcagggaatgtgggtggtgtcatgtgtctgaactagtctgtgggcttcctgagagccgggactctgctgtacatatgcataacaagctctctgtcagtatttgttgggtggatggataagtgactaggacattccatctggagggcatattgtaagtagtcttcattgctaaggaagaggtttgtgcattattttggtaaagcactggagtaccaccaagtttgtgggattttgtttcggattttgaggttgtacagtgagattggacctgcattttaaggaggattcatcagaaaacagtggtatataaggattgaagaggcattttgaaatcagtgtttaagaaggactgtcacagggatgtaaaggaatggttggcagagggagaggatggcaagaccagcagggtggtcactaagagcttgtctttgttcccacacctctgtcacctcctccctttccagtgcccctggtcgcccaggccacagcaaacctctttcagctgcttcctctccccttgtgacttccctgcttctctgtgttggttaattttctgatgcactgagcacatcctgctgcagaccttgcagaaatctcacatgactctgtcatctgcactcctcatcctggtcttctagatgccccacaacttagcaccaccccacccacctgccagaatggccctgttcctccctccacctgagcctgttttagtttctgcctttgtaatagaacatgaccatgtctgattgcaagtctttatgtataaggttctagcctgaatcgtttttcttttctcctttcatactccaaatactgcttctccttcaaggtcaaacctttcatgaagttgtacctaacacctggcacattgacatatcccttctctgactttggcgtcttacacttttttgggtgtttagtttttgtactgctttgtagtgtggaacactgttgcacagtacatgccattgtctccatttatgctataatttagttgacagtaaaagttcaacttacattttggtatctcttccagccccttgcattgtgcaacacacatagcatttcacttagtaaaacttacgagtgagtagatggattaatatacaaaattggctagtttaggagtaatagctttttaataaatcttataatcacaaatatgggtattatagaaggatttataaaagtctgaataaattcaggtcttgttacacctttgggtacagcatatatttggacccaaatagatgaagtcatgtgtttcagaagtttaatgtaaagccccagatactacatattgtcctgtttatgtgcaagagatttaaataatcaaaagaggttttaaggaccagaattagtgctgttctgaagttgccgttttctttatgccagaaatgcatacaaaaaggctatatgtatatgaatatgctattgatattttaccttttttaatgaaaagttaaattagtaaaattcttatttcaattttacacttacgttattgacataaacaatggcaagatatttggtgtttttaatatgcccttccaatgcacctttaaaatttattttattttattttttggagatggggtcttgctctgttgcccgggctgtagtgaagtggcacagtcatagtgcactacaaccctgaactcctggcctcaagcagtcctcccttctcagcctcctgagtagctgggattagagatgcacaccaccatgcccagctaatttttttattttttatttttttaaagatggggtctcgctatgttgcccaggctggtcttgaactcttgggctcaagagatcttcttcccttggctcgtaaagttctgggattatagatgtgggccactgcacccagccaatctaccttttacatgttatttaggtactggtttagtcttgaaacatgtagggtgtgttttgtttacgtatctttaattcaaatgatactgtacttaagtaaacaaatgaaagactagatggatgagcaacaaatggatttgaaaacaaaatgtaacaaaactctccccaaatttatgatagtcaggaagcacaatttaatttttattttatactgtgagatatcacaaaatagtaatgtgactaattcggctgtttctttagaatcttgctggataaactagacttttgcttttctaaagtaggtatttatttcttgtgtatttgagaattctaagtattagcatcttctccttaccatgtgctcttctttctaaccagtgtggaaagaaaagaccctctggcagccttggcccgggaatacggtggttccaagcgcaatgctctactgaaatggtgccagaagaagacacaaggttatgcggtaagggacaacatcagccaacttccagctgcccctgggcagtagtagtcctgtgccaatacatgttccttgtgtgcctgtgcttgatgggccaatatgcatgtaattgtcatctttctattctcctaggcagggctgccagggaatgtttgatatttgtgcactgcccaaaggcaccgtgacagaggcaaatgcaactgaaaaacggtctgcactccacccaccaaatgtatggctgcacgcagagctgcacctcccgagggaaggggacctttttctttggtcagagtgttactggccacaggttcttgggctgtcaatgcgatagaaattgtcatgaggccaaaagagttttctcaacaaggctttattggagcttatgcccttatccctcaggcatgagggaggaagcacgggagagggaggattctctggctgactccttgaaatgagctggtagggatttttttattaagcaaagtgcaggaattgatatcaacatagagaatgtgggctgggctgggtagatcatatgaggggtaggggatgtgggtcagtttatctgctggcgacggttgtcttgagtcatgggccacctagtgttctggttggtggcagcaaggctgtaaatcagttgtttagcattcttccctgagatgaggacatttgcaactttggttggatatgttggatttcctagggccagtttctggaattatttaagtaaaagaattaaacattcttttattcttttaaacattatgagagtgcggaaaaacagtatggctattttctttgcatgactgttaagcaggtatgtcagtgaagtagtggtgtgggttttgtgatcagtgggaatgcatgaaagaatgctatagtggggatgagctgaagccaagtcctgtccctgctgtctcagaagaagacacaagctccagtggctcacgcctgtaatcctagcactttgggaggccgaggtgggcagatcacgaggtcaggagatcgagaccatcctggctaacacagtgaaaccccatctctactaaaaatacaaaaaattagccgggcgtggtggcgggcgcctgtagtcacagctactcgggaggctgaggcaggagaatggtgtgaacccgggaggcgaagcttgcagtgagccaagattgcgccactgcactccaggctgggcgacagagcaagactccgtctcaaaaaaaaaaaaaaaaaaaaagcagacacaagctccccgagcagtgatgcctccacccaagaagacagcttttgctgaattaccctcctgaagaagagtgctttgcctaattcgcataaaggtcctatgtagttgggcctccaaaacttctccaaacattttgtttctattgttttgagaattgtttgcgtttagtttaagagtttttgttttctaggacagtatctgttttctgtgaatatcagaaaagggaagtaatacctgatgtaagtttaagtttttttcttgtgaaatacacaaagataaaatgcacaaaatataaatcataatttcttgaactgtgaggaagtgaaaagtcatgcagtcaccactcccatccagaagaggagcatcaccagctcccacagacccttcctatgactttcccatcatagccctcagtactccctaagataaccattgtcctcaattctccttccagatttttacaaaagtatgcatccgtaagtactatgttagtattgcttgcatttgaattttattacaaatggaataaaaaactatgtaatatttgcagctagctttttttacacggtattgagtcagtgagatttatcctcattgttgcatatagctgtaatttgttcattttcttcaccatttagtaacccattgtaggattataccattatttatccattcgattattgatggagagttgagtcatttctagtttggagctattatgaataacgctgttatgttcttgtgcgtatttcctgaaaaacatatgtgctcattcctgctggatacatgcttaagaatggaattcctgggccatagggtatgcatacaatctagtggatagtgccaaacagatgactgaagtaattgtataatttatgtctctccagcaatttatgagagatttatttctctgcattcacatcaacacttggtattgtcagtctttttactcaaggtcatgtgggtaatgtgtagtactgtctcactgtggttttggtttgcattttcctgttggctggggaggctgaacaccttttcatatgcaaatagataccctctttaaaattggcaattcctactgcattcttaacaatattttgctaaaatttcggaagattccagcaccgtaatactcccttcccaggctgaagcttttgagggaggtggggatggaaaatgaaagaagctagcaagaaaaacccagcctcagccaagatccatcccagatagtaaattagcagggctgggagtctctgtcatgtcagcagtcagatgtcttaaaaccagaatctacccagagtatgtgtatcctgtatctttgccattaccttcttttcactttatgttaaaaaagaaaaagaatcgcagcactttgagaggccgagggggcaggattgtttgcgcccaggagtttgaggctgcagtgagctgagatagcaccactgtagtgcagtgtgggtcagaaaaaagaaaagaaaaacctgtcatgctactgaccaataatagaggctcccaaagtataaactcgcctcagacccttgtttattcttcctgctaccctgtccactctgcctctgccctgtttcaaggatggaccatgccatgaaggaaggcctcttggttacagcctcccccagcccatcagccacgctgccgaggacacgggaaagaataagaagccataagaaccaatagctatgacttcttattctttcctgtgtccttggcagcgtgactgatgggctggggaggctgtaaccaaggggccttccttcatggcagttgaacaatgtgaacacttggacacaggaaggggaacatcacacacgggggcctgttgtggggtggggggaggggggaaggatagcattaggagatatacctaatgtaaatgatgagttaatgggtgcagcacaccaacatggcacatatatacatatgtaacaaacctgcacattgtgcagatgtaccatagaacttaaagtataataaaaatatattaaaagaaaataaataaatatcaagaaggagaaagaaaaaaaaagaataagaagtcagagggaggcagctgcctgcaggaggtttagcgtaaagaaaataggaatggtgatgggaaattgaagaaaacatttaaaaagagctgtcattcaagaatgactccactgatgccgcctgtgctgttccccacctgacagtaatggaccaaggcagctgccagagtgcatatgaaaagacaattcacgttttcagaaggagtggccttctatgatgtaaccttgttgtaatgcagggaagagacagacaataagatgtttccagtcaggatcacaagaacactatttcctgctggagtgatttgtgtgtgtgtgtgtgtgtgtgaacattttggattcgttttcaaaacattttacgtttgatgaaacccaaaactcattttgcctgtagtacttttcattcatcatgaaatctctgtaaaattagaaatatgaccatgtgtctgctttatttacccttcacaaaatatgtctagacctgtttgtctgagacacctcatagtcttgttctctcagaattaggaagccaaaaataactggtgaaaactttttgaaaaccgggaaccatgtgtacttgacttaaaataactttccttttatttcatcaaaatacagcgtgaaaggttatgttacatccctccatatatatatatttttatttcagctttagttatagattcagggggtgagtgggcaggtttgttacaagggtatattgcttgatgctgaggcttgagttatgggtcccgtcacccaggtagtaagcatagtactctgtaggtaggttttcaactcaggccttcttcccttcctcccttgtctagtagtccccagtatctattgttgccatccatgtggctttttttggagacggattttttttttttttttttttttttttttttttgagacagagtctcactctgtcacccagtctggggtgcagtggcacaatctcaggtcactgcaacttccacctcccaggttctagcaattctcctgccttagcctcccaagtagctgggactacaggtgcaccccaccacacctggctaatttttgtatttttagtagagacagggtttcgccatgttggctaggctggtctcgaactcctgacctcaggtgatccgcccaccttgacctcccaaagtgctgggattacaggttcacacctgtaatatacataaagggctactggatacatatacataaaaagggccactgcacctggccctttatatccatatgtactcaacgtttagctcccacttataagtgagatgtggtatttggttttctgttcctgcgttagtttgcttagaatagtggcctccagctgcatccatgtttttgttcttttatatggacatgatttttgttcttttttatggctgtgtatttccatggtgtatatttaccacattttctttatccaacccactgttggtgggtacttaggttgattttatgttttttctactgtgaacagtgctgcaatgaacatacgagtggtagaacgacttatttttctttgggtatatacctagtcatgggattgctgggtcaaatgttctatttttagtaccttgagaaatctccaaactgctttccacaggggctgaactaattttattcccaccagcagtgtataagcatttctttttctccatggcctcgctagcgtctgctattttttggctttttaataatagcctcctggctagtgttagatggtatctcattgtggttttgattcgtatttctttgaagattagggatgttgagcgtgttttcatgtttattgaatgtatatatgtcttcttttgagaggtgactgttcatttcctttgcctattttttaatggggttatttggtttttgcttgtggatttaagttcttatagattctggatattagatgcatagtttgtgaatatttcttcccattctatgggttgtctgttaactctgttgatagcttcttttgctgtgaaggaactctttagtttagttagattccacttgtcaattttttattttgctgcacttgcttttggggacttagccaaaaattctttgctaaggccaatgttgaaaaagttatttcctaggttttcttctaggatttttatagttcgaagtcttatatttaaatctgtaatccattttaagttaatttttatatgtagtgacaggtagaggtctagtttctatcttctgcgtatggtcagccagtcatcccagcagcatttgctgaatagggaattctcttcccattgcttgtttttgtcaaagatcagatgattataggtttgcagctctatttctggatactctaacttgtgtatgtgtctgtttttataccagtgccatgctgttttggttactgtagccttagaatataacatgaactcaggcaatgcgagtctccagctttgatcttcttacttaagattgctttggctattcagactctgttttggttccatatgaattttagaatagttttttctaattctttgaaaaatgacatttgtagtttgataggaataccattgaatctgtaaagtgctttgggcagtatagccatttgaatgatactgatttttccaatccatgagcatggaatgtttctccatttatttgtgtcatagctggtttctttcagcctccttccatatattgttcagctccaggtaatattgtaggtgctgggggccgggcgcggtgactcacgcctgtaatcccagcactttgggaggctgaggcgggtggatcacaaggtcgggagatcgacaccatcctggctaacatggtgaaaccccgtctctactaaaaaatacaaaaaattagccgggcgtggtggcacgcacctgtggtcccagctgctcgggaggctgaggtaggggaatggcgtgaacccgggaggcggagcttgcggtgagccgagatagcgccactgcactccagcctgggcgacagagcaagactccgtctcaaaaaatatatatatatattgtaggtcctggggattccacagtgaatgaaacaggcaacagtccctgctctcatggaacttaaatcctcatggggtctggcagttaactgaaataaaaggtaacatatgtacggtatttgaaggttgtattgccgtggagagaaataaagcagggaaggagggttgggaatgttgggtgaatggtacaatttatacatagtggtcagggagatgacatttgagcacttgctcccctctcttgaagggctttggtgtctgcatgaagctttatttcccaccaaggcctaggtgtggagggtcagagtaaggaggtcattactgtcgttactgtgccaatagaagctgaagtgacacacggtggtcgacccaggtcagcagcactgggaagtgagcatcgcagccagacccacctgccgagctccgggccaactgcctgacatctcgagtggcccaggattgagacccagtgaaaggatgtgagtttgccctcactacgaagtgaggcccagttcactaagctcaaaatggcgctcctaggaggcccttcctcacattctgctcaactcatacacactggtgtctttttggaataagtcactcctggaaaggccctctaaattactctcagtcctcaaatttcatactcctgatgtgtgttggctgttttccaagccaagggcaggcctgactcagataactcctacccctccctttctttcatctgaaagtctagtttaagctcctagttttctgttacgatggagagatttccatttgtaatttccagtaagaattctgaagggacagaaagtcgggagggtaggtgtgacaggaagaattctgaagataacccccatgactctccatggtagaatgtcctcctctttatatgacacagggagatggtctggatatgcccactaatcacaaacccctgtagaagccaagtgatgtctctggcttgtggcagaagttggggaaattcaaagcatgagaaggactctgattgttcttggtggtttgaagagggagggggcacgtgagaaggagccaagaagggccccctggctggcagccagcaggaaacagggactttctagcactaaagcattagtgctgaggtcctggccgtgcccagaaattgccatgtgggtgctctggagttttgaggttgacaactgcaagttgtgtgtagtgccaccgggtcctttgtctcctcctctgtcctgatgccctcagacctcagccaggccagggacgctcagtttgctttgccttctgctttccctcagctgggggatcttgggctggaagtcactctgatgaacatgtggaattcagctctaagtctctcctgagtcctctgttacctcccaggaggcatgatgaggcacagctacccttcacctccatgggtggcatgaagatacttgcaagtatcttttagacgaaaatatataccggtatttactgttacttgaattcctgtttggttcttgcatttcagatcaaaagaaagaagagtttagatagggatttacttgaaaatgtatctgtatctgttccacttttgaaattgtatggcaagaattcagatagcaggcgacacctacactatcattaagggacagatgacgtctttgaaccaggttttaacctgttagctcagacctatatcttcttctcttttggagaaaaaaaaatcagtctttgtgtgtccacactgaattttgctttgaatctggaaagaacacccatgttgcaggcaacttctgttgttctgtctctgagttcccacaaacaagcactaaaatctgcttagccaatagcaagcagcctctaaaatatcaggtcacttggggctctgtttcttatattcttttttgagacagatctcttgaaggctacacgcacaattcaaagaacataaagcctttgatttatttactgccatcagagtggtcctttccctgacttagatgatagagtctcaatagcagatgcgcggcactgtgggcttccactctattgaggccttttctacccactttctctgcttctgtaccgtttctgacacagtggtctgtgaagacattttcagtggcacaggtgttgtcctacaacctgtgacaacagtggagtttgtttgcaaaataaagatgcaaggctttcccatgttgtgggagacacagtcctctcctggtggccgtgtttctggttggttttctctcacgagccagtgtgctgtggggcacccgctcccactcccactctcagtggtgtgtgcatgcccagaggtatgaaacttcaaggaataaaagtggctttctgaacaaaaatatcaaagtgtgtagagacctgtcagactgttcgcacagcagatggggagggacacgttctcccaccttagtctgcacaaacaccgaagaagcagccctgacaagtctaagctgggcacatccccaattccttgggaattttggaaataaaactgagaaagattactctaaaatataaagcccagatgctattggcagccatgtttttgcctctgtgcaaaaaagacttaacccagtaggcctgggacggctctctttagcaaggctgcttgcaaggctggcccttggctggcgtctgggaactgggattacaggagggttcccattgtttccagaactgatgagaggggctcacggtgctgaaactgtttgtgcaaacacatggtatgtgctgaacagcagctttcctttggggagtctggaatgtagtatgtgctgggcagaaggggctggatgctgagtccctagtgagcttccctggttggcagcattttttcttgagatggggtttcagtcttgttgcccaggctggagtgcaatggcaccatctcggctcaccacaacctccgctcccgggttcaagattctcctgcctcagtctcccgagtagctgggattacaggcatgtgccaccacacccagctggtctcaaactcccgacctcaggtgatctgcctgcttcggcctcccaaagtgctgggattacaggtgtgagcccctgcacccggccggttggcagcatttcacacgtgttgtcatggcttgttgccaggggaattaaacatgtccgtgactgctggagagaattcttggaagcacgtgcctggtttcctcgggacttcctgccctgtgccttttccctttgctgatctggctttgtgtcctttcgcagtaataaatctgtgaatagccgtggccatgactccatgctgcgtcctgtgggtccttcccctgatcattgaacacgggctttttattgagccttaaaaaggagtaaggcactgacacaggctgcagtatgaatgttccctgaagacgtgttgccaggtgaaagagctgggtgcaaaatctacatcttgtatgagtccatttataagaaatatccagaataggcaaattcacagaaacagaaagcagatgagcggttgccagaggctgaggagagagggcaatagggactggagtggctgcttagtgggtacagggttttctgttgggtgatgaaaatgttctggaactaggtagtggtgatggttgcacaacattgggaatgtgctaaaagccactgaactatacactttaaactggtttaaaatggtgaaagtgatacattaattttaccttaattttttttaaaaaaaacagtgttatgaacagacacgatagctcatgcctgtaatccagacactttgaggggccaaggcaggaggactgctgagaccaggagttcaacaccagcctgggcaacatagcaaggccctgtctttaccaaaaaaaaaaaaaaaaaaaaaaaaaaaaaaaaaacattagccggctacgatggtgtacacctgtgattccagctattcaggaggctgaagacagagacttacttgagcccagaagttcaaggcctccgtgagctatgatcacaccactgcactccagcctgggcaacagagagagaccctgtctctggggaaaaaaaaaaaaagtgtgccatgatgatgaatatcacttaccatgcatttttatgcttatgctaaatagttgtgaaatagtgccaaatttttgtaaagtaagttcctagaagtgaatttgtttttgcaaaagggtgtgttacactttccattttaatatatattctcaaattgccttcattaaggttatttagtttacacttctctatacagtgtacaagattatacattcccaatactggatacacctactcttttgatctttttcagcctaagaggagaaaatggcatttcttttaatttttcattgcagatgaaggagaagcactttttatcaacttgttagttatttatatctttcttctgtgaattactactacagttgctttgcttgcttttctatttgtatgttcatcttttttcctcaaaatttgtgatagctctttttggttttcttttggtttttatttttatcaaagctctgcatgcccacaatcaggtatgcagagatcctgatgagcaaagcagtcagccggcctgagagctctgcttcctgctccccagagtcaagcattttcaagtcaccttgctgattttttttttgtcatttacctctacgttgctgactagcacgtttatcaactgctatttctagtttttcattttagatgttgtattttgatctcctactgtgaaagatgagggtttatttctttttcactcccaccccccccatgcttcctgtctttgcattctttcatggttgtacatatctggagttcacattaagatgctgtgagtgtcattcatagattagccatgtagtagtatacactgctgcagctttttcttttacacaacctgttacttgccttacacttaaaatcgtcttgtttttgtctgtttacttagttttgtatgtaaatgatactcattcaaccgcaactcttcatgagatatccccacacatcacaagggtcaggggttgcagctgtgttatcctgaggagatctctctggagcctctgacctcttccatcatggctgccctctatgcctggtgcacagagtccctgttagttctttgcctctctcttttttgatcttctgtatcctacatcctattcttttttttcccctttgtttttttttccctttgtttttttttcccttcagtatctccctgagaatgagttcatagatggtaaaattttatgacctcgcatctttgttttaccctgatgcttgatggtttctttaggtataagattttaggtcagaaattattttcattcataattttgtgggcatcgctccattgtcttctatttgccagtgttgcagcaagaaaagaatgattacagtcgtttgtgatttttttttcctctgcaaaagctcataggaggttctggttgtctccaggattctaaaatttcagggtgatgtgccttgctctatagcttaagttttgtgttttctatcatgctaggcactcactgcaccctttcaatatgtaattcatgactttattttctggaattatttcattggtaatttcttctactctgttttctttttctggaaatccccctggcctggccctctaattatcatattctttttttcccctatttctatctctttgcattacagttttgttttctgggaggcttccctaactttaatcttccaaattctattaaatgcttaattttgcatttttttttttgcttttgcatcatttcaattgttttttaattgtgaaatgtacataggataaaatttaccatcttaactatttttaaatgtacagttcagtatcgttgagtatgttctcattattgtgtaaccaatctctagaatgttttcattttgcaaaacttaaattctatacccattaaacactaatctgacattcccctcttcccccagcctctggcagcagccattctactttgtatcactatgaatttaaccactttaggtaccccatataaacggaatcatacagtatttgtccttttgtgtctggcatatttcacttagcatgatgtcctcaaggttcatccatgttatagcatgtgtcaaaatttccttcctttttaagactgaataaaattccgttgattatatttgctatcatatttttaacttctaggatttcttttttattccctgaaattttttatagcatcctgttcttgtttcacagatacaatgttacatatgaatttcactgaggattgtaggttgattttatcaccaaatctctctatgcagattgtttcctacagtccctttattccattggtatctttaggtctctatctttatgctggaggtttgactgctcatgtttaggtggaggctctgcaaagctgaccccctccctggcctgcgtatgaggcctgcgactatgttcctgtggcatatccatgacgaacttctggtgtcagtgtctttaggtggtccttcctcttgggcacatccattctccagagaaaggccttctagtctcctgctggaggacatcaacctggcaaccagaattgtgggacctaatcagaaaagaggcctgtgggccaggcacagtggctcacccctgtagtcccagcactttgggaggccgaggtgggtggattgcttgaggccaggagttcaagaccaggctggccaacatggtgaaacctcatctctactaaaaacattagtggggcatggtggtgcacgcctgtagtcccaactgcttgggaggctgaggcatgagagtctcttgaacctgggaggcggaggcgagatcgtgccactgcattccagcctgggtgacacagcgagactctgtcaaaaaaaaaaaaagaagaggcctgggggtggagagtgactacctcagccctcaccatgtaaattcacttaattcccttgttttcactgcatcactcatgcctccactgctcactgtcctctgggtgtgcacagaagagagaacgtttggagctttggctgctctataaacagatctccaacccattcttcctgtttttaaccaccttcattcccccacctgaagcacctcttgccaccaatttcctgtgtctttgagggattttgcaccataaatcaggttgggtctttgcccttcgccactgctggcctgggatttagtttgcttcggtctgttatgttagttatctcttgtccattgacttttcagctgccaatgttttgtctttttgctttctttcatgttccctttttccttgtctgttaatgcctttggaggaaaaattcctttctgtggttttctggggcttcacgagggggtgagattgtgaatgcatgcgtttcattgccatcagcctggaggcctcagagagctttattcctttctccttaaggatattaaccattatctgtcatagaggttccaagtaccctttacatatatactatattatatacaaatacacacacccttttgttccttctggagtgcatttgtgtttgttaggtcaagttttatttttcccccagatggatggctatttatttcagcatcacttatttcatcatctctcttgaactaactgataggcctaggtatgaatgggaactgagtggtgtctggacttgctgttcccttctgtgcctctgtgggtctggcctctgccacaggttgctgccgagcagagaaatgagagcaggacctgagtgcggcacagcgccctgggcctcagccagggtcctgtgagtgtcagtcagtgctgtggcatgcgttgttttgatgaatttaatgccctggcatttttcattatttgattatacttgttggttttctaggtaaactattacacataacaatagttttgtttcctttttttcttttttcttttttttttttttttttgagaggtagtctcaaaaaagtctcggctcactgcaatctccgcctcccaggttcaagtgattctcctgcctcagcctccctagtagctgggattacaagcacgtgccaccacacctggctaattttttgtgtttttagtagagacgaggtttcaccacattagccaggatggtcttgatctcctgaccttgtgatccacctgccttggcttcccaaagtgctaggattacacacatgagccactgtgcccagccttgtttcttctaatatttatacctcttgtactttttttggtttattgcattcatgaaagtccaggtcactgttgaataatgctattgatggtggatattcttgttttattttctgttcgtaataacagaaataagatttaataatattattaaataatttaataataatttaataatcacctaaatgagattcttgtattgttttgtgataaatactctatcaactaaaggaagcttgcatctgttttgagcttaccgggggatgttttaagtccagaaataggtaagaattatatcaaattcctttttagcttttaatgagctatccatatggtttcttctcttttgacccatttatgtaattaataacataaatacatttactagtaggggaacatttgtacatatctgggggcaaaattccaacttggtcatggtatactattcctgaaggaaactctacttgattgtggttattctttaatgtgaaatatacgattttttatactcagttattgatgagacatttggcttcttgttggttgctttggtataaatgaagttttgtctcaataaggcctgtttttgtttttgttatgatgttagtgagctctaaaaccctgtatcatctgtatatagtaaaaagtgcaataggtatttattttaccaccttctgtagtaggattaatgacagaattaattcttagccaaagagaatgttttatactctagttgcaaagttctgtccagtctgacaaatgaaaacctgaaaaccccaaaaatgttgttgggtagaagttgggaaacctttcatttaagcttcagacaatttttgtgaaaagtataagagtgaagacttaacatttttcctggaactgatgctcttttgttttgatgaaagtcctctgaaaggacttgttagttgcatagaggtaaggctaggcccctgcctattctcagggctcaaggcctgagcagccgaaggcccatcagtggtcccagttacctcagtgggagctcaagtgtcccctgtccccatgtggccacttgatctgctggattctgagtcaggtgtgttgaaatctcttactctgactgtggtttgtgtcaaaagctttgattgctgagagattatgttccagatattttgaaccatacgtaaaggtttcttgttctatcttcttggtggtttttaccttttacttcagttaatccttttgatctagaagcttacattttatataccaatattgctatttccatttatgttttctgtgcattttatgttttgcatttatgttatttgcatgatatatctttgtactttctttcctttcttctctttttttcccccagagttggagtcttgctctgttgcccaggctagagtgtagtggcacaatcatagctcactgcagcctccacctcctgggctcaagcaatcctcttttcttagcctcctaagtagctgggtctacaggtacatgacaccacacctggctaattctttaaaaaatttttttagagacagggtgttgctatgttgcccaggctgattttgaactcctgggctgaagagatcctcccacattagtctccccacttagctgggattacaagtgtggagccactttgcccagctcctttattttcagcctttcttagttggttgtttcagggttatgtcttataaatagtttggctttacatgtaatctgaaaattcctctaacagggcagcttagcctgttcacattttcttgtggctgtatgtgttttatcttcttcctctgtctcactttctatttttagtagacttctcttgctggcttccttcttactgattcccaggcacctagcagcgtggtaaggtgtgtgagttgaagaggtggaaaaacccaggcctgagactctgaggggtaaccacagtggaataatcataaagtttaaagctagagtctgtttttgttaaactggagcagaatcataaatcaaacacattttaaaaaatgcagagctacagagccggctgcattagtgagaaacagccccgtcggcccctttggggtcagaagtcagaattggaggcagggcctgggcccagttgctcttgccagggctgctttctggggtagaatggaggaagagccatgggcaagggccaagtccactggccactgtcaccaggggagcagcccgaagtcagggccgtacctgggaacaagaaggactccaaagacctggagcagatctggagcactgtgagttggaggagtcgggctcggatagcagcctgcaagggtgagggtgctgagaaagcaagatggacagagagggacagatgtggcccattcagggatccagaccagtgtctcatggcatctgatgtctagtcaccagcatgcatggggacatgcctggacacttgggctgatgcttctgcatgactgagcctcacggtagcagggtgcccctggacagaaacaaccacatgaccaagcagaactccttagcagccatttaaaaggataactggaaactctccaacctaattgggtaagatggcttaccaatttgctaagtagggcatatgcttaaagtactttttaaactttttttttaaaatgatgctgctaaatgaaagtatgtttaatttcacagggaggatctgtttttgccaaatgaagttcacttagctccttttattggtgctttggggaagagggggtgtggtctgtccctttagccttatagttcttgatctggtttttctttttttcttttttattgtaaaatacacataacatgaaatttatcattttaactattttaagtgtacagttcaggggcatgaagcacgttcacatggttgtgcaaccatcactgctttctatttccgaaatgttttcatcatcccaaactgagctctgtatgctttaaacacggggtaggggactccatattccccgccctcagcgcctaaccaccgttccgcttcgtctctgaatttacccattctagccaccttgtagacgtggacttacacagaatgtgccctttgatgaggggctgatttcactcagcacagcgtcctcaggcccacttatgttgtggcgtgtgtcagccacgctgcttctgcatccatctgtccaccttctcctctccatagtccccaccccatcctgggtcaggagttgtgatttttccttgtgtcttccagaaccaaagctgggagatcgcctgctaccatggcttgaaaacccttaacgactctgcagccagcagagttggacccatattcctggcctgtgtgaaagaccggctttttttaatgggactatttagctgtattatttgtcctcccttttctcagaggtatggaacatagctcccctccccaccctcaccacacctacctgaaaaacgggaagattagatccaccatgtccttaaggaaaagaagagagtgttttgattgccaacaatttgggctccaggcttctgtaagtcatcaaggtccatattggagaattagaagcaagagggtaacagaggcagaggataagagcagaggcttaggttgagggagagcagaggccagcgcccttggatgtggtggccgggggctgagaggtggaactgggaagactggaaactcagccaccctacaggctaagggcccacatcctccctcttctgacctgccaaattcctacaacatgcaggagaaagtgagggaactaataaggtgagcttattaatctggttaaaggttcttggctgggcacagtagctcacacctgtaatgtcaacactttggaaggttgatgcaggaagatcacttgagtatagaagtttgaggctgcagtgagctatgattgtgtcactgcattccagcctgggtgacagagtgagaccctgtctctctctctctctctctctttttttttttaaaggttcttaccatgagttagcctcgtcttctgacttcccagggtcatttgaaggaagcatctgcatcaaaactgccaatttacactttaaaattttttatataaatgttagatgttttgccagcttcaggaaggaaaaacaggattttcaaaataaaatgttataagaatgtgtcatcctcctggggactgagggtgatttaagtcccttggtcttctttcctcccatgggctgtttgtccccagctgagggcctccatgggtcaagtatgccagcagctgctgctgcagcataacactgcccaacaccaaagccatcatcttgtcaccattcagaaaaaggaggccttgatttttgctgctgttccttctccatcccccaggacagcatgtgagtctatttagataatcacagtcccaggtgaatctgcactgagcattttttccattctcttactcgtgaaatgttcatttgggaaaaagaagtaatttcatggcaagacacttatgatttcacaggctgaattcagtctttctgagggtagaaggttaacggagttgaaggttacttttctttctttttttttttttcttttttttttttttctgagatggagtttctcccttgttgcccaggctggagtgcaatggtgcgatctcagctcactgcaacctctgccccctgggttcaagcgattctcctgcctcagcctcccgagtagctgggattgcaggcatgcgccaccatgcccggctaattttgtatttttagtagagaaagggtttctccatgttggtcaggctgatcttgaactcccgacctcaggtgatccgcctgccttggcctcccaaagtgttgggattacaggtatgagccaccgcgcccagccttgaaggttacttttctagtataaactaaacttgatcttggaacaaaattccttataatcaatttttcagttattgcatattattttcttagtacaattctaattctgctgactacagagtcagaaagggtttaaaaaccatggtgacaggtggtctcccagccagagctgtggttttggaagacatgaggaagaccacaactcctgaactaggatgggggttgggatatggagaggagaaggtggacagatggatgcagaagcagagtggctgacacacgctgcaacacagatgggtctgaggatgcttcagtgagtgaaatcagcccatcaccaaagggcacgtgctgtgtggtggaggaacatagtcgcatgtgtgttgttgggaggtggagtttaaggtggaagaacctctttgagggcaatttggcagaatccatcaaaatggattccacctgtgtgcagagaggtgcatgggaggacaattatcgcagtactgtttgtgataacagaaaactggaaacaacctaaacgggctgctgtctccatccatgtgatggacctgcatgtgtcgtcagagaacaaagtagcgaatggtgatggaagtaaagctagcagtgacaaaatatttaccacgtgaccgacattgtctaagtgcatctaatcttgaccacaatctcatgagttaggcattttgtatccattttacaaatacaaaactaaggcagcaagaggctccatgactgctcagagtcacaccctagtaagggatagagctgggactgaactcctgctgttgggcccagcatccagtcccttggtctctacactgaaactgttcatccagatgtcgtgaaggacctagctctatatatcttggtaagggtgcagaacatgccaccatctgcataaaagggggaaatacacatgcatgtttgcataagtgcaagacagcactgtcctgtagaaccctctgtgatgatgggaatgttctatatctgtgctggccaatcctgtagccacaggtggctgctgagcacttaaaagattcctaatgtgactgagaaatggaattttgatattatttaattttaactaatttaaacagccacatggggctggtggctgtcgtatggggcaatgcaaggtagaatatagacagatggatgttaaagaaaagatcaccggattttgtggtttgcaatccctacttttaaaaaaccttctgcagaagcatcattggaagaacgggtttcataactgtttatttcagaaccactaatttaatctagccacttcatttgagagatgaggaaacttaaggcagaaaagttgagtcactttcctaaagtcatattcagctgcgttagtgtgaggaggaaggagcgggtcacagtttggtttggtttgttcctctttagagcatcggacattctcgtttgccaggggcttcattcaatctgatgtcagctcagttcttagcatggccggtcggttcctggaaatggcggctttgggtgaaaccatgtgctgtaagccatgggaactcaactctggcccatgtcaattagcctgcggtgaaactggttttgttatacagcgtgtcaccatttcacttaatgttacagtgtccaagaacctcccaacattaagtgaggacttactataaaagaaagaaagaaccagacttttgtctcctgggctcccagaactccatgaggaatcttgcagtggctcgccctttcctgaagccccagagttcatcctgcctcctgcacaccccaggctcaggctgtcctgcctgcctgcaccacagcatgggtgaaccatggtaggaccatgcttccctgcggtgtactcctcagcgcctcacacatggagggctttggaaatgtttgtgtggactctactcccagcctcgagggctgaaccgctagtgagttgtgcagatggctcatgaggagatttctccaacatttccttgagggagctgctggacacaggtaaacactcagcaaggagcagaatggggcttcagggggctgctagtccactgagcctgggtgactccaggaggagaggagccagcagagctatgcatgaccatgaccttttttagaagcagcaagcaaggaggaagagtggaattaatgaaaatgaggtagccaacttaacagaaaggcagaagaggaaagaaaattccagggaagtgtttccccagaggcctgagcatggtcctaggggtcagaagatggcagggaatcatctgggatccgaggtgagggcacagagaagacctgttctcaggacgccaaggaagaactgggaggcccctgctgagccgcggggcttcgcctgcgttcgggtgctgtgtgaggctagcactgccagtggaactgctgttgggctggaggaagtggacccagccagggggcaggaggtgttggccgcaggcccatgcttgcaaggcaaccagaccctgtgtcacaatgccaaagccagttaacctcggggaagaaacgccgtgggtggggacttctgagtgtttgtcaagtgaaaatggaggaagcaagaaagacagggccccagctgctcctgagatgtgtatcttctgtgattctgtctccagggagggactgtgcagcatctgcctgaacatctctgggacacagccgtcctctcgccataggaaggctcttgtccacagaggagtaaagggaagggcgctgcttcctgcaccagctcaccgtggccgctgtctccattttcgcagtctcaaaccctcggtgctttcagtgtggataaaagagtgggaggaacatttaaaaagtgaattattccaaattagtctctaaatttaatgcaattccgattaaaatcccaacagactttctttattcttgaacttaacaaagtaattaaaaattcacctggaagaataagcaactaagaagagccaaaaaagtttagagaaagagtgctgatgaaagtgggttgccctgcctgactggaaaggtgcaatgaagccacggcagaggagacccccttcacacgtcattctgcccaccgtagcgttgcagaagcaaagacacagtggaaacagccatgagcatggcccctgcagctcatgtttcagaatagtaatgacactgacttgaacgggttgaggaggtctgcatttttttaaatcttaaaagataagtagaagttgtcagatttgatttgggagataatgagccatataaaatctaaagtagaaaaataaataattggctgggtgcgtgcagtggctcacgcctgtaatcccagcactttcagaggctgaggcaggaggattgcttgacctcgggagttcaagaccagcctgggcaacatagtgagaccccatctctaagaaaagatgaaaaaaaaaattagccaggcatggtggcttccacctgtagtcccagctactctggaggctgaggtgggaggatcacttgagcacaggagattgaggctacagtgagccctgatcacactattgcactccaacctgggcagcagagccagaccctatcttagaaaaacaaacaaacaaaaaagattaaagcaataatatgaacaggagcagaaatggaaaggcattccaaggaatcccagagttattccatgagggacaaaaggtagctttccgctgccagagatgtgacttgccctttgcagcaaatataaaagaagtcacttcaggcattctgattgtctgtagctgtagagcaaaccaccccgaaacagtggattacaataacatcttcattaaccttatgaattaaatgtctttaatttttgccagtttgatgagtgaaaatgatattttaccgtttttattttctggtgagactgaacatcttttcatacatttcagactatttgtatttcctcttcagtacattacaggttcatttctctgccaatttttacttgagttgtttgtctttttctttgagacagagtcttgctctgtcaccctggctggagtgtagtggcacgatcttggctcacctcaacctctgcctcctgagctcaagcagtcctcccacctcagcctcccaagtagctgggactacagctgcatgccaccacatttggctaatttttgtatttttttggtagagatgaggtttcgccatgtttcccagactgttctcaaacccctggcctcgagcgatccacttgcctcaacctctcaaagtgctaggattataggcatgagctaccatgtctgtcctctttcttattgattacaggaatatattttgagtattagtcgtttgctatacatatattggttttaattttgtcatatagaaactttctttaagtcagatttcttaatcctttcctttatactttttgcattttgtgccttagatggctttctttccccaggattataagcctattcttctatatttttctttttataatgttataattttggtttttaagcttagccatctggaactcatctctaggaaacaagcgatgcgagactaatccctgggagaagggaaactcctgcagtgatggccagctcaccagctctctgcctgggaacaatatccacttcccagtgcagggagctggcctctgagcagagcacagcagccccactggctgaggaggcggtgatcagagaggggcagccaaagctgcacattttatggaatggggcatcagaaaggaggatgctgtgaagatagggggcccaggagtctatgtgcaggtctccacaagtcatggccaagggttgtgctgtccgtgtgcaggacgaggccactcgaggtttaccagatagtctgagatcagaacagaggtactaaaactggatgtgtgtgtacacttgtcccaggcaaggaccgaacactgaatgcacggcagggaaggagcacaggctgcatttgctgagatttcacatgaaatgttatgtgtgcatttgctttgtatcctctctgaccagaccttcaaagtaagtgtgatcctccctgggcttttattgcacatgctgagctccagtgaggaatgagctgcttttatcctctgtgatctgtaaactgttaaactttccaaaaactaaaaactcaatctgattccacagctgtgataataaagaccaattgggaaaaccccagagagattcagggagtgagactgtttagatcaccatgagcctgagacagctggttcctgcaagaatgaatgtacagcattttctaatcagtctcctgcctttttcccaagaagctttgcttttttctttttgacttttgcagttagtgtacacagagtcagttcattcacagacacctcatggaggcacctggaggtccttggtgaaggtaaagaagtactgggaatgcagccacggaatccagctgtgtcctcgattgaatttagcacagtacacaattcagtgtgtaccctgcagcttgtccccccagtgattgatgttttttaccaaatgttaataaccaaggcaaggcaagtaaccaggcaaccaaggcaagcgaaagcatcttctagaagcaaatgcgcaggctgtgtggttttgctttgccctgtcctgctgcgttattcatgagtgctgtctctacattcccccgtctgcaactttagtacaacctcaacactctgggaagatattcttggatatgcactaaaattagatttttaccttcccatgtgtaattcaatgtcttcatttttctcaaatgacttttgcttcattgaggtggacaaaattctgtatcttactttttttttttcctaaaccctcctagagacctataaccagttttggagatggttggactgttacccttttattaaacatctaagactttcatcaaaaagttccatattccactcagaaatattgctaaagtatttatatcctgggaaaagttaatttgtaattagtaactagcatttccctgggtaaaaataatcagcaagtttctttctgtttttgctccactttttcctccccaaaaatcttgtacataaattccaaatgttagtgttcagagtggacaccacactctagccccttaagacaatcagggtccttccctccttgtttccttcttccctccccctccctgtcctccctccttctctctccccttccctccctccctttctttcttccttccttcctttttttttttttgatagggtctcgctctaccacccaggttggagtgaagtgatttgatcatggctcactgcagccccagtctccccaggctcaagtgattctcctgcctcagccttcccagtagctgggattataggcatgcactatcatgcctggctaatttttacattttttgtagagacagggtcccgccatgttgcccaggctagtcttgagctcttgggcttaagcacctcctgcctcggcctcccaaagtgctgggatttgtgagccatcgcacatgacctcctttttaattgaggtataacatacacatgtgcatgggggatgctcacgaggtgacccaggtctagaaagcacagcattcagccccccagaatcctcttcatgttcccctggttaccagcttccactcaaggataacaatgatcctagtccgttttattcagggatgaatatcaaggaaaataccagaaggtaacagcctacagaatgcctgctgggctgcttttcattttcttctcatggttcttttgatgaacctctgagtctcagatgagtggtccttgggaaaagaccttaccatactaacatccctggggtggtctgtgtttcttcttagttttggctgcttctgtgagcattgaggactgtcgcgcagcagctcagccagatttcacccctctctactttaaggcctgtgccagctctagtcatcccctcgccaaaaatgagacttttcacctccatccaggggtaggtcctggagtgagttctcagcttgctccctggggtgcctaggacttgcccggccacccatgtcccacaaactgctgtttttctgcctggtgcccagtatattggccctgcccacacgagtaccttgctgccatggcttccttgacctctctggtcactgcagtgggactggatcttaacccacctacctgggacccacagaccttgcctagctcctggctgcccagggctggatgcttttccagtccaggaaaccagcccccaagagactggtgaatgatggcatgatcccatcgctgctgcctgcctcttccctccaacccccacgaactggcccccagggcccaggctgcaggagctcctggaaactgtgctagccccaagaaagtcctggctcctggaggactgatccccttgcactccttaggccatcggctgccgtcagcagcctcccctgcctcccctgggctctgctgatgagggtgcaacacactgcatagctcatagcctctgtacgtggtctgcaagggaacagtaatttaaatgacatggctttggccgggcgcgggtgctcacgcctgtaatcccagcactttgggaggccgaggcgggtggatcatgaggtcaggatatcgagaccatcctggctaacaaggtgaaaccccgtctctacgaaaaatacaaaaaattagccgggcgcggtggcgggcgcctgtagtcccagctactcgggaggctgaggcaggagaatggcgtgaacccgggaagcggagcttgcagtgagccgagattgcgccactgcagtccgcagtccggcctgggcgacagagcgagactccgtctcaaaaaaaaaaaaaaaaaaaaaaaaaaaaaaaatgacatggctttgaatgaactgagagctctgataaagcataactcaattcatctcttttctgcaagtcatcttccatccatgtggaaagtgtgaatgataccagttgtgccacattgatactgaccccctcgttcctgaaaatacaccttagagctcatgaaagcacaccccagttactggaaaggaagccacttttgttgtaagcacagcagcagagcagcctctgaggtgcacagggctctgcaggttgctgcttggccttatgtctgagtaaggcctaagtacacatagctttttttttttgttttatttctgagaaatttaattattttagttctttttttaaatcaacttttattttaaaatttcagggtacatgtgcaggatgtgcaggtttgttacataggtgtgccatggtggtttgctgcatagatcaacccatcacctaggtattaagctcaacatacattagtgattcttcctgatgctctccctcccccacccccaataggccttagtgtatgttgtttctctccatgtgtccatgtgttctcatttgttcaccttccacttataaatgagaacatactttgtttggttttctgtttctgtactagtttgctgaggaaaggggcttccagctccatccatgtccctgcaaaggacatgatcttgtttttttatggctgcatagtatggtgtatatgtaccacattttctttattcagtctatcactgatgggcatttgggttgattccttgactgtgctattgtgaatggtgctgcagtggacataacgtgtgcatgtatctttataatagaaggatttatattcatttgggtatataaccactaataggattgctgggtcaaatggtttttcttctagatctttgaggactacaaggaacttaaacaaatttagaagaaaaaaaaacaacatccccattaaaaagtgggcaaaggacatgaacagacacttctcaaaagaagacatttatgtagccaacaaatatatgaaaaaaacctcaacatcactgatcattagagaaatgtaaagcaaaatcacagtgagataccatgtcacaccagccagaatggcgattattaaaaagtcaagaaacaacagatgctggcgaggttgcagagaaaaatgaacacttttttttcttttttgagacggtatattagtccattatcatgctgttgataaagacatacctgagactgggaagaaaaagaggattaattggacttacagtttcacattgctggggaggcctcagaatcatggcaggaggtgaagggcacttctttttttttttttttttttttttttgtcccaagacggagtctcactctgttgcccaggctggagtgcagtggtgcgatctcggctaactgcaacctccgcccccccgggttcaagtgattctcctgcctcagcctcctgagtagctgggattacaggcgcctgccaccgtgcccggctaatttttgtatttttagtagagatgggatttcaccatcttggccaggctagtcttgaactcctgacctcgtgatccacccatctcagcctcccaaagtgctgggattataggcatgagccgccgtgcctggctgaaaggcacttcttacatggtggtggtggcaagagaaaaagaggacagaagcaaaagtggaaacccctgataaactcatgagatgttgtgagacttattcactatcacgagaatagcatgggaaagactggcccccatgattcagttacctccccctgggtccctcccacaacacttgagaattctgggaaatacaattcaagttgagatttgggtggggacacagccagaccatatcagatggagtcttgctctgatgtccaggctagagggcaggggcgccatctaggctcagtgcaacctctgcctcctgggttcaagtgattctcctgcctcagcctcccaagtagctggtactataggtgcacaccaccatgcctggctaattttttgtatttttagtagagatggggtttcaccatgttggccaggctggtctcaaactcctggcctcaagtgatccatccgcctaggcctcccaaaaagtgctgggattaacaagcgtgagctactgtgcctggccaaaaagggaacacttttatactgttggtgggaatgtaaattagttcagccgttgtggatgacagtgcacacggctttgaattgtcccccagctgcactggactgggagttgctggtgctcctgatgctcagctagaattagagataattttagatggcaactaggggactcggttggggttgttccactctgagatgaaagggaacgtctttatttaggagtataatgttcttggagcgagtgttatgtcacaaaccatagttgggtggcctctacctctgccaacgtcagcaataaaaagtctgaggcagggaaactttttagagagaagaagagtgtttcctgatcatgggcttgggcttgtctacctgactagatttggacttttataataattcttttttaagatggtacacattctcctttttcctgtgttgtttctctgtggtctcactgctgcagtgccaggatctgcattcaaatacggccgagcccccagagcaccaccagtgcagtctgtcctgaggcactggactctcagagctctcctgcgggtttcagtcattttgtttggtttttcaaccatggctttgatcttgccagactttagtctcaacctgtgacccatttatagttacagatcaagaactagtggtcactttggcaacatacataccaacatggaaatgatacagagaagactggcagggaccctacacaaggaaaacaaaaaaataacttttttttttttttttaaagagagtctcactctgtcacccaggctggtgtgatcatggctcactgccaccttgaatgccagggctccagtgagtctcccacctcagcttcccaagtagctgcaactacagacatgcaccaccacacttgtctgatttttatttttatgtattttatatttatttttttgagacagggtttcactctgttgccctggctggagtgtagtggcatgatctctgctcactgaaacctctgcctcctgagttcaagcaattctccctcttcagcctcctgaatagctgggattacaggcacacaccaccatgcctggctaatttttaaatttttttggtagacgtgaggtttcaccatgttgcccaggctggtctcgaactcctaacctcaagtgatctgcccaccttggcctcccaaagttctgggccaccactctgagcccaaaaactattcttgacagtgttcaatgaactagcatatgggcgccttcttggttgtgggagatggtggcattgttgagcttccggatccatctgacctctcaaatgcttctgaagattttgcagatgaagaaaaatgctgttttgtatcagaaatgatagaagatgtaagtgtgtatataatgttctcatgtttttggaaaagaaggatttagcaagtgttaaagtgaatttgggaagggagcgaggaagggtgagaaggagaacctggcccgtttggatgcacaagttccttggggcggtagcattcaccagtgcagagagcagtgccatccaccccagagtctgttcctggtgggcctggcctggcctcagaaaatggggttctagtttctttaactgacaagaaggaatcaaagtttcaccactcactcctctagaatctgccctctcccaccctcagcctttcctttcactcttgtcgaagacatgaattgagcaagctgcagggcctctttcagcagggtctgctggcagtgtccactgcaaatgggacatgtgcttcagaggcaaatggagctggcgttctggccctgactctggcgctagaaatatttctttttgttctggctttcttatctgtaaaatgggtataacactagtcaccgtgcatggctgtaaatgagaaaatgcacagtgacaggcttatcacaggcactcagcaaatgccactgcccttcccagcccaccattttttttttaaaagacggttttgctctgtcatgcaggcgggagtgcagtggcatgatcttggctcactgcaagctccgcatcctgggctcaaacgatcttcctgcttcagcctcccaagtagctggaactacaggcatgtgccaccacacccagctaatttttgtatttttagtagagatgggatttcaccatgttggcctgtccggtctcaaacccctgagctcaagtgatctgcctgcattggcctcccaaagttctggggttacagcgtgagctaccgcacccagccaagggactcatacttaaaggactttggtcttgctcattgagcatttggttttctatttaaaatgtggtctttctgttggaaacgatctagtatccgtcagcattgctcttgggaaagaacacttccaggcagggcaagcacttgccttgtgtacacagatgccttgagatcagcataatgtaaacgtcaaaacgggtttctggatctaaagcctggcttgctttcttccaggtcagcagtgcaagagatgggtttggagatagggtcgcagccagcctgtgcgtggcagaggaaggaagggggagctgagtactggcaggggccacagtgctctctgcccttcccaagaggaaagcagaaaccagaccctctgttagaggccctccttgttttcaccttcccagggtttgatgtccataacatctggtttgaatgattccagcgaactggatggggcaccccactgccccaccaccgcctgttttttcatctttttttttgggggggggacggagttaatctctgcaccccagctggagtgcagtggcgctatctcagctgactgcaacctccacctcccaggttcaagcaattctcctgcctcagcctcctgagtagcggggattacaggtaccagccaccacgcccagctaattttgtatttttagtagagttgaggtttcactacattggccaggctggtctcgaactcctgacgtcaggtgatccgctcacctcagcctctgtaacctacaaacctcttcagaaagtgtaaaatgaaagcatttccccatttctaaagcagtgtccaggtttcatcaggtagctgtcgaacccaaagagactttgaagccaagagtccacaggatcagcttcccagtggccccagaagttacaagatggggccctcccaacaaaaggcatcctcaggcttttacgtaatgctggtgtgcttagcgactgctgaaagttgactgtgcttgtgtcgtgaaagccaagatgaagagacgttattatggttgtgtgttgctttcagctagatactcctcgctggggaaatgtaactgcaaagcagactccaggacactgtcttcctgaaagccggtgcttttgggggacattctggggcccaccagggtcatcctggatgctgactggaactgagaagaggtttgctgggaagatagggacagattctttgtatctatgtcattcaggtaaaccctacatgtgacatgtgacaccatctcttttgacctcagtttcaaatgagatatttgaccaaccttattgctaagggtcaggctagcttgaaataaccctcaagaaatctagataaaaacctaaatgagattataggctttttttttttgcctaagattatttgcttccagaaccctaaggaaacttcacaggaaacatggtaccatattttagtacacatctccatcctatgcatgttctccagaacctcttcacacacactttgaggagagttccatcaaacctccttctcttattccatcttaatgtcatgcattatttctcttcatcctgcctctccttttcagttacaaattgattctgatagaaacaccctaaatgaccttcccagggcagtcagagagttaacttgttgtagggttgcatttggccatctgggcagagggaggaaacagtggtcagtgtccaccctgtgggagggaggcagcacccaccacagctttccaactttgctggcttcacatttcccaggacagggcaagaagaggaagagctcctcagtggctgtggggagagtgcaggaaggagccctagacttgcccatttcttcttgtcccaaaacccaacacagacctaaaactcagccaagcccaagctatgccccgcttctgcaatctcttgcaaggcccctgcttaaacaacctgagctcccagctttagtaggcttgggaacttgatgcttcatttgggacaaactttgtggatccagggaagaaaaccttgttggggtgagcaggtggccgacaggactgaggatctaagaggtggggatgcactggagtccccagctggcctaggggaccggtacaggagtcttcagaagccaccatctcgatgggcagggacttagaattgaattttttttgtttttgttttttttgagacagaatgtcacctaggctggagtgcagtggtgcaatctcagctcactgcaacctctgccttccaggttcaaggcatttgcctgcctcagcctcccaagtagctgggattacaggtgcccaccaccacacctggctcatttttgtatttttagtagagacggggtttaaccatgttggctaagctggtctcaaactcttgacctcaggtgatccacttgcctcggccttccaaagtgttgggaatagaggcgtgagccaccatgcccagctagagttggattttagtttccttatcactgtgtaccaagcagctgctgggggctgcacccatcccgatggaggagcttctttctccccatgcagcctcatgctccctgcttgtttggtgtgctgacggggctgctgaacaggacgggttttcttttccccctgagaagcctcctacattgtggggagaagagtgtggtaggaagagcaatccagagacagtcttgtaggtctttaagaccttctcatcttggtctgcttgttgcgaattggggttatacagagatggtgatggtggtagtgatgacggtggtggggatgatggtcatggttatgaaggtaatgacgacggtggtggggatgatggtcatggttatgaaggtactgatgatggtggtggggatgatggtcatggttatgaaggtactgatgatggtggtggtggtagtgattcctccttgaccaaataagtctgggaaatgctggcatgtacaaaactaatcaggtgggttaatttgagaataagatatctttgagcctttaatgactctcctgagggatggacagaaatcctctactgttttgagcactgaaggcttttcctcaatactattctgtgaatggatttgggcaacaccaggccattcctggtaccaaaacaaaatgtactctgagcaaatttgggaagtttattcttatgttgccttactgaaaaatccaaaggtagattcccatctattattattattattattattatactttaagttctggggtacatgtgcacaatgtgcaggtttgttacataagtatacatgtgccatgttggtgtcctgcacccattaactcatcatttacattaggtatatctcctaatgctatccctcccccctccccccaccccatgacaggccccggtgtgtgttgttccctaccctgtggccaagtgttctcattgtttagttcccacctatgagtgagaacatgcagtgtttggttttctgtccttgtgatagtttactcagtatgatggtttccagcttcatccatgtccctacaaaggacatgaactcatcctttttatggctgtatagtattcgatggtgtacatgtgccacattttcttaatccagtctatcattgatggacatttgggttggttccaggtctttgctatagtgattagtgccgcaataaacatatgtgtgcatgtgtctttatagcagcgtgatttataatcttttggatatatgcccagtaatgggatggctgggtcaaatggtatttctagttctagatccttgaggaatcaccacactgtcttccacaatggttgaactagtttacagtcccaccaacagtgtaaaagtgttcctatttctcaacatcttctccagcacctgttatttcctgactttttaatgatcaccattctaactggtgtgagatggtatctcattgaggttttgatttgcatttctctgatggccagtgatgatgagcattgtttcatgtgtctgttggcagcataaatgtcttcttttgagcagtttctgttcatatcctttgcccactttttgatggggttgtttgattttttcttgtaaatttgtttaagttctttgtaggttctggatattagccctttgccagatgggtagattataaaaattttctcccattctgtaggttgcctgttcactctgatggcagtttcttttgctgtgcagaaactctttagtttaattagatctcatttgtctattttggcttttgttgccattgcttttggtgttttagacatgaagtccttgcccatgcctatgtcctgaatggtattgcctaggttttcttctagggtttttatggttttaggtctaacatttaagtctttaatccatcttgaattaatttttgtctaaggtgtaaggaagggatccagtttcagctttctacatatggctagccagttttcccagcaccatttattaaatagggaatcctttccccgttgcttgtttttgtcaggtttgtcaaagatcagatggttgtagatgtgtggtattatttccgagggctctatgctgttccattggtctacatctctgttttggtaccagtaccatgctgttttggttgctgtagccttggagtatagtttgaagtcaggtagcgtgatgcctccagctttgtgctttttgcttaggattgtcttggcaatgcaggctcatttttggttccatatgaactttaaagtagttttttccaattctgtgaagaaagtcattggtagcttgatggggatggcattgaatctataaattaccttgggtagtatggccattttcatgatattgattcttcctatccatgagcatggaatgttcttccatttgtttgtgtcctcttttatttcgttgagcagttgtttgtagttctccttgaagaggtccttcacatcccttgtaagttggattcctaggtattttactctctttgtagcatttgtgaatgagagttcactcgtgaattcggctctctgtctgttattggtgtataggaatgcttgtgatttttgcacattgattttgtgtagattcccatcttatcacaatcttcctcatctgtgatactgcacagtttgcaatagttcttgtttattactacttttctctcctgcagaacattgacatcaccaatttcagcagcagctggagcgatggcctggccttctgtgctctgctccacacctacctgcctgcccacatcccctaccaggagctgaatagtcaggagaaagtaagtcatggccctgtcaccttggttatcctctaagaaatgcaggagtcctaattgataaaccccactgtgggagggggcttacaggcctgaagtagaagttgggatattgataccaggtacagataactcctgaatgtttgactgcaccgtggaatcccatcctcagcaaatcttcctcagtttcccttctcaggaatctcagcttcatggtttcaagaccttggccagcatttttcaaagcctattccaaagaaccagcaagcaccaacaaaaagaattccctgttcaaataagtcttggacactgtatattgcatcacattttcagagagcatggtgcctgttaacacattaaagacttcaagaagtcctacattaagaaatctatgtgactgtttaacacagcatagatcagatccacttaacctctttacttatatttgtttgttttactacaatcacacaacaagggttggcaaattttccctgttaagggccacgtaatagactcagtgggtcaggtggtccagtcacaactgttcaactctaccatcgggctaaagaggccattgatcactttgtaaatgaatgtgcatggctgtgtcccaacaaacctttatttacaaaaacaggctatgagccagatttgggacagcagtttgccaacccctgacctagaacctcctacaaaatgtcccacagagcatactttggaaaatactgtgctgggtcccgctgttggtcactcaagaatttcttgtcaagcatcgggcactatcataagaaaacaggcaacaatagagacgttctatgccctcatgagctagacagataataagcaagcgagtagacttataacaagtaaaattataaattagcaaggataagtggtctaagagcccagagagaaactcagtgctgtgagacagagtgacggggatcacatttagaccagggagactgcagcggtgatgtcagaactggtgttggggctgggcatagtggctcccgcctgtaatcccagtactttgggaggccgaagcgggtggatcacttgagttcaggagttcaagaccagcctgcccaacatggtgaaactccatctctactaaaaatacaaaaattagctgggcatggtggtgcacacctgtaatcccagctacttgggaggctgaggcaggagaattgcttgaacctgggaggcagatcgcaccactgcacttcagcctgggcaacagagcaagactcctcaaaaaaaaaaagaaaaacaaactggcattggaaggtagaggaggcagcagtgcagagccagggctatggagcagcagcagctggggaacaccttggtgttgtccaggccgtggaagaaggctggttggctggatgcagttagtggggccagagaggctgtgctgatccagggaagtggagggggcagacccccatagctgggctgatctggggagtctggggcgggagaggcgacagagcttccccacagctctggtttggcctcacccactaaccatgagggtggtagcaacgcagacggaaagacatagaaggatttgaaatatgtctcagacagaatcaactggatttagtgacagattggttgtaggggaggaggagaggaaggagtcaaagatgacgccctggtgtctagtttgaaagggccattttctgagatggggagggcatagatatgtttaaaagctctgtttcgattatcccacatcaggatttaaataaagtacaaagaaggatcatagcaatgacaaaaactgagcaaagtaatttaatttttaaggtgttagaattctccaaaaaagcagaaccaaaagagagagagagagagagagagagagagtgtgtgtgtgtgtgtgtgtgtgtatgtagagagagagagagagagaggtgggggctggggagagagatttattctaaggaactagctcgagattatagaagctagcaagtccagcatctgcagggtaagccagcaggctggagactcagggaagagctgatactacagtcccaatgtgaaggccatttgctggtggaattccctcttcttcagtgaggttagccttttcttttaaggccttcacctgattagatgaggcccacccacactaactggggtcatttgctttgccgaaagtctcctgctttaaatgttaaacttgggccatgtgtgggggctcatacttgtaatcccagcactttgggcggctgagacaggaggatcacttgagcccaggagtttaagaccagcctaggcaacataggcagacctccatttctacaaaaaaaattttttttcaattagctgagcttggtggcgcacatctgagatcccagctactcaggaggctgaggtgggagaatcacttgactctgggagtttgaggctgtagcaagccatgattgtaccactgctctccagcctgggtgacagagaccctgtctcaaaaaaaaaaaaaaaaaaaaaaaagaaaagaaaaaaaaccttcacagaaacatctagaataatatttggccaagtatctgggtgccatgcctatccaagttaacacatgcaattaaccatcacagaatgtattaaaatatttaaattacttttctgtggggtgctttgtttgtgaagcaggctgtacaggattattaaacattctgggggaaagattgtatttaaatcatgtgaagtctgaggggctgtgaaatatgcaggtggtgatggcaggcaggcgattgcacagcaaatccggagctggatgggagagcagagcttgaaacacagatctgggggtcgtccatgaagagatccatgctgtctaatgcaggttcctgggatgatgggaatgttgtgtatctgcactgcccacagggcaaccaccaaccacacctgcttttgagcacttgaaatgtggcagatgtgactgaagactgaatttttaatttcaattttcatgttaaataaccacatcatgtgtggctgccatgttggacagcatgggcacaaatggaatttaaagccattaagagtggaggagagcacccagtcccttggtcttagggaagcatacagagggaggaccgaggaacacacctgggaaccccagtgtttgttgtggaggtagaggaggaggacacagcaaaggggaccaggaaggagcagccagagaggtggcctgagctggggccacaggcttcagcggcctcacgggtcacaggtgtcatctatgcatttattccctccctgccctcttgatgtcttagtgtctgcttttctgatacgatgttggagagataactgaggaaatagtgggcataaaagcactgaaaatagtcagaaggcctttctaacactgtgctgggtgaagcccacacatgcacacacctacgtcctcctgacagtgtgtgtgcgtcactccctgcagtcatccagacagactggctgctttgtccttgaatcagcatggctgtattggaaaattatggacctaaaagtgtttgttctcaggctccaaattgtgagccttgcctcctgggccagagcccctgtgtctggccctagtctctgcgattctgagcgcagaggctccgccagctgcccaggcctcccgcagccgtggcagcatgcagtgggggcaggctgaggccatggtataggcccctgctccctacatgcagggttgaatttcttccccagaccaatcacccgaccaccagggagtgtgtaaggcagcgtgtggaagactgtgggtctgtgatgagagtctgagtcagccctggatgtctggaatttttcattttaggatctgtttggcctcacagtaatcttgaattgggttgtgtcccagagcctaggattttatttgctaattacagcccgtttgccactctctgaaggaacaaccagcctcctgtttcctaaatgccccatcctggccacactctggaggagccacagtggctgcagtgacatttcgccacttcttggtgtgtggcttgccctgggggatgctggcgttctttttggtgagagaggccatatctatcacagttacgggtgtgggttttcaaagtaacgtatcccaacaggcagactcgtaccatataaaactgagcacacggggggaatcttactagagcagagaggggaaagagcaggaaagatttcctaaaagtgtgttagaagctgggattcacagggagcaagtggatgtgaatacagcacataccttgggtcatcaggatgagaggcacatgtgtccagccccagcctggagccgtgttcccctatgtgctcagtgccagggcatttttttttttttttaatttacacttacatcagaaagggcaccaagagaagcctttaatgtttgtaaaactattaaaatcaaaatctaaaaagtatgtgatagagttgttgatagcccagaatgtatagaaattatgaggtgtccccacctggatggaagcaattaaactatgtctgacattggtattaagtagagaatttctgataaaaactaacaagcatgtcttctatgatagtaaagagatatatgatcacagggtgcgatttacagtccatgaaagattttgtcattttgttgttgttgttgctgttttgagacagagtctcactctgtcacccaggctggagcgcagtggtaccatctcagctcactgcaacctccgcctcccaagtccaagcgattctcctgcctcaacctctcgagtagctgtgactacaggcacacggcactacacctggctagtttttatatttttagtagagatggggtttcatcatgttggtcaggctggtctcaaactcctgactttaggtgatccacccgcttgggcctcccaatagttctgggattacagtggtgaatcactgtgcccagccatttttgtttttattgttttcagtaaaaagatagggcattcacttgtccgcctttgcaactctctgcttagtccagacggactcaggtagtggactggaccttgcttatgtcagtatctgaaatgaatgaagtgtgaccctgagagggggaactctaggattggcatctttctcccgtcggttttgagtgtgaggcccaacgggcccaacccctcaatccctgctggtgactaagagttttgccacaggttgggcacttaggctgtcctggaactggaaggtcccaggcctgcaccatcatcccccgaccagggcagactgaagcagtgatggcgtcaccctgcccggctcctgtgggctgagctgcatctgaagcttacagcccgtgggggaagtgaggcccttcggagctgctgcttgtctgtggcttctgcctcccaggtggcctctgcacagtggtggtgacagtgatcaaatgaaagagcattgggataataacacttggtcacagatgttctgctgctgcaaaaatgaataaaagttactgttgtgaataaaaaaccaccccctctctgtattctatgtcaccctgtatactatttcagggtattttgagacagtttttcatcaagggatcctcccacctcaggcttcagagtagctgggattacaggcatgttgccaccacgtcttgctccgcttgtgttttcacaacagatactgaacatagaagaaacagcatgcagcacactgtgaaaacacagcggtgccaggcgttgtggcaacatgcctgtaatcccagctactccagagcctgaggctgggggatcccttgagcccaggattttgaggctgcagtagtgagcccatctaaaaaaaaaaaaaaaaaaaaaaaaagaggaaagaaaacaagtggtttcattagaatcaaactagaaggtttttgcataaaacgttgagtttaaaaatgctttctcgttagaccttactagtaatcaatacaaattaaaacaataaaatatttttagcctgatacatttggcagagacagtacaggaaaatagccacttatacactattgctggagccaaaaattggggtaacgctctagaaagcaatgtttggcattacatattaaaagccataaaatatttgacttctggaataatggtggcctaaaaactggctaaaaaccaaaaggactgaagtaaacacaaagacctcaatagcaccaaaataggagattgctgccattaatttgggctaaatggaaggaagccaggagttcacagctcccctctcagcagaacagagtagtgttagggtaacaagtgtgcagtttccagcccatgcccgctcctttcctttaatttcaaggaaggggcatggcagcttgggcaggatcaccacagatcaacagctttccaaggcatgggccacagactggaagaaaatgtggtggctacatctttctgtttttttggtgacctggtgcctagagtttgcttcagtgtcagggaaaacccgtcgcttcaggctctagatgttcaagcaagggtagagagtgagagccgtgggggaaatggaaaagggtataaaatgatgtatgaaatctaaaatacataattatgtataaaatctaaacatacaaaattaagaaatttggacaggtgctgtggctcacgtctgtaatcccagcagttcggaagactttgacaggcggatcacctgaggtcaggagttcaagaccagcctggccaatgtggtgaaaacctgtctctactaaaaatacaaaaattagccaggcgtggtagtgggcgcgtgtagtcccagctactagggaggctgaggcaagggaactggttgaacccaagaggcagaggtggcagtgagccgagatcgtgccactgcactccagcctgggtgacacagcgagactccatctcaaaaaaaaaattaagaaattctactgaggaacataatggccaggtgccatagctcacacctgtaatcccagcactttgggaggctgaggtaggcagatcgcttgagcccaggagttcgaaactagcctggtcaacatgacgaaaccccttctctactaaaaatacaaaaaaaaaaaaaaaaaaaaaaaaaagccaggtgtggtggtgcatgtctataatctcagctactgaggtaactgagaaacgagaatcacttggacctgggaggcagaggttgcagtgagctgagctcaagccactacactccagcctgggtgacagggcgagattccatctcaaaaaaaggaaatttcactgaggaacttaaaactgaatatgtagagaaacatttatatctcaattatacttaatataacaatttaattttaatataatcctaataattttgaaatgaattttggaatgggagaagcatgaacaaatgattcttaggttcatctagatgaacaaacatcagagaatagccaggaagagtccccaaaagaagccacacactagggctgaatgattgtggagcactaccattaacattctaaggggaaattattttcagcctcagattccctgtccagccagcctgttaactgaacgtgatggtagaaaggagaaattttcatacatccagaaaatgtgtctccccatattctttcttaagaaggaacctaggcaatagaatgggggtaaaatccaaaaatcagtgaggttctggagggcttggggctgtagggtttcatagaatgatgagatgattaagagctcgaggctgtgataaaggagaagatgagaaactgtgcgaggaagccagggtccaactatgaggcaggccctctgtgtcagaatagaatggcggcagccacaaggagaatgttaggacttaaaagcaacagtcagaatgggcaagaggccagatgagaaggaggcacaaagcccccctcccagtaaggaaaaccccaaacaagcagaaactgtaggaaaaaaacaaacttttgaagaaaggcagggtccaaatctggggcacactaaaatgtggggtgattttgggcgactggtagagtaacagaggaactcctttaaatgatgctttgagtggctcaggtcatgatggtggagctgtagaggacacgtgcccacagctggcttctgtgatgccgcttgtggttttcagcttccagaatcattctagtcagagagcgccgaggacttaaatgtgcttccagggaaggaagcaaaggttctcagctgtgacaatgtacaacttgaccaggtggagggaagaaagggtaatttactcctgacatacaaagtagagtcaggaagtgttgtccatacccagtgggacaaaaaatagaagttcaaggatattatttaaggtcacaaacatagctaatattaatacgggcactaaaattagctatgtgtctatagtgtaaggaggaggcagatgcatggtgcctgagtcctcatatgtcctggaggaagtcagtagaaaatgccttcattttagaaatcaagtagtagtcgtattagcatattacagagatacggaaataatccataactaaacagaaattgaaaggtagttctctgaaggaccaggattgaaggaaggaacaggttttcatttgatttaaatacaatctatatatactataatatatgcatttattactttgataatttttttgatatagcatcatgattaagcaactttgttatgcaacagaatgtttatgccataaatcttgcaaagtatgaattacctaaatcttgacaaaggtaaacaaaaatttatctttgataggtgtcaatcagtaatgttagttttggtgcagttgcaacctgttgatttttttttttcttaaactgagatcaaatattgtacacttgacttactattcttcgctttataatagtgaataatctatatgggaatatcagttgatattctttcctggcaaaagctatatattttaaattactgattccagtctctttgtctttttaacttagaagaggaatctcttgttggcatttgaagcggctgaaagtgtaggcatcaaacccagcctggtacgtatcctattttgtatccttgtgatactttaattgtatgagaaatgactttatgccatctgataaacagtttctcgtagaacattgacatctgtttgccgaaagtctgttgctctcaatacctaatatagagttatccagttgatataatcacatatcaacatatgatttagagattttcaatcgcataagatttcatatggacaaatttcagttctggaaacacagtggactgaattattattagagccctcttgttcagaacacctagaaatctgaataaaatgctatgttaaaaaatatcaacacatagctaagctcttaataaagaatgggaaatacccagatgccagaaatgtaaaacaaagcagaaaccaggcacaactgagcctgcaaaactcggcaggggtgggtgggggatggtgggccaagcaagcagcaagcctgcataaagccaaggctcacaacatgctgatcttcttagtgaaagcagaaatctctaaaactccaccagccagcccagggaggtgataaggaagctggtttccacctgggattgtgtgcgcacgtgcgcgcagagagaggaaaaggagagagagaaaagagagagagtctcttgcaaggaaaggaaacagggccagatgaggtttagagtccaaatttataatatctgtgctgcatgaagcccttagtatactcttagatgcaggaagcccctgggctgatactacaatggctgctaaaaagtaacagaacacttgagaaaatgatctacttgagctagtcagcagatatagcaaacaaaaggattatctaccagaacttgagatgataaataagagactaccaaaagactatttaaacatgaaagagataaaaggaggaatagaaaccacaaggaaagaatgattctatttaaaaaagagatttgtaaaaagaatctaacacttctagaaatgaaaaattggaattaagaccacaatatgtgttgccaaactcattagatacagcagaagagagaaatactaaattggaaaataaatacagggagatcacccaaaatataaaagagacattaaaaaatataaaatataatggtaaggttgaattagtatgtgttcagcttcaagaaatggaaaacccaaccagcagttgcttaaaccataaaaatgttaattttcttaacaatagtagttttagaactggttcaccactcagtattgtaatcaaagccccagagtgtctcctctccattctcaccatctttaatctgttccttttgtccccatgcttgttctttgtggttgaaggtggctgccaaacttcagacatcacttccacctacagggcaggaagaaggggaagagagagagcaagtgcctcctatctttccctttaaagaatgaaagtgaaaggctccctgggtttctccagctcattggcagtactctgttacatggtccccagctgcaagggcatttgaggaagtgagcatatgaacagttttcagtttctttagtgggaagcctgcgagggagagagcttgggaatgactgttgggctatctaaataatagtgtctgtctcagagtttaagagacagggacaaaaaaaatcagacaatggccatgtcccatgcccagagggaattccagatgaaaaggatagaaagaatggaatggagacagtatttgaagatatgatgcctgaaaattttccagaatgatgaaaggataatgaaagagtccacagattctttatttatctcaagcaggatgaataaaacaaaatatccatctagacatattgtaatgaaactacagaaaaagcaaagacagataatctattaaaaatttctgctcaccagtaataaaaatacaacctagtaggaaattatcaaagactagaagagaaaattcacagatgatgatgatgaatggtcaatgaggatttttaaagatgttcaatctcattagggattgggaaaatctaagttgaaataaaaatgagataacaattccagctgggtgcagtggcccacacctgtaatcccagcactttgggaggctgaggtgggtggatcacctgaggtcaggagtttgagaccagcctggccaacattgtgaaagcccgtacctactaaagatacacaaaattggccaggtgtggtggcgggcacctgtaatcccagctactcgggaggctgaggcaggagaattgcttgaacccaggaggcagaggttgcagtgagccaagattgcaccattgcactccagcctgggtgacaagagcgaaactccatctcaaaaaaaaaaaaaaaaaaaaaattccataaccctcaaagcatgtggggaatctgagaaatgaaaaagtgaatgtacatctattgtgaaatcttaccaccatgaacagtgctatgccagtgtaattttgaaacagaatggacagttttctagaaaaatacaagtatgtttcttcaaatattaaatgtaaatattcctatgaaacttaagaagacataaaactttaaccattgaagaggttgaatttatgctttaaaatgtagtcacacacacaaagaaaaaatatccccatcagcccagattttgctaaatctttaagacgcagatatccctattgtgtatttacaagtctgggaaatttaaaaaggtgtgaggaaacttacacatctgaccagggtggagtagcagggatctcccttcagaaacaacaaaactaaggagtaccaacagagagatcaggtaaggataaagatacaatgagaccttgttggaagattatattttacacagaatacatttttctttgtagtgttgtaattaatatttacttctgtttaaatataatatctttttcttaattttcatctaatgtgctatagaagttagtgagctgggaagtgaatgaggtcattttgttgtcctaattgtcagagccaggggtttcattggtgtggatggtctgtgaggagctgctgacacacatgataattaatctcaaaggcacttaggagtgtttgtgagcactttcccggctttttccaccaacaaaatagaaatttcctacattcttaaatttgcttttcagtaccttgatgtggattggaaaatccagtatgttgaattacacatgacactttaaaactacacccagtcagaagtgacagcagtaatccccaaatcttcagtcaagttctgttgttagattatgccaggaaaattgtcttatatgtttatattcaagtaaatataagtttctggggtataacatattaggatgagatctttatttttataatttcaacttttattttagattcaaggagtacatgtacaggtttgttacatgggtacactggatgatgctgaggtttgggatatgagtgatcctgtcacccagataggcacatagtagccgatagtttttcagcccttgcctccctccctcctttctccctcttgtagtccccagtgtctactgtccccatctttatgtccatgactacccaatgttgagctccatttataagtgagaacatgtcttatttggttttctgtttgtgcattagtttgctgaggataatggcccctagctgaatccacgctgctgcaaaggacatgattttgttctttttatggctgcatagtattccatggtatatatgtaccacattttctttatccagtctactggttttctttctccttttcttttttttttttttttttttgagatggaatttcgccttgttgcccaagatagagtgcaatggtgcaatcttggctcactgcaacctccgacttccgggttcaagcaattcttctgcctcagcctcctgagtagctgggattataggcacgcaccaccatgcccagctaattttttgtattttttttagtagaaatggggtttcatcatgttagccaggctggtctcaaactcctgacctcaggtgatccacccacctcagcctcccaaagggctgggattacaggcatgagccactgtgcccggccctttatccagtctactgttgatggacacctaggttgatttcatgtctttgctattgtgactagcactgtgatgaacataagtgtgcatgtgtttttgatagaacgatttcttttcttctggatatatacccagtaatgatattgctgagtcaaatggtagttctgttttaagttctttgagaaatctccaaagtgccttccacagtaactgaactaatttacatttccaccaagagtgtattcccttttctccacagccttgtcagcatctgttactttttgacgttctatcaatagccattctgactggtgtgagatgatgagatctttaaaaatgaagctctatagtgttccccagatattagaaagtgttctttctcagccaccgtgtaaggagagcatcttagccagcccaattacagatgcaagcaactccccagaaaaggaattaggcgagggacgatatgtgatgtcactgtcataaaaacggccaaaacatgtgtccccagggctgctgtgtctttaccaggccatgtagtccatgagggctgttgctcactgagtgccagcatgcccaccaggacagctgctgcaggactgggtgctggcatgcccccgtggagggaggtcaccatgcagcaattcctgaggcatggctgggcctactctgcaagtgtaaacttaatgagctgtgcttaaatagctaatttgtgcttgattgtgtgacaagcattttgtttttcatatttactgtatgtatttaccattttgggcatttttcatgcaaggacttgttggaccctcatggaggtcctgcaaggtggatgcactctataagaggaaactgaggcacatggcttatgagcgggaaaggcaagaggcaaggccaggcaggcagctccagagcgcatgccgtcaaccaccctgacagctgtgtctgccttctgcacataccttgttagatttagaccttagtggggtttttttttttttttttttggtgctattgtaaatgttattgtttttcttattacaaaatccagttgttcaattggtacataggacagcaatggacttttgtatactgaccttgtatcctgagacttagctaaacctgcatgtaaatgctttgggatttttctaaacaatcatatcatctgcaaataaaggcagttttatgtctccctttccaatctgcgtgccatttgtttctttttcatgccgtttagcactagctagaacttccagtacattttttttttgtttttgtttttgtttttgtttttgagatggagtcttgctctgtcacccaggcctggggtgcaatggcatgatctcggctcactgcaacctctgcctcctgggttcaagtgattctcctgtctcagcctcctgagtaactgggattatagacacctgtcaccatgcctggctaatttttttgtatttttagtagagacggagtttcaacatgtttgccaggcctgccttgaactcctgacctcaggtgatccacccgcctcggcctcccaaagtgctgggattacagtccagtacagttttaaataggacagatgagaaaggacatccttgccttgttcatgattttacggggggaatgttcaggtctttcaccattaagtatgatgtcagctgttggttttttatacatatcctttgctaggtaaaagaggttcccttctcttcctagtttgttgagagttaccacctataaaaactatcttgattgtggaattttgtgtaatgctttttcttcatctgttgatttgatcatatggtttttcttgttcagttagttaatgtgacgaattacatcagtttacaaatgttgaaccagccttgtgttcctgggatgaacctcacttgatcatgatgtattatacttttataggttaatagattgtgtattcatgagaaattggcatgtagatttcctgtaatgtttatgtctagttttggtatcaggataatgttgggatcctggaatgagttgggaattattctctcctcttccattttttgaagagattgtgtagaattggtattatttcttccttaagtatttgatagaattcacaagtgaaatcatctgggtctggtatcttttggagggtcttaactactaattcaaacaaatgtcatgcactataagattgttactaatgcagcatactctgtcttctgaaatgtataacatcttttcacaaattctcaaatatgttaacaatgtactaaatatttttagttcagttatgaagttcaagcatgtaagattgtctgctcaaaactgaatattgattggacttcggagtcctctctgagattaaagacacaccctttccataatacagaggaaagtgtgcagtgtgccatctctcttgtgtttgtaggtatcccttcttttcccagagctcatctatgtccaaattgcatgcccaattcttcatcagttcctttctgtaagtcatgttagcaacactccttggtacggattttaggttgccaggcctcagtctgtgtgcagtcatgactacagccagtgtaggtagaaggagacattctattcttgtattctgtgaaagtttgtttttcttttaaaattgttctaggtgtacctgcacggaatgttctaccaactcttcttccactcctttcccatgactaatgataggctgataattttttagcatcaccagggagcagaataagtgaagtctgttcagattttgaatcaggggatgaatggctcattaacagcctcagccaactctgttaacccccaggaactgatgtgctaagttcagccttacttttccatggcatctctgcttctggctttacatcagggtcctttcctactattctcttttaaccacacagaatccaaattcaatcccaaagttaattattaaatatgtccagtggcacaaatttcagaaaagtttgagtgcctgacaggatgcccaccctcttgcccctccctttctggcctggatgttatgcatgctcattacaagcttacttgcaaaatgaacaaaaataaatcagtcagtaaaaaccagcaaattagcaaaagtaaaataaaaataagccaaaaaatcaccaaactgtattaaataacaaacaaacaaaaaaacacattaagtagtaacaatgctggtaaaataaatggttgcatttgaaattggttcaaggcttttgtgataatcccactcagtaatttatcttgagggactagttcgacagaaggaaacaatactgcacaaagatgctgattgcagagtctgtggtggtcacgaggtgagcgtacactggatgccatgtcccttgtggacagcagtttccctggtgagtgcacattcactagaatggcagcccgcacagtggcacagcagcacggggacccgggtgtgaaatgctcagcccacgtaatggcacagcccacgtaatagcgcgtgcagtgtgctgggagtctggggaattagaggtggattcaaatgtaatttagaaacttggaaatcattttaatagtgaaattatgggtgatttttgctttttaaaacttgtttaaatgctgtcatatggttaaaagataaaagcagtgggaggtcatgttttccgtttttggaaagggacagtatctcctgaataagtgggaggaaaagtcctttaactcatcgctttcagcaccacctgtgctggccttcacgttctgtctgtgtaagtggagggtttccaggcagtgtaagccctaacctggactgaagtccttgaggggaaggggtctgtgatgtcctgccttgtgatctgtcccccattcccttcccctgcaggaactcagcgagatgctgtacacagaccggcccgactggcagagtgtgatgcagtacgtggcccaaatctacaagtactttgagacgtaaccctggagggcctggggcagccaccattgccacctactgcagcttttcctggaagcgcctgattactgtccactgaccctgctctgcccaccacccagctgcctagacttcaaagacaggctcaatccaagtggaccaacacccaaataagaaacagagtgggtcccacgatgtacctgtctgaaatgcaaatgcagctggactgtaaattggggactctttgatctcttgtgggatgcttctaaagagggcagcctccctccttccagaccaagaccccacacccaggcttgttttgctgattatattgggtggctgaacgaacacattatctgcagaaattcagacaaagaacatctccaaatcagtcttttggttgctgttgttaaaaatatcccggctttgcctttatgaaacctttgcccttggctgggtgtggtagctcgtggctgtaatcccagcactttaggaagccaaggcagtaggatcgtttgagcccaggagttcgaggctgcagtgagctatgagcataccactgcactccagcctgtgtgaaagagccagaccctgtctcaaaaaaatgataaaacccaaaactttgcccttgtgaaccctcccttcccccctccccccccaaaaaaaaacaacaaaacacaaaaaataaacatttgttccagggcaacctggaaacgtg

SEQ ID NO: 1691 - DNA, 227739 bp, Homo sapiens
aagaagcagaaaaggttggataaaagataaggtactcagacttgatactttaaattatcaagttcctaagtctatggttaccatcagttcatactttacaaagcatttattaacataaattcatttattatgtttctgtgaagatgcctggttaaatctgaaaccatagaaatgtaaagtattgtttactatttctgtgaaactagggtgtaaaccaaaagttttaaaagccatccctcaggaataaatttaggaattatttctcaagcatgactgtgagttaagaatattaagttttataacactgatgcttacacatcagcatgaatgttttcaaggtagtagtgctggaaggctctatattcacatccatggggctctcatcctgaaagcagtctggggactttattattttttttcaaccatttagagatatttataagtattatgggagaaggattgtcattgccttccagttctcttttgtgcttgcccgttaattcagcacctatttagtgagtggctcctgcctgctgggactgtgtacctttgtagaagctccctggctggtggggcagggccagggaggcacccatatgcatgttttcagtgaaagccagaatctaagtattcattaactaatatttgttgaacacttattatgtgccaggaacacaatggtgaacaagggaggtaaaggccctgctatcacggaccttccctagtagcacaggaaggcagataacccatgacagaaaatcaatggcagataatcgatggcagtgagagtcttcatttggtgataaaggctctgaagaaataaaccaggggctgtttggtggggtgggagagctactctagagagtataagaaagacgcctcctagaggaagcaccttggagcagagactgacctaggagaaaggagcccactgtgtgaggagctggggggacattctggacagagggaacagcagggtcagagctcttccttgggaactagctgcacatgctcagggagctgggagcggcccacatgaagcacagtgagcaggggagagtgatcagagctaggcgaggaggtgggcagggccaggaagcctaggagcttggggctgggacaaagaccttgggctttcactcccaatgcagtgagaagccactggggggttctgtgtagggagtgatgtgatctgatttttgtgtacgtgtcttaattttgaaactttaattttagtgaaaaaaagtcacataacatgaaatttaccatcttaaccatttttaagtggacagttcatgatttgtgttttgaaaagactcctgtggctgctgaatgggcattaagtggtaggcaagaaggggcaagagcagaagccaagagccagtgaggggaggctgcagcacccgggtgagaggcagggctggcccaaggggtgggcagtggtcacagacctaggagttccagaagagagacgattttctggaggtttagagctgggagtatctcatcagaaaggtttttgcaagaaagtcttgattggcataagcctaaaaggaggggataaaacattcatacagggaggccctcagattggtgaataccccaagatgagaaccgcaagtttcattggaagtgcagagaagagtcctgtttggctacgctgcagggtaaggggtcagcgtggctcagccgagctcaggcaagccgtcatttaatttggtggatgctattgtctgaatgttgatgtaccccccaaaatttatctgttggaacctaaaaccccatgtgataggattaagaggtggggcctttgggaagtcggccatgagggcttcaccctcatgaatgggattgtgcttgtgcaaaacaggcttgaggagctcccttgccccttctgccatgtgaggcgcagcaagaaggcaccttctgtgcggcagagtgagccctcaccagacactgaatctgctggtgccttgccttggacttcccagcctccaaaactgtaagcaatgagtttgccttgtttataaattacccagtctacagttttttgttgtaggaacccaaatggactcagacggtgtgtaaggggagcagtaggccagggttaggcacacagcctgaagtggcattgctgagggtcccgttgggggagttagcaaactcctcgacattcccttgttgctgaactataaaatggggatgacagcagctacctcacagggtagtcagaaacatgaaagaagacgaaggaaaatgatgaacatggtgccagtctcttagttggtgttgctaaatgttagcttaaaaatacagtaaaatgggctgagtgcagtggctcatgccagtaatcccagcattttgggaggcttgacgcgggaggatcacttgagcccatgagtttgagaccagcctaggcaacaaggtgagatttcgcctctatataaaaaaaaaaaaattagccaggcgtggtgacacatctgttgtcccagctacttgggaggctgaggcaggaggatcccttaagcccagggggtcgaggctgtagtgaattgtgattatgccacagcactccagcttgggcaatggagtaagaccccatctctaaaaaaataaatgagtaaataagataaaatgcaggattttgagcagaaaatgactgaccccagctgaattttcagaaatctgtcttgaatatgtggaacggatgagcccaggagggccttaatgccaatctgtgctggagaaaaaggcagggctcctacaggaaatgttgcaggcatctgatctgctggcctggacagccgtgaatttgagaaatgggcgccctagagaggagtccaagatgactgaggttttgagtctggaagagcaagagaaaggctgtgccgatgacagaaatagggaagtccgggctgaagctggttattcagggtttgttctgtgccccaggctgaggctggctgtacacaggcagatgccaggaggctgcccctgggaagggcttaccaacaaggagaggcatacgtatgagaccgtctcagactaggagaagattttctggagcggagagacttgagcacactttggaaggtggtgttgaagttagccgggccatgggagctgggcaggtttcctgggcctcctgtttgccacaccacatctctgtcttcttcctccagctctgcaccagcgcaggcgaccgtagacactgtacctgtgtcccatgccttccctgagcctgtgggcagcactggctgtcaggttggagggagggagaggatgcgtatgaggtgtttcctagctctggggtgctgcactttccgttttgcttctccctttcattacaagccctgcccacacctttgtaaacacttcctttctcagctcacctcagttccccagctggcgtcccaggcagaggcagttgcatgtgcaaaggcccggagccaggacttgataaatatggctcaagatgctgcagcctagatagatatgaaagtctctggttccctcctatactgtagtttttattctgtttactttgcactagaccattttacactattccaaaaaaaaaaaaaaagggctcttattttatttccatctccttttcctactgccttggctcattcactttaatcctttgatggaagccatgttacaggtaagggaataactacttattagtggtcatttagctctttgggatgctggttgcttgaggcagctttggagacagaaggacgtcacagaccagtgattgtgagctcttggtctcaatatagctgccagattatagcctctctcttgggtctgcatttcatatttgggacttgcctcggcctctgtttcttattccagattacaccctattccttatgggtctccatattataccctattccttatgggtctccagattacaccctattctttatgggtcttcaccttctggcaggagtccatagtttcttactccactatcaaagtttgttttcaggtttgaggtggtgtggttagcgatgtacaaatgttcttttccatttagtttttgtttttatcacttctttttttccagtgacttctgctgatgggatcaatgaattttactttggaatttttcttctgatgctgtatggaaatctgttcttttccttatttactgggaaagaatctgaggctattgggatgatttttcatctcaagactgtgggaaataatcagctttgaagcatttcctgtggccatttgctgaagtctgggattccgtcagctgcgccccaaccagattttcagtgttaatgtttccatgttaggtggtgaggctaagcagatatgtcatgtgccggctggtctaggagccagtgtcccagggctctcattcttcctctggaagtctctccaccgtggcactgctgacattgtaggccagatgcttccttgttgtagggctcccctttgggttaccgatgtctagcagcatctctgggctctgtccagtagcaccccaagttgtgacaccgtaaatgcctctgcacattgccacgtgcccattgggcttagaactactactgtagaagaggtcaggagcaaattcgacccatgttccaaaaagctccagctcagtattttcaacatgtggttcacttacgttctatttcctgctgagtcccctggcaattgagctatgtgcacattcttattttgttggttctcagacttgaatggtttggcctcttccgcttcccagtgcttattgtgcttgtagccgagccctgagtgccctctcccactcctggagactcgtcattattttctgattgtccagaatggtttcccagttgcctttctatttcttgccttaaaaggataatgaagctgaggcccgagataacctctccaacgcaggctccgaaggcagcaatttagtggcggaacagcgtgttttcagggagcaggagacgtgtggactctgactttaactgttgcccagcgcctaattgtattccttaaataggggttccctctctcctccttttctccctccctcctttctcttctactttacactgtgaaatttaagagttgcagtttaagtcctacactattctggagaggagagaaacttggtaagaaaataaaatgtttgacaaatttaaagaaaacacccctggaacgacatcccccaccccaccatgggtgtggggtcctagatttaactgtaattccttgatcgatgtgatcctttgtggtgttcatgaggattttaggaaatcatgagattaataatagaaaccttcttttcactgtcttgtacttggctggagcctgtttattttgtatggctaattcatatccataagaaaacgattactcagctagcattcccacctgtgtttatctttcagcagccaggatttgttaagccctgggcaattttaattgctgtgaagtgtcttccctgcaggtgtgtttccctcgcttctttctctctttcacatttccaagtgaaaatagtcttctctgtgtagaagagtgtgttccttggatctgatatgtctgtctgcctcctgccctgaacacacatttaattgacccatcactgtgtgctgctgagtcagaaggcagagcagcgctccgttgaacaccatcaacagtttttgtcgagagggcggctcatagttgtcaacagccttctgtgtgcctggcacctgatggacttgttctcctttcatctttacagttttatgaagttggcactgataactccatcttattgggtgaagatgtagagaatcatgttcagaaagcatggctgagttcacaatgtcaacagtggagctgaatttggaccaggtgcatttgatctatagccttggtgctctccagggagcaaagattattcagagaggccatccgtccctggtgtttaggtgtgtaggttttggaaccaatttaaactggatctgaatcttggctccaagataaactctgagatttgggcaagttgcttaacctcccttggggaaatgaagtttccccacctgtgaaatggatatgtcttagtctgttcaggctgctgtaagagaaataccataaactgggtgacttataagcaacagaaatttattgctcacagttctggaggctgcatagtctaagatcaaggtgccactagatttggtatctggcaagggcctgctgtctggttcatagatggagtcctcttgcagtgccctcacttggtggaaggggcaaacaagctccctcaggcactaattacattgatgagggctctgcctcccagatgccctacctcctaataccacaatgggggttaggttccaacatgtacattctgggagaacattcagatcatagcaggaggtgacccttacctcgtagggttactgagctatttacatagagcatttagcagtgctttgccaggctcagaatgaaataggatagctgctctcagctcatgacagcatttatgtaaatgaactggcttcagagagccaggctgaggggctgagatgacgggagggatgtagaagtggtgggaagtggattgggaggaaacctgaagaaacttggagtgggcctaggggtgcacctgctccccttctagtaggagtccttcctgcaagtggacggagggcaccatattgtgggttttttgtttttgtttttgtttttgttttttgttttttttttttttggagatggagtctccctctgtcacccaggctggagtgcagtagctcaatcttggttcactacaacctctgcctcccgggttcaagtgattttcatgcctcatctccccaagtagctggggctacaggtgtgtgtcaccacgtccccctaattttttgtatttttagtgagacagggtctcaccatgttgcccaggctggtctcgaactcctgagcacaggcagtccatccaccttggcctcctaaagtgctgggattacaggtgtgagccactcccagcctatattgtatattttaaatttgagaagaagatgggatttgaggagcagtgtatggctgatgggtgggtacaaaatggaaggccttgcccaggaaaacaatgatgggaatgaagccgaagatgctcaggaaagggagtgtgggcagcaggagggggatggatgaggagcattttctgggtgcagtcatgtgggagtagttgggttgaattcagagggtccaagagaaagggaccctgatgcaacaaacatgggcctggacagtgctgcctcagagcgggccacctgccaaccctggaaaggaggctgcgtgttcgtcaggggcaccatccacaggatcgacgcatttgttgccagagattaagagagaagtttagatcttttaattttgactgaggtggcttttccttcttttctttaaccaaggacttagactcctgaaatgttggggaaaaggttgacagggaaaacatccaccctcttcctgctgtttttcatctctatatttttctcttttgtggtggtgtggtggtgggcaataaataaaaggcatttcatttcaggggtaacctgggcagattttggaaaatgtagacagattgcaaaatcatcctatgttttcataaagtaagccctgtaatatccagtcctttattttttttttttatttagagagaggttttcactctgtcactgtcccaagtagctgggactacaggtgtgcaccaccatgcctggctaatttttgtattttttgtagagacagagtcttgctatgttgcccaggctggtctcaaactcctagactcaagtgatcctcccactttggcctcccaaaatattggaattacaggcatgagccactgtgcctggactgtaatagtcatttctaagtaattctaatcataacataaaagggtgtcttgattaaacagatactttattaagtcatctccatgagtcagtcagactgacaggttgctggttgattctgcagtaattggtgaaattcatcagtaattctcttcaagagtcactccggctctgttcattcattttatattgggaggaggtcctcatgaaattagttactgtataggtctcaacctatgcattctttcattgttgctgtggaaacaagcaataaaaatcgtgggttgaagaagaaaaataatcggtgctgaacatctgtaaaatacatgataattaacttgctttctgtaatccagaattttaaaaaaatcatcatacttggaacaaagctgagactcataaggttctgaactaattatgtaactgaatcattaatagttttccttggaaacactgtggaaaacaaattacgccgcctttaaaggagtgtttccactggtagcagcattcacagagccgctgccatcagctctgcagcgtgagctcagtcagatgcatgcctggacacacgccaccagctggtcactgtttcaatagggtcgggaactagatggtcgggaactagagagacattgtcaggagaaacaaggtcgcagactgagcaggatgctgcctgtggttcttctcgtggctggctaacgggctgtgaggggagaggcagccagggacgctagcactggccgccatcccccgggggcagttagtgagacccaccctgcccccaccctgtgcactgtgagagtggcagttagaattggttgtcacttgtgggtgttttgtaaagtgcatttctgatgttctttgaaaggacagaacatcatgggtttggtgccctgtgtcacaccctgagtccatggggacaggcggagtcagggttggggctggaagagaaccgagagggcatttaatccagtcctgttatgttattgacagaagaaacagaggctctgagagggtgagggatggaccaggccgctccttgctcaggaatcacagtgccggtccctgctggccagtctcgggctgccttccacatctctgtgtggattttcccctgatgtcttcagctgtatcttgctggtttgaacaattttcctttcataaaatattgtagttagggcagtcactctgcccaacagtgttgggtctgaccaattaaaatatgcttcattaattttttatgatacccatttttatccaaaagaagaaaaaagtcattttgtgcttctgtgaattctttcaagtaattcatttatgtttattttaaaaataagtatattgttcctttgtcaaccctaaagccacaaagcttatgggcattttattggttgactctggctgacctgttttatctgggtgtgagatacagatacatagtgtatgggtatttggtggaatgctgtctcaggtcattctgctgaaaagtgatgtcaggacatcagtaatgtggatatgtttcagtagtttggtaaaagctgttatggagttgtaaaaattagcctagtataaagcctataaacccatcttaggaatattctatttccagccaaatcataggtgctcctactctgtgatagttcatggtgacgtggtatgtggggtgtaaagtgtgatgatgtcatgcagcaggttcaagtgatggagacatgtttttcttttctgctcttttgcaggacagacccacgaagtcaagcatgcggagtgcagccaagccctggaacccagccatcagagcagggggccacggcccagaccgggtgcggcctctgcctgcagcctcttccggcatgaagagttctaagtcttcaacttccttggcttttgagtcccgactcagcagggtatggatcaaaatgcacagggccaggcagagcgcctggataccctgggttgggaggattgaagagggcagtaagcaaaccagtggcctctcggggcagggaaggaggctcccaaggaggggtcgcaggaggaccagcatgcctggacatgaaggaatagagctagcgggtgggagtgggggccctctggggtccagaaaggaggtctgcaaagtgtttaacacagtaattaaggtcctctgccctgggttgcatggacatcccggcagttttgccccaagcacggccctggataggggtcgaggtcatgcacgatctttgcagccccccacaatccagttgtagttcttcaagcccctcttactggaccccgcagcagcatggacgctgttgattacgcccttcatgagggagtgcgttctcctctggttttctcctccccccatccctttggtctctaaggttgggtgggcccatgccacattcctagactcatctcttttctagctgcattcatttctttacatgagaggctctcaccgtgcaaagcctagtgcctccttagctgccctgagatgaattcatagacagtagcacctacctcatgcaatactttagaaaagtcaatatgatcttctatattagcatggatttccatctgcacagctgtgctaaaggccttgagatgctccttaaagcaccacgggcgtgacagctacaatgcagatggatttgagatgcagactgatttgaattgtgttgatgactcaactacggtgaaggctgctgcagaaggagtgacgggattgttttgaaatagcagacactcttggtgaagttctgaaccaagcatggtgccggctccctttgttttagtatttttggacttagagcagacactcttggtgaagacactcttagagctaggcaaggggcacattgtttttatgagtcaaatggagggaggctctaggctcagataataataaaaggtgttccacctgtgtcagtgcctgcggaatatgtggaaagtgtgtgggtcgtggagcagttctttgtgtaagattgtcatgagcattttaggacatctgaatttcctgtcctcctacccgttaaatattagtaacacatccagtcatggtgacaaccaaaaatgtgccctcagattttcaacacatcccctgagggacagccctgtccccattgagaaccattgttctaggtgacgggtccattctcatggcttttaacactctaagtggataacgtccaaatttgcatctccagctgggacccctctaactgcctttgtgacatcacccttggatgtccaaaagtgtaacatgtccaaaaccgaatctcaatgccttcctctccatctctctcaccatcccctaacctgctcccccaaatcttcccatttgtgtaaatagcaactccatcttcttggttgctcaggccacagccagtggcatcacccttaaaccctccttttctcatgtctcacagtccatcagtgaaatgccatcacttctaccttaaaaatatgtgtcaactccaaccaattcccactgcctcccttgtgaccagttgggtcatgcccccacccttctgtgccctagtcctggtccttggaacacctgagtcatgtcacttctctgcgtcaaccctctagtggctctccccattcactcagagtgaaaagcagagtccttgaaatggccagcgatgccctcagggcccaaccctgtcccctgcctctcaggtgtggtctcgctcctctgtgccctggctcctggagctccagccacacgttctgctggtgtttggtgacagctgtccttcggattgccaggtgcactcctgcggcagtgtgtttgtgtttgctgctccctctgcccggaaagcacctggtgcctctataggaagtgtccttgacctccatcctcctcctcctgctgccttgttttccttctctgctcttgatgccattgcacacacctgcttgtttacggtctgtcttctcatggctggaaagtaagccccctgcagacagggactgtatgcttcttttttgtactcggctctgtccctagtgcttagaagagcacctgctacctggtaggcactcagtatttattgaatgatgagcacacctgttttctggcggtctgatggaacaagaggagcttgggggcgtggggctggcctgagttggaatcctggctctgccacttccccactgtgaagctgcaggcaagctgtgtagctgccctgagcttgtgcttccttgtctttcagatgaaggtaacaccttctttgtcataaggagtaaatgtgggtaaagcatcctatgtgtaattttgtttattattctattatcctggattgaaacatcatttccattatttttgtttttattattttcaacccaacagcacactttaaacttagatttttatgtttattattattttttctatatccaataagcaacatataaacttagatttttaaatgaatacatacattccacaataacagatcattagagctgctggaatacggaaatatttttaaaagcagtgtttaaaataaggcctcggccgggcagggtggcttatgccactttgggaggctgaggtggatggatcacctgaggtcaggagttcaagaccagcctgaccaacatggtgaaatcctgtctttacccaaaaaaaaaaaaaaaaaaaaaaaaaaaattagccttagccgggcgtggtggcatagtcctgtagtcccagctacttgggaggctgagacaggagaattgcttgaacctgggaggcggaggttgcagtcagccaagagcgcaccactgcactccagcctgggtgacagagtgacactctatctcaaaaaaaaaaaaaaaaaaaaaaaaaacccacaaaatatataaaataaggccggaagaagcataggaatgtttctaaaggacaatgaatgagatgctggacacttctcccattgataggttcatgttttggaaacttgttccaaagagaaaatgtcagggaaaagcaaatacagtcattccttggtatccttgggggattggttccaggacccactgtggataccaaaatccatggatgcttaagtccctgatataaagggtgtttgcatataacctacacacatcctcccatatactttaagtgatctctagattacttatgatacctcatgcaatgtaactgccgcatacatagttgttatactgtgtcattttaaatttttttattgttgtattgttaatttttaaaattaatgttttgaataactttttctgcacttggtaccatgcgcatattaggggccttctgctctccttcccgattcctgtcctctccaggcctgattctgtgcaggaaaatgatagggcttgagggaaggagcagcagaaagaaatgtagcccgcctgacctttccagccctggttctgttcctctgatttgaccttaatctttccacctatggtatgggaagaagaaaaatactaaaaaggaagtcagagagcagaagagagaaagaggaaatggtggtggacaaaaaagcaagtaattttccctcccaatattttactgtgacaatttgtaagcacacggggaggttctacagtagtacaggggatcccacagcagacaccatagaccaccacctaggtcctacagttagcatctcactatatttgctttataggaaatggatagatagggtttcactggtcaaaacaggaacactgagacaaatccactgaaagtagaactgaatacctgactttctttttttaaattttaattcgaattattatttttttaaaattttactttaagttctgggatacatgtgcagaacatgcaggtttgttacataggtataaatgtgccatggtgctttgctgtgcctatcaaccagtcatctagattttaagccccgcatgcattaggtatttgtcctaatgttctccctccccttgccccctacccaccaacagacccgggtgtgtgatgttcccctccctgtgtccatttgttctcattgttcaactcccacttatgagtgagaacatgcagtgtctggttttctgttcctgtgttagtttgctgagaatgatggcttccagcttcatccatgtccctgcaaaggacatgaactcattcttttttatggctgcatagtattccatggtgtatatgtgacgcattttctttatccagtctatcattgatggatgtttaggttggttccaagtttttgctattgaaaatagtgctgcaataaacatacatgtgcatgtgtctttttagtggaatgatttatattccgttgggtatatacccaataatgagattgctgggtcaaatggtatttctggttctagatccttgaggaatcaccacactgtcttccacaatggttgaactaatttacactcccaccaacagtgtaaaagcattcctatttctccacagcctcaccagcatctgttgtttcctgactttttaatgatcgccattctaactggcgtgagatggtatctcattatggttttgatttgcatttctctagtgaccagtgatgatgagctttttttcatgtttgttggctgcataaatgtcttcttttgagaagtgtctaaatacctgactttcaacattggcctgaactgaaggagcagtgaaagaaagcagggtgcagaggctggggacgtggacactcagggagggtgcatacactcctgtaaatcctccttgtggtatctgagcacagcccagaaagaagagaacctgcagtgtcatttgcgaggcccaggtctattaattggggtcctcttggttgcaaatgatgaaacattggcttaagcttgcttcagcagaaaaggaatgtactgagcagatcctaaggctcccatgtcactatgagcgggacaaaggtgcattttaacaaacccttcctgtgactctgatgtctgctcaagtttgagaagcggtgtccaaccataacatgttatccaccagtaacgaccagattatgttatgtctgatgattttagggctgtgaattcttttctacatctttgtggaattgagaggaatttcttagttactttaatctgtgaggcatttgaactttttccttttatatactttcttatacaggtggttggcagcttaaatatcagtgaagctgttaatgaagatacttactaaatagcaaagcagcaccgaagtgcacaccttcataggatcttctggagcaagccagaaatctcaagtggtgctgtggccaggaaacaaagcaaaaaatgcagtggtgaatagagaaggagcaagaattagtaactgagactggtagctttccttttgatgttgcatccaaaaagcagtgacaaagtaagagtagctaccttcagctgtttgttttgaaggacacgtgggatcagttttttgtctttatgtcctacccccaggaaaccttttaagctaccagtctttttcaaatggaattcctcgtggaaggtgcaggggaaatgaagtgctccccttgaaagctttgctgctacccaaactccatgccctatgggagggaggtggcacagcactggcctgcagcacatcatacttatcctgttgtctgggaaggacaggaccacatctacccacagtgcagcataaaatcccctagtccaagaggagacagagtcagctgagtgtggctggctcacaaaatggaacacaatagctgatgtgtgttatctctagctgtgcctggtgcatcacaggcaggcacactatgcatttttactgaatattgttcttggatggatttaccgaagaagagcctgaggttcagagaggttgatgacttgcttgatgttctattgtactctctggaatccccgttgcattgcgttcatttttcctaaaaacactcccctcctccctcctcctccttgccttaatttgaatttagtttttacaggataacaatagtaaaaacaataatgatgattttcatttgttatcgttatagttggtgtctgttcaatgcatactgtgtcagacactgttatcctaagcacactgcatggctaacttgtttaatcctcagagcaacactctgaagtgggtaccatgatcatacttactttttaggtgaagaaaccaaagcacagagaggacgtgatttgcccaaggtcacacagctaagcactggcagagccaggattcagacccaggtggtctgtattttcagcccttggccactaaactgtgctgccacgtgacatagcttttttcccaacccctgtgacgtgggatggggacctcctggctcctgttggtcttcagcctggtgttgctgtggaagacacccacccctccagaatgcctccctgccctctctgcctgagaaaaactgaatcatggcctcttctgtgaggtcttgggactcccccagcccctcctgggctttctccacattcgtttctctgcagcttagtgctgtcctcagtgtgttctgtgtggttatatgggaacctcctctttaggtggttaactctgatcggcagggcctcctgattcactttgacattcatgccatatgcacagcatacagatcttctaagtggacgtaggctaaagatgtacgtccagcctctagtgggtttttggtaaagcttagctgaattacagtgttcagaatgggagggacaggaatggagaagccacaagcccgacagaagcagccctggcaaagtgacaagaagggagggaggggtttggagctgtttctcctgccgatcttcccttccctctcccacatacatgtggagggctgctgcagtctccctaggagcatggcatcccaggaggagtgcccccctctctccccaggacgtccgcatcccccgtccacttcctcctggcactgaaatctggactttatctcactgcaggattcactgaaaggctgttggatggctggaatccccttcagcctttacagctaacatactaggtgttcccatattctaagggctcttttactgtgggtgagctggctggaggagaaggggagaggagaagggggacgagaaagggagccccaccctctgctcaggacccattgttcacattcttttccgtgtgaaatgttgctgcatccaggccctaggctatgagtggtggcatttctatgtttgtggaatgaatataaagtctgttttaggatcagtggacaaaaatcagcatgtttgaagtggaggttacaatcagttggttagtacgatatttgacatttaccctgggcccttaatggtgcagtttttctgatgtaaggagggtgaaaaagcagccactatgtgtactaaacagaaggcgtgatgagtacagtcagtgcaggatcgtgaaggcatcagcacattccttcttcagctaatcagcccagacagtgtggggtatttttgtattctctgctgtttgtgctctgagtacatgtgcacaaaatgcagtgacactgatcaataaactctttaagcctaataagcatatgcagtctcatagcaatgaggacataaacagggagaaggatcttaggtgattcaaattctcttttgttggccaggcacggtggctcatgcctgtaatcccgccactttgggaggccgaggcaggtggatcacctgaggtcaggagtttgagaccagcctggccaacatggtgaaatcccgtctctactaaaaatacaaaaattagctgggtgtgggggcacgtgcctgtaatcccagcttcttgggaggctgagacaggagaatcgttcaaatctgggaggcggaggttgcagtgagccgagattgtgccactgcactccagcttgggtgaaagagtgagactgtctcaaaaaaaaaaaaaaaaaaaaaaaaaagaaaaaaaaattctcttttggaggtgaggagactgagctaccagatccaaacctttccagggctccatggctcacaggttgcccgattcctaatacagcatggtacttcatgccctccttccaaaggaggatttagattttgtttgtaaatctaaagatgcttctgttgctgccagcctggagaaccaccatggagagccactaggaaaacagctgcaatgatgatgttgaagatgatgagagcctccaacatttatgttcttaataaaatgctttaaatttttaactaagggcacaactctagagatacgccaactgctttctcttttttttttcggtgggggggcgggagacagggttttgctctgttgcccatactggagtgcagtggtgcaatcatggctccctgcagcctcgaactccagcgatcctcccgcctcagcctcctgagtagctaggactacaggcacgcagtgccacaccccactaatttttaaaaaagattatttgtagaaatggagtcttactatgttgctcaggctggtcttggactcctgacctcaagtgattgtcttgccttggccttcaaatgttttctccattttagaattgaggaactgcagcatcagtacctgggtcatataggtaggaagaaggagcgctgctcccttcaccactccctgggctgcctccttcctgtgtgattgcagggaacctcctatatagagatcccagatcccaagtcttcttttgcatgtcccactccctccccacccttgaaaacaaaaacaaaccctgcgatgcagcacttactgctgactcctcaccagagaccccccagccctgagcatggtgctgcagctacctgtgctttccccccggtcactgctactgcttcacccctgttcttatcatgactggcgccacctatgttaccatgccaggtcctcttgcagtgcctcaaaggcaaaactcccactgcttgcgcactgctgtcttgtgttgcctccagctgtcatctcaccaagaccttgagtcccaggaaccaaccccttatggaagggggcagggcaagctctacctctgctgctctggggtggtggctggggatggaggctgtggtgggatctccgagggggtttcacttctgttcccagtaggagtgctctcatttgttggatttcctggtttattctgggtttcagagagcccttcctctcttggcctttgctgtagagtttgaaaattctgtactttgagtcagacttgcagattttagaaatgtcagagaatcagataggggaaaagcagaatccaccgtgtatggcttgcgttattgcgttaagaattcccttaaccactgtgatttccctttttcatttgagaagtcatctagggagttttcaaagtttcaaaccagaattgattttcatttggggaccagggaggcacctgagtgtgcttcttggaagagtgagtaatagtttttctctattgagaaaaagctgccaacattatagactatggtcatttaatattaaacatgtattatacaggtgacctgatggatggtttgagaggttggagagcttgagtgaagggatgctttttactctgagatgggaagtggaaagaccattacagagttctctaagaagggtagtagtgtaacttctggattaactcaagtgtcatgtttggtccatgatatggtttggctgtgtccccaaccaaaattcatgttgaattttagctcccataatccccacatgtcacaggagggatctggtgggaggtaattgaatcctgctgttctcatgatagtgaataagtctcaggaggtctgatggttttataaaggggagttcccctgcacatgctctctcttgcctaccaagagtatagtgagatgtgactttgctcctcctttgctttccaccatgattgtgaggcctccctagccatgtggaactgtgagtcaactaaacctctttcctttgtaaattacccagtcttgggtatgtctttattagcagcatgagaacagactaatacagtccagttgctaaattaggggactgtgctgttgttcagaaaatgtggtcgtgggccaggcgtggtggcccacgcctgtaatcctagcactttgggaggctgaggcaggtggatcacccgagatcaggagtttgagaccagcctgggcaacatgatgaaaccccgtctctactaaaaatacaaaaatcagccaggtgtggaggcacacgcctgtagccccaactactacttgggaggatgagaatcaggaaggcagaggttgcagtgagccgagatcgcatcacggcactccagcctgggcgacagagtgagactcgtgtctcaaaaaaaaaaaaaaaaaaaaaaaaagaaaagaaaaacaaaagaaaatgtgattatgctgacatctagtaactggagttgcacacaaatcatccttttaatgtgaattacttgtttttaaagttaataatttgttttgaaatcttgaccaagattgcatggctaatatgaagacatccaccatcaggctgggagtggtggctcataccgataataccagcatttgggaggctgaggtggaggattgcttgaggccaggagttcaagaccagcctgggcaacatagtgagatcctgtctcttcttttcttttcttttttcttttttttttttttttgagatggatagactgtttgccagtatagagtgcagtggcgcgatctcggctcactgtaacctccatctcctgggttcaagcgattctcctgcctcagcctcccgagtagctgggattacaggcatgtgtcaccacacctggctaatttttgtattcttagcagagatggggtttcaccatgttgaccaggctcatctcgaactcacctggctaatttttgtatttttagtagagatggggtttcaccatgttgacaaggcttgtctcaaactcctgacctcaggtgatctgcccgttttggcctcccaaagtgctaggattataggcatgagccactgcgctcgaccatgtgatcccacctctacaaaaatatttttaaaaaattagccaggcatagtgttgtgcacctatagtcctagctacttgggaggctgaggcaggaaagcccaggaattcaaggctgcaatgagccatgtttgaactactacactcctgcctgtgtaacagagcaagaccttgtctctaaaaaaacaaaaagacttctaccgtcatccctcttgttaaaaggcaatggcgagttactgtttaatgagtagactttatttgtgatggtaaaaatttctggagatggatggtggtgatggttgtacaacatggtgaatgtatttaataccactgaattgtgcacttaaaatggtgaattttatattatgcttattttagcacagtaaagttttaaaaattacaaaaaaaaggaaaaaaaaaaaacccagaaggctagtatttgcaggagtggaactaggactttgcctaaattgcaaacttccttcactccaattttctttttctgttttaatgaagcacagcatatttacaataaaatccataaagtacactaatcttaatcttagctataaagctcattgcatgtttatatttttttacacttgtgtaaccaccaccctgtcaatatgttgaacgttccagcaccccagaaggtttctttttggttgtaactccccgagaggtaaccactattctgacttatattaccatcatttgattgtgcagcttttaaacttaatacaagtggaatcaggcagtatatactcttttgtgtctgcttctttcacttagcataatacctgggacagccacccatttattagtatatcagtaattcatttttttcctatttgctgtgtggttctcattgcatttatcctctctgttgaaggacatttgggttgttctagttttgggctgctataaaaaaggtgctatgaacattcttttgagggacctatgtacttgcttctcttgggtgcggatctaggaatgggattgctgagtcacagggaactgtgcgtgctcacttaggagtctcccttcttcgacttactgcctttcagcaaatgtttgtcctacccctttcatgacagggaagaaagcaaagcaagagcagagggtgttgctttcttctattttccagccttagcgttagtagatactgccactttccaaagcagttatgccagtttacacttccactcacagggcatgagtgttccagttgcttcacagcctcaccaacacttggtattggtgtttattcactttcaaactatggtggggtgagggtggttacaccctgaaatttaaatgatgcaaagatggaaactttaaaaaattgtgcaaatatttaaacttctaactctcagtaaatgaccccaaagccagtggagtaggatggagcagggcttttcccttcagcctgtgtgatgggcggggctcgcccactgcatatcgacattgatttaagggcttttccttactgtgtgctctggatgtcagatacattagacagctttgggcagctgccttctccagtcttccggcactgttcctctccagagccttctttcatgaagacccaacagtagttgagagaattcagttgtggtttttctcattaacgttgaatgtaatctatctgggcctgaagtgtggatcacttaggagtctcctttcttagacttcagcaccttttagcaaatgtttgtcccatgacagggaagaaagcaaagccagaacagagggcgctgctttcttctgtcttccagcctccaagatttcctttctcacctttgaacacattttctgtgtcagatcatctacagaatgcttggtggtgaggccacagcagatactcagattgtttctctccctccacctcctcctggcctatgtcatgagcctttttttgttgtcctggaatttcttttgcattgccctaccctgccttttgtgcatctcccagttcttttttcattggttcccattctttttttcccccaccaggagagcagatttattttttatttaaaatttttgtttagagacgaggtttcactttgtcacccaggctggagtacaatggcacaatcatagcttactgcaaccttgaacttctgggctcaagcaatcctctcacctcagcctcctgggtgtcaccatgcccagctaattaaaaaaaaatattagcgagacagagtctcactgttgcccaggctggtcttgaactcctgagcccagcagtcctcccacctcagcctcccaaagttctgggactacagtcgtgagtcactgtgcccagccacattttttaaggctcattacttgaagtgtgacctgatggtattcttcacgcacagtcttagacactgctctttgaaacagtcatgggagatcatactcggacctgttatgacagaaacaggtttgtgtagctttgcattttttcacttcactctatcatgctactcaaagtgctgttattgtatcttgactgctgggcacatagcccagctcccatgctctgcttgtttatagcgctccttcctgaaaaccacctcttcatcctctctctttccttccaactctctcagctcaagagggccagcagtgaggacacgctcaacaagccaggaagtaccgctgcatcgggggtggttcgcctgaagaagaccgccactgccggagccatctcggagctcacggagagccgcctgaggagcggcacaggtaggagggaccgggcaggtgggctcggcaggccatcagtcctggccgcatggaagcacttcagtgacccatgacccatccattccttccctcgtgaaatatttcttgaccacttaccctgggccggaactgttttaggcagacgatgtcgctgcccacagggagtttacatctatagagtggggagaccgatgagaagcaaaaggtaactgggcgtgctgtggtttctttggtcccttcggaggtccatttgtcaccatgcacgtgtgaaatccttctgacatccaagcagggcggcatatgttctggggctgtcttgatacagaatgcattagaggaatgaatgaaccctgttgatcccttgcgaaggtgggtgtctaatatttgtactgaaccctatggaaagctgggaagagcctcgcccagcagctgtggaaggctgctcagagtggcttggacggcagtggcaacaggaagctgtgaaccttctcagtgttactcattttttaagaatcagaaaagggtttttcaatcattatatttgagttcagagcatgtgaaacatgaaatatcaaagaatttatttaattctctctttgtgcatatagataataactcttaagctttcatggcctaactcttacagtgcagccctcagtgtattgctaaattgtctaagacgggaaaaataactgaaatacatcgttactaatttttaatgtgttgaaggggcacttataatttttgtgctcttttcgtaaaagtcacattcaggctagatctcaaaaggtatattttaatttatcagtttttaaaaagttgaatctgtgaaaaccatacaaggtattcttttcttggatataaagggaatggcctggtttttctatataatggctttaccattgtaaatactgatattgtattaaacatacacacacacttggtttttaaaatacaataaacaaaagtaccatttatttttatcaagccagcctaacagtgatcccaaaagttaataaagccccactcaaaaaaagacagactgggaggagcctaggggcagggtgggaatgaggaccagccgagtcccgggtgtgggacaaattgcgtgtgtgtggtgtgtccccaaaagcaggaaggtggcgaaaggaggcgaatcccagtgggtggagggaggggaaaggcggaaggagaaaaaggtgggaggaggatcgggtgggagggtggtggctcactcaggacccagggggggggcagcgcgatgaggtgggtggccctgttcctgaacggcagccccaagaagggaaaggtggttgctgtatgtggaactttatctgatttgctttctgtggccagtggtaaacttggcataaaagccaccagtgtgtataatggcaaaggtggactgattgatgatattgctttgatcagggatgatgatgttttgtttgtgtgtgaaggagagccatttattgatcctgacagattctaaaccacctgagggattgtcaggattccacatagactggctaacattaaatgctggaggggcggtactttacaaccacacagagcactttagtgaataaagaacctgatagtatgctggcccacatgtttaaggacaaagatgtctgggaaataagcaagatcacagaggagctttcttaattgaccgaagtcctgagtactttgaacccattttgaactacttgtgtcatggagagcttattgtacatgatggcattaatttattggatatgttagaagaagcaagattttttgtattgactcattgattgaacacctagaaatggcaataaagaattctaaaccaccggaggatcattcaccaatatcctgaaaggaatttgtctgatttttgctggcaacttcaatcaagtcagaactgcgatgccaaggtttgaacttcagtggtgctgatctttctcatttggacctttgaaacattaacttcaaaatggccagtttaagccgctgcagtcttgcacatgcaaatctttgctgtgcaaatcttaaacaagctgatctctctggatcagtgcttgactgtgcaaatcttcagggagtcaagacactctgttctaatgtagaaggagcatccctgaaactgtgtaattttgaggatccttccggtcttaaagccaatttagaaggtgctaacctgaaaggtgtggatatggaaggaagtcagataacaggaattaacctgagagtgactaccttaaaaaatgcaaagttgaagaactgtaacctcagaggagcaactctggcaggaactgatttagagaattgtgatctgtctgggtgtgatcttcaagaagccaacctgagagggtccaacatgaagggagctagatttgaagagatgctaacaccactacacatgtcacaaagtgttagatgagaattttaggggctggaggaacatgtacaagatgaaaatgttttccttatcacttttctttctccacccgctcagttgtctagaagaaataacactgtaaggaagttaaaaaaaaatttagaggattatgcttgttctcagtggtgcataagggaaaaaattgacttttttttccatattctgatttttaacagaaaagcactcatttaatagatatagggaaactagatattgctgccttttgaacagggtaggggggtttacctggttttatgaccaggaatagtatctattacatttgcttttaaataggcatgatgtggaaataccatcttggtttgagatgcatttgaggattttaatttatggaaagcacaacatatgcaatttatatttattgaatactagatgcagtatggatatttaaattgtaaaaactttacgaaaacttggaaaaggttgttcaggtttataaatagctttagtgatgcctccttctttaaatacttgtcacagcatatgaatatggtaagatcagactccctaagactcttcaggttcatttttataatgtttactttttagaacaaaacagtagctaaattacagtaatatccagttcttactgattgagacagagtggaaagaaagacatcgttgtacatcactgtcattccaaaggtacagtggaactccggatggaggaagaacttacctatcactacaacacttataaatgagcatttctcagaatgtcattctaggcaagttccactcaacaccagaccaagcaattctgtctattcacactattagcctagttttctcatacaatcagcacaagcataggaagatacttcaaaaccaaaaaaccaaggtgcaccattaatattcatttaattcaaataccaaatagttttacatagggccatcttagaaatagatattaaatccagatctactgcaatcaaagcttacacaatatgaatgaatatggtagagttgcctgttaaaaggcaatgtaatataattgctgctagaaccctacagtggggaatgaggaattttaaacatatatttgattacagccaccaaaaaagtatatataaagaaagtaaaaataaaggcatttggctggtccaagatgtaacaccaatcagtcagcacctatgattcttttacttacattttttactttttgtttttgtttttgtttttttgagacagagtatcagtctgtcgccaggctggagtgcagtggcgcaatcttggctcactgcaacctccgcctcctgggttcaagcgattctcctgcctcagcctctcgagtagctgggactacaggtgcacaccaccacgcccagctaatttttgtatttttagtagagacagggtttcaccatgttagccaggatggtcttgatctactgaccttgtgatccacctgccttagcctcccaaagtgctgagattacaggcgtgagtcatggcgcccagcctgtttttttttttgtttttttttttagtgaaatttagcctgtttttcttgagtcattttctctctgcaacagtagaggaagggcctgtatctccctaccaatgacctggtgtccttacatctaccccaagagcagggatgttagctgtgtccacagggttctgaattctacagactcatcaacatgaggcaaggaatcattgaaaaccacttttgtctcctttgggagaatgactcatctttagtatttatgtagtgtattcttctatatctacatatgcaaagctttctttgacagtaaagggcacatatgcatagtgggagaagatcagacctttacaagtgaaggaaagcaacttcagaaatgaattattttctttgctttattatttttaccaagacagagaagtattgtattgagagattatctattttcataatcaacatttgcctaaattatatttaaatcatttcactttgtactatattttcaggaattatagaatgtgttattcactcacttaaaggtacctctgtagaaataacctaaaactgcagaaggatccgaaagatataacatggtgtgtttagaaactgcagattttagatctaatgtatactgcattaataaatgatgtaaagtgtggaaaaggaaaaaaaaagactgatcccatgatcaaatattaatataaaaatttgagatcagccgggcacggtggctcacacctgtaatcccagcactttgggaggccaaggtgggtggatcatgaggtcaggagatcaagactagcctggccaacatggtgaaaacccatctctactaaaaatacaaacattagctgggcgcggtggcgggtgcctgtaatcccagctactcaggaggctgaggcaggagaatcacttgaacccgggaggtggaggttgcagtgagccgagatcgtgcaactacactccagcctgagtgacaaagcaagactgtctcaaataaataaataaataaataaataaaaataaaaaaaattggagatcaaaatattagtgcataggattcaacaataaattaaaagaacagtagtgtacatcacaactaagtgaatttatgccacccaagaatggatgaatattaagaaattttggaatataatctatcataccatattaacaggccaaagaagaaaaactgtagttatctctatagatacagaacatacatgtgacacaattaacaatctttctaacaacaaactcttgatagactatacatgtgcagagacttctttaatgatgtgtatgtgtcacaaacaaaagccagcgattcccattaaagtcaaagataattcaaggttgcttactatcaccagtcatctaaaattttcggtagatactaaccaaggcagtaagataagagagatgtagaagtacataaatattggaaatgagggaacaaaatgatgattgtaatcagataataacattgtatgctttgaatttcctgaaaattgtcttagaattttctgaaattctattagagacaataagagttctgtatgtggctagttgtagactataatatatcaataactttcttttttatttattttatttatttatttttttgagatggagtctcggtctgtcgcccaggctggagtgcagtggcgcgatcttggctcacggcaagctccgcctcccagtttcacgccattctcctgcctcagcctcccgagtagcttgggactacaggtgcccgccaccacgcccagctaattttttgtatttttagtagagatggggtttcaccatgttagccaggatggtctcgatctcctgacctcgtgatccacccaccttggcctcccaaagtgctggaattacaggcatgagccaccatgaccggccatcagtagctttcttaccagtgactagaaaagataataatgtaagaaacagttctatttataaaggaatgaaagggcaaaatatttagaaatagtgtgagcatctataaaaaaaatcttaaaactcttttgaaggagaagtcttatgtccttcaaagaagacataaataagtgaaagcatatatgtgattcttaggaagattaaatagaattaagattaaacttagtacaagatataaaatgtaataaggatgtctgaattattctaagaattccttttcatcttgattcagtgggaatttgggagtggaaacctgaataaaataactggaatttatctaaaacccgttgttctcaatgggggacgattttgtcccccagttccaacccagggaacaattggcagtgtctggagacttttttttttttttttttttttttttttttggctgtcatgactcggggctgctactgccatctagtgggtagaagccagagatactaaacatcctaggatgcgcaggaccgtccctgcagtggagagtgtcctgcccaaaaatgtcaacagtactgctgctgagaaatcctgacctagcagaataaatattctagagtaaccaggaaaattctgacaatactaatcaggggattaaccttaggcattctggaactgaagaggtgctaggcagctcagtggaacggtggacaaagtgcagaatacactggaagatttagtacaggggaaaggtggcatttcatatcacggtggataattcactcaaaaatgtgaccgagtaagtatttaggaaggaataaagctggatccctatctcattcctcccatcaaaataaattctaggaggattaaagatttaaatattaaaaaatgaaactgcaagactacaaagagaaagcatcagagaattaatttgtagtcttggccttggaagaacctttctaagtaggaacagacacagaagccataaaggaaaagatgaaaaatgtacttacataaatataagaaacttctttgcaaaaagaagaaattatttgcaatacatgtaacaaaatgcttatttacaaagagtttatacaaatcaataagaaaaagaaaaataggccagatgtggtggctcatgcctataatcccagcaatttgggaggccaaagtgggaggattgcttgagcccaggagttgaagaccagcctgggcaacatagtgagacctcatctctacaaaaataaataaataaaaattagctgggtgcgtgcctgtagtcccagctgcttgggaggctgaggtgggatgattgtctcaaaaaaaaaaaaaaaaaagaaaaggaaaaataatataatagaaatatatatagcgcccatgaaaaatacagatggctagtggaaagatactaagccttacttaagaaatgtaaagcaaggctgggtgcggtggctcaacgcctgtaatcctagcaccttgggaagctgaggcgggctgattgcttgagcccaggagttcgagaccaatctgggcaaaatggtgaaaccctgtctgtacaaaaaatacaaaaattagccaagcatggaagcgtgcacctgtagtcccagctagttgggagacagaggtgggaggatcacttgaacctgggaagtgaaggttgcagtgaactgaaatcatgccactgcactccggcctgggcaacagtgagaccctgtctcacaataaataaataataaataaataaataaataaagcaaaacaacaattagatatataatttccgctaatacattagcaaaaattaaaacagtttatcatttctggtgtcattaagggtgtaaagagccacatatggttgatgcacaaggacaagttggtaatatctatctaaatcttaatttaatctttcaccaagcatttctattatttagcacttaacggttactgatattcttggaaaaggatgccaacatgtatgagcaagttcagttgcatgattatttataatagtataatatgggaaacaacctaagtatgtattcatacagggctggttgaacaatgtgattttggtgcagtagaatagtatacaggcatgaaaatgaatacagtagatttgtgtgtactgatagggaaagatttccaatatacattactaagtggggaaaataatatggtgcatatggtataaccttaatttggttttggttttagaagtatatattaattattaaaatcaacttttttttcctggaaggatgtcagaatgattatctttgaggagagttagcagaattgatagtggcagaggaaaattttttcattttagattttcctgtgctgtttgaacattttaaacatatgcatacattgctatacaaaattaaaaacaaggtaaatacaacataaatttagacaatataaatataaactaaacttttttttgccttcacaaaatccttcctcttctacttgccttttgtagtgttctttagccatttgttggtggatttttttttattgtttgcttatagcatctgctcctttgcacaggattctaggaaaagaccttggtttcatattggctcctaaagtagacaagttcccatgccccaaggggcattggcatcctttatttgtcaaaggaaggaaataactacatatctactatacagtgatgttgggaaaaaggtctgtgaataatttatatagactgtaatgaaaagtaagtgacagttattattctcctagttatacaaattgtttgtcagttacttcatttaagtgaaattaaattatttgagttaatagggttgaatttgaaaattacattttgtttctgaagcttttatttttttaaatttattttattttttgagacggagtttcgctcttgttgcccaggctggagtgccatggcgctccacaacctccgcctcctgagttcaagtgattctcctgcctcagcctcctgagtagctgggattacaggcttgcgccaccacgcccagctaatgttgtacttttagttgagatcgggtttctccatgttggtcaggctggtcttgaactcccaacctcaggtgatccacctgcctcagcctcccaaagtgctgggattacaggcgtgagccaccacacccagccaagagcttttatttttaaatgtcagtagtcctcaacatttttgtagcacctttggacagctgatacttttgtacattgtcatgctgtccccagactgcctcatttggaataggtgaataccagtctattaggacagaccattaggagcagtggtatgcagtgcctgtctgttgcaggtgttatcacctctacagttgtatagtattgtttcggtaatcatttcaatatttgattgcattttgtctattttacatgcgtgaaaacgaggaaaatgaaagtgctggttgggattacagcaactagttgtacaggctgaacatcccaaatccaaaaattcaaaatcccaaatgcttcaaaatctgaaatgttttgagcactgacatgatgctcaaaggaaatgctcactggggcattttggattttggatttttggattagagatgctgaactggtaagtataatgcaaatattccaaaataaaaaatcagaaatccagaacacttatggtcctgagcattttggataagggatactcaccctgtagtaataagcttgggttttaaaatctcagtactgccgggtggggtggcttatgcctgtaatcccagcactctgggaggccgaggcaggcggatcacctgagatatttggagaccagcctggccaacatggcgaaaccccttctttactaaaaatagaaaaaaattagccaagtgttgtggcgggtgcctgtaatcccagctacttgggaggctgaggcagaagaatctcttgaacctgggaggtggaggctgcagtgagccgagattgtgccactgcactcgagcctgggcaacacagtgagactcagtctcaaaaaaaaaatacagttgatacaaagatggaaattatttagtgtgttagaaattagatgttcactggacttaaaccaattttctataggctcagctgtgaaggaaaagaataaaattaaaggaaattgggggacttctggcaatatatagttgatttcctttcagaggaaatttcttttcacaggaaatcaactatatattagacttgtagggggcagaattctttttatgccatgcaagacttagtttttgtacttttgacttggggacaagttttctacgatgcatagcatggtattatctatattttatttcaattgtattaattttgagaaagatttttgtcatgaaattttaatacagtgttgtgattttgaacttacaagaattaaatctatagtcagcctatattttattgcaccctttcctgggagctgatctgtcctcagggagaatccctgaaatctactccaggagaaatcatgtaatcttttggtcgtaataattatattattgtctcagccttgcctagggcgccaacttgccatctgtcatgggtggtattggaactgcttgaatggggaggcatgagcttcctcattcttttcaagactatttccagtttctggtttccaggccttatgctgttctctggggctatgccaaagtttgctccaacaatagcaagaacacagcaaaaatcacaaaaggggcttctatttttgagccctgccacctgcctgcactgtgccggcttctctgagctgctgtctctattcatgctcacaatagccataggaagagcatggttattttatctagaccaggaaccttggctttggaaaggtcaaaccagttttactttttctctcccgtgcccaccacaggtttccatatggaacatccactttttctaattggttttatttcattaatattattcacttatctgaattccaaaaaagaattctgaattcttttttttgttgttgttgttttttctatagacggagttttgctctgttgtccaggctggagtgcagtggtgcaatcatagctcattgcagcctccaacttctgggctcaagcaatcctcctgccccagctctcgagtagctgggactacaggtgcacaccaccggggtctcgccatgttgcccaggctggtcttgaactcctgggctcctcctgccttggcctcccaaagtgctgggattacagacatgagccactgcgcctggcctggattccagttcttattattctttttctccctgaggtgtcctttgtgtgtatctcatgttacacagtggtgtggcttttagagaatgaggaggttccttgtgtgcagggtcctccctgcctgccccagggtcaagtgaaaggttgtggaacccccagaaggctgtcaaggaatccagccactaggtggcagccttgtcaaaagcacccaccttctcctctgctacaagttctggttctgacaaatgtttctgactttagaaacaatgcttgtatttattgattaattcaacaaatatctttgagtggctaccatgtgcctggcactgttctaggcaaaaggactatatgagtgagcaggacaaacatccctgccttcataaaggtacatgagcaagacgtgggagagatgagaaagccaggtgaacagctggagtggtggacattccaggcagagatgacggctggcccgtgtcccccacgtcaagggagtggcaggaagaccagtggggccgcagcagagtgaacaagcagttggggaggaggatagaaagatgggggagcttgcgagtcactgtcaggactttggattttttactcttgactccactggggaacttttgcaaggttttgcacagagcagtgatatgacccaacctcattttaaaaggactgctttgggctgcttgttgagagtggacagatggggtaagcagaccagcttggaggctagggctgtggtctaggaaagaagtgacctgggctgggctggcagccatggcaccggggaacagcagctgcgtctggatatattctgaaggggagagccagctggctctcaactttcctggtttttgaattgtggaaaaatacacataatcatttttaagtgtacagttcagcggcattaagttcattcacattgttgtacaaccatcaccaccttccatttccagaactgtttcatcttctcaaagtgaaactctgtccccattaaacactcgcttcccattccccttccctcagctcccggcaagcaccattctgttctttgtctctgaatctgactgctctcagttcctcataggagtggcatcacacagtgtttgtccttttgcaaccggcttatttcactcagcataatatcctcaaggtacatccacactgtagcatgtgtcagaatttccttcgtttttgaggctaaataatatttccttgtctggatataccgtatcttctttatccattcacctgttgaaggacccttggcctatttctaccttttggctattgtgaataatgctgctctgtacacaggtgtacagatatctccttgagacactgctttgactttttgagggtatatacctggaagtgggattgctggattctcctgatggattgtaaagttggtgtagggtaagatttctgctcatgttagcagtgggatgagtgagatgaaatctgatgggccttcccaagggatgaggagtgaacgtggatctcttctggagacagcagtcggctagaaggaggttcatgtagccacatttaaaacatttttaaaaccacgagacatggaagtgcccatttagatgtttctttatatagcacacgtgggatccaaagacatgtcactattttaaactgatatcagtgttttctaaaaggcaaaataaatgtgaagggctagttttactgtggccaaactctgatgcttgcagaatctcagacatctcagatggtgatcagtaagggcaagcagtcgtgattggctcactgccaagaaactgtcagtgtcctcgctgatacctggacccctgcatgctcccagttacctgcatcacaaccaggtaatgcctgaggctccaacctgagacacctgtcctctctgacatgaggagggaataactctgtcctctctgacatgaggaggggaactcgtctaacatggaaggtaagtattcttatccccatctgacatgtgaagaagcgaaagctccaggataggtagtgttcccaaattcaaacccaggtccgactccagagttcttttttctgctactctgtttgtctcaggtagggagacttgttttcttccctcatcatctttacctgttgtagaattactattaccggtgactagcattctttgctcactatgtgctaaccactgttctcagtgtgcgatgaatatggtctcctttagtctttactacagccctatgaaatagtatccttattatcattcccattttatagatcaggagactgaggcataaagagattaagcagactgtccaagtccatgggatataaatattggtaccaggacttgcagattaggaaacaggggctgaaagaaaaccatggatgggttggcttgctggggtgagagtggaggaaggggatgttggaagttttggagttgagaggccggaaggtgggtgggtcagtttcttggatgccacagaaggaggagggccatgagccagggatgtcagggaatggggagaatggggtggggatgtgtagatggcaacagggaggggaagaggatgccaggtcctgctgtgtgaactgcagaaatggaaggtgtctgtttacagtggggaggggaacagacggggggaagcaacagtcataggtatgaggtacagcgagaccttcagtttgggaaatgtgagaaaatgaacagactggccttgggaaggcagtggtgggattcatccagctgtggaagtgaggggacattcagagagctcagcctatgggaaatgttgatttcactgtgagttctgaagggccctgaagaagtgttggggactcaagggaggggcctggggcaggtggggctgaatcgctttggagatgagaacctggaaaatcacagaatgccaggaatgagtttgttcttgttttcataattttagagaggtcatttatcaatgagtatattttgtgataaaaaaaatttcagattcggtatagatgctcctccacttacttcatcggttacttccagataaactcatcataagctgcaaatatgctaagttgaaaacacatttaatgcacttaaccttccgaacatcatagctgagcccagcctgctttaaacaggctcagaacactcatatgagcctacatttgggcaaaatcatctaacacagagcctattttataataaagtgttgaatatcttacataatttattgtattagattggtgcaaaaaagtaattgtgatttttgccattttaaaaattgcaggccaggcgcggtggctcatgcctgtaatcccagcactttgggaggccgaggtgggcggatcacgaggtcaggagatggagaccatcctgactaacacggtaaaaccccgtctctactaaaaatacaaaaaatcagccaggcatggtggtgggcgcctgtagttccagctactcgggaggctgaggcaggagaatggcgtgaacccgggaggcggagcttgcagtgagccgagatcgcgccactgcactccagcctgggcgacagagcgagactccatctcaaaaaacaaaaacaaaaacaaaacaaaacaaaaaaattgcagttacttttccatcaacctaatttactggaagtgaaaagcagaatggttgtctgggcacttgaagtacagcttctactgaatgcgcgtcatgtttgcatcaccttaaggtcaaaaagggtaagtcacaccatcataagttcggaactgtctgtattttcattttcttctattttattctacatttaattcattttcacattgtggtaggagatctaccctctgaacacatttttaagcatgtaattcaggggcaatgctgcatagcaggtccctcaagcttacgcatctgtacccactgaacgactccctgtcgcactgtctgcagcccttggcagccaccactcaactttctgtttctgtgagtttgactgtttgagattctgcatccaagtgagatcatacagtatccttttgggactggcttatttcccttagcatagtatccttcaggttcatccacaatgggacatgtgtcagagtttccttccttttaaaggctgaataatattcgatcgtctggatagccacactttgtttatccatcatacatggatggaccagactggctttcagcttctggtggtgtctgaggtaaacccagttgtgaggatgttatgaactctgcactagttaaggtgctgaattctaagcttgaggacacacatggtggtgtcgtggccctgcgtttcccgggagtacatgatttagtcagggctttggagtggggccaagggttttctgtgactttctctgttggcacaaggtgcagtgctggtttggggatggcagctctcctgggtcctccctgggtgcctgtggtatagacagtggggagctctccctgcacctccccgaagaatactgacatctttgccaactctttccatccaggtcctggctgtctctccagttctccatgtcctctcttccttttatttgggctcttcccctgaagtttgctatttcctttctccctccttccctgctctcctctcctcctttcctttttgttgagtttatacctttgtttatgccttccctcccttcctctcttcttctctcccttcattccttccttcctttttgttgagtttatgcctttgttttatacttttattcctattgtgaatgggattctttattcattgtactttgttcttattttctaacatatggactatttcacgactttgaatgtcatccttacacaggaaccatgctaatcttctctgcatcattccagttttggtattagcactgtcactgactatattttctaattagatactttaaaaaatatttagtttggaactggctcgctcccttaccatcctctcttcttagcactaatggttttcagttgattctcaggtgtcttccaagcagacagtcatatcagctgcagataacaatgccttttgtctcctccattccaggagttattcttttatttctggttcttgctgttttgtgcatgtgtgaccccagttgtgttaaatgctagtgacatcttgacttgctctcactttactgtgggtgattttggtgttttctgattaaatatgatgcagaaagttggcttggggctttgttttacatgttaagtcttctcctcctatattcctttgagttattaggatttggtcatggcttttattaaatgccttctaggcatgctgttattactttgattattgcttctctttttaccctggagtctcctccaggaaattaaagtatgtgtgtatttggtctcctgggtatttcttccatgtcacatatgttatctctgattcttgtgatcactttcattcatgctctgatttttcaaagtttatcatctaatgtgctttgctttgtatgtttcttttcttcaactattatgtttttaatctttagtctgatttctgtgctttcaaattatttcttcatgacttcttgctcaactttcatagctatcaaatcttgaatttcaaatgagaatgcaaattgcagatttttttgaaatctcccatttctaccagtaactttgtttcataggtgcatatttacttggaatcctcagctgctcccccttttatgatctgccagagctttccagatagatctagagagttttctgtgatcacctatctttacagagggaagctagtattggtccaaaaatcagaaattgagagggatactactggagaatgtgtggttatcaggtcatctttttttttttttttttttttttgagacagactctcactcttttgcccaggctgaagtgtagtggcgtgaccatagctcactgtagcctggagctcctgggctccagcagtcctcttgcctcaggctctcaaagtgatgggattataggcgtaagccacagcgcccagccaggtcatatcatttacgctctgtcgaaggaagaggaaaaatttttgcattatctggggtgaaagtaaggagggcattaaagcctgaagtgcaattttgccatttttttcttttctatgtattttgtttttgttgttctcattgttactttagtgcctgttggaaggtggccttgtcctccccttctgcttgcatgatggcccctgttcttatcagctggccatggctgtttcccttgtgtggccttctgtgcatgcaggcaaggagaagggaacactagcaggccttctgaagctgctcatggcagaggcctcaacttagtagtccagttacccttttaaatgatgacgattctgtaatgtgccctttaatatcctaaaatgaaattcaccagtccatatacattactgaaaaaaatcaatataatgctgtacctataatgtagagaagaaataaaaggcaaataatttctaatgaagtgacatatcagtgtgtaagtgctggagcctgactccactagaagacagatgcttgtacattagtggagattgctgccttaagcttgaatgctacaaatgagactgactcatgggtgcagtgttgagaattcaaataccaggcgtgttgacatcagtgactttgaaatgttgacagctcagggtaaacattttgaataaagcaaagtactgtctttccttaagttacatgatagttgcattcctagaaaattcagtgtataatagcaatgctgtgtgaaactgctttgtgtttctctgtaaaacagagttagattctggatgtaggtatttataactgtgttctcctattcaggagtgctgtcagatcacaaggagggagcaggaagcaggaagcaggcgtgcccctcatatttgcaaggcttggggcaagagtgcagcgggggccatctgtttattcacaatattctgatataattaaatattctagtaaaggagatcaagtgtcagggatttcagatgacctggtagcttgtcgatctaatgacaataattttcttactcattttcatcttttttttaatcagtaatgggtgaattttgtgtggtgaattttattttttcttcccagcttcccccaagttctactttagtattttctcatttttatcactttgaaatttgtaattcttctcaaaggttaaaaaaattaatgatattcaaatataattttaaaataatttttcttcaaaatagaaattaaagtcaatataaagggtgaaatatatttcatatttttaaattttttaatttaattttttatttttagagacagcgtcacactctgtaacacaggctggagtgcaatggcatgatcatggctcagtgcagcctcaaactcctggcctcaaacgatcctcctgcctcagcctccaaagttgctgggactacagccatgcgccaccatgcctggttaattttttaaatttttttgtagagacaggtgctcactatgttcctgggctgaagccatccttccatcctggcctcccaaagtgctgagattatgggtgtgagccactgtgcctggcctgttttgtttttttttgttttttttttttgagacggagtctcactctatcaccaggctggagtgcagtggcaccatctcggctcactgcaagctccgcctcccgggttcaagccattctcctgcctcagcctcccgagtagctggggactacaggcgcctgccaccacgcccagctaatttttttgtatttttagtagagacggggttttaccccgtgttagccaggatggtctcaatctcctgacctcgtgatctacgcacctcggcctcccaaagtgctgggattacaggtgtgagccaccgcgcccagccagatttcttttttttttagctgttgaattttgtgagttctttatatgtactagaaactagttctttattggatatgtggtctgcaaatatgttcttccagtctctcttttatcttttcaaccttataacagggtctttcacagaccaaaaattttaaattttgatgaagtccaacttgctaattttcccttctatagattgtgcttttgatgtcaaaattctttgcctagagccagttttgttgttgttgttgttgttgttttgtttgtttgtttggttgttttgagacagagtctaactctgttgcccaggctggagtgcaatggcacaatcttggctcactgcaacctctgcctcctgggctcaagtgattctcctgcctcagcctcccaagaagctgggattataggcttgtgccactgcgcccagctaatttttgtatttttagtagaaactgggtttcactatgttgctcaggctggttttgaactcctgacctcaggtgatccacctgcctcagcctctcaaagtactgggaatacaggtgtgagccactgcgcccagctgcctagagccacttctttaagattttctcttatatttttcccgaaagtcttatagttttacatttacatttaagtgtgttattcatttttagttaatttttgcaaaagttgtgagacttgggtcaaggttacttttgttgtggatgtccagttgctccattgttggaaagggtatcctttctctattgaatcgcttttctacttttgtgaaaatcagttggggctgggcgtggtggctcacacctgtaagcccaacactttgggaggctgaggccagaggatggcagcctggacaacacggcaagatcccgtctctacaagaaataaaaaaattagctgggtatggtggtgcacacttgtggtcccagctacttgagatgctgaggtgggaggattgtttgagcctgggaggtcaagtctgcagtgatatataataacgccattgcactccagcctaggtgacagagcgagaccctgtctctattaaaaaagaaaatatcagttgggcatacttttattctgggttctccattttgtgttgttgatctatatgtctgtccctctgacaatgcctcatactgttgattatggtagctttgtaatgtcttgaaatcaagtagactgattcttcctactttattattttccaaaattgttctagctagtctagttcctttgacttcccatataaatatacctacaaagaaatcttctgagatttgatagtaattgtgttgaacctgtaaatcaatttggggagaattcacatgtttttactatgttgaatctcctaatccataaacatggtatggctctccatttatttagatctttgatttctttcatcagcattttgtagtttgcggcatacaaatcctatacctgttttgttagatttacacctaagtatttattttttatttttgaggaattgtaaatgatactgtatttttaattttggtgtttgtgtgttcattgctagtatattgaaatgcaattgatatttatatgtttgccttataccttgcaactttgctaaagtcgcttattagttctaggaggattttttgtttgttttagattccttgggatttttcaatgtaaacaatcatgtcatctacaaataggtacagttttatttcttcctttttcttttgagtcgttttcttcctctgttgcccaggctggagtgcagtggcatgatctcggctcactgcaacctctgcctcccagattcaagtgattctcctgccttagcctcctgagtaggtgggattacaggcatgctaatttttttgtatttttagtagagacggggtttcaccatgttggcgaggctggttttgaacacctgacctcaagtgatccacccaccttgacctcccagagtgccaggattacaggtgtgagccactgtgcccagccaggacagttttatttcttcatttctgatctgtatgccttttatttccttttcatgtcttatcacactggctagaaagtttaacactatattgaataaaagtgctaacagtagacatctttgtcttgttcctgatctacgtggaaagcattcagtcttcttctttttttttttttttttttgcttttttgaagatggagtctcactctgtcacccaggctggagtgcagtggcacaatttcggctcactgcaacctctgcctcccgagttcaagcaattctcctgcctcagccttccaagtagctgggattacaggtgcgcaccaccacgcctggctaattttttgtattttagtagagacggggtttcactgtgttgcccaggctggtcttgaactcctgagctcaggcaatccccgcccgccttggcctcccaaagtgctgggattacaggcgtgagccactgcatccggccaagcattcagcctttaaccattaattatgtaatgttagctttcgggagtttctgtagatgctctttagcaagttgaggaatttctcctctattccagtttttctaagatttttttttttctgagaaatgtccctctattccagtctttaccatgagtggattttgaatttgtctaatgttttctctgcattgatagatgtgattatgtgacttttcttagcctgttaatatggtagattacattgactgatttttcagatcttgaacctgccttgtaccctctaaagtccacttggtcgtggtatatgattatttttatatattactgaattctatttgctagtattttgttaagaatttaaaaatctgtattcatgagggtctgtagtttgcattttttgtactgacattttctggttttggtatcaggataatactacttcataaagtaaactgggaagtattcctaacttttctttttttctggaagaaattaggtaaagtttgtgttaattcttcgttaaataattggtagaattctgagtgaaatattctctacttagaagtttgtttgtttgtttgtttgttttcatttttttttggcttttttttttggtgtgaaagggtgagtttaaaaaaatttcaaattcaaatttccctaattgttatagggctactcatattacctgcttaatattgagtgagttgtatttttcaagcagttggtccatgtcttctaaactgtcaaattttatgtgtagttatttatttatttatttatttatttatttatttatttatttgttgagatggagtctcgctctgtcacccaggctggagtgcagtggcgtgatctcggctcactgcaagctccacctcctgggttcaagccattctcctgcctcagcctcccgagtagctgggactacaggcgcccgccaccatgcccagctaattttttatatttttagtagagatggggtttcactgtgttaggcaggatggtctcgatctcctgacctcgtgatcctgccgcctcggcctcccgaagttctgggattacaggtgtgagccaccgtgcctagccgtgtgtatagttattcatattatattcccctttatcctttttgagtctgtggagtctgtagtgatatccccagtttcattcctgccattggtaatctgtatattctttctctttttttgtcagaagtttgtcaattttataattttttttcagaaccagctatttgtctcactcgtttttctctatttttttttcccatttcaccgagttctgctcttctttattatttccttatctgaaaaacagagctagtcttacccatctcctacagtgtgagaattaagtgaaatgacaaatacacgtacctaggacagaagcagaagtgtagattattttgtaaaatgtgatttttttcccccttgaactagctcccttaatagaatctcctacttaggaatcatggcagttaaaaaaaaagaatctacctgccttagtgtggtgtaccttgcccagtgtttcaggctttgctttcttaagatttttcttttttttttcaaaatcacacttgactcatgttatgtctagatttacatatacataaatttgagaggaataagaatagtttagtattgcaaactactcctcggccaccatggctcctgttgcaaacactgcagggattcatgaatattccagaaccacctgttgggatggaaagaaaaagaaaatggaaaatggaacttggcacctctggcaaagtgtaagaatgtattgtattcatcctatctgaaaccagtttaacagactgaatcttttgtgtgatctgttgtcaaagcccctcccggctttgcactccgtattcccaaccagaccagtctccactgtgggcagtggtacaactcacaaaccctcacagcgttcagacgcactcttttttgtttcaaggacaaggaaaagagatgtgaagtgtttcttggggcccagatggtgttattcataacagttgatggttagggttacaagattatatattcccatatagaatattcacacattatataagtattacttcatataatgtttatatatgtttaaatataaacatattacaaacatgtatatatttatgtaatataaatataacaaaatatagtataaaatatatattatatattccctatgtatatataataaagccacacctccaatttcaatccaaccactcagggttctttctagccttgcccctttctctgcttgtaaccatcatctctggtagtagtgagaaacatggctgccagtatcctcaatttatgtacctatttgctcaatataaccagtctcaaatccttctcccacctgccacctgcacccaactccccattccccaccctccagcctcactgaccaacccacccctctgcatgactccataacatcctttcactgccccatactcagctcccatgctgaccccttgccctgggaagggaaaaaaaattgggcacaggagctttttaaaaatggtatattataaagccaattaaatgtgcttcgtacttctagttgtttgcattatcagaaagcaagatttcctgctttctttgttgagaaaggtacttcttattgcttaggaaagttttgttttatttttttgagacagggtctcactatgttgcccaggctagtctccaactcctgggttcaagccatcctcctgcctcagcctccagagtagctgggaatataggtgtgagccactgcacctgacatgttgcctagaaatgctgaaatgggggtgaatgagaaatgctgtccctgcaggtaacttggtcaggttccagtatcccatactcccttatggaagaggagaaaagggaaagaattgtaggatcccaccatataacaagttttatgttccagaagaaagttctgcttttctggttctgtgtaatcatcacattggatggaagggaagctgaaggtctttccactgaattcatggaatattaaagttccagtccttgaacttgggtgtgaccttctgaaatgttcaagtttgtcagtggaaaacatgatcagatctcttatgctgcttttcctggctgctgacacacagtagattctcagtgttgtgtgttctcttttcctgaaagtttgtgcatgttactgagtttgccattgaattgtctttgtttgcatattgatttccacttcaaaaagtagtttaatactgtgaaagtactgttcctaagcaaattacagtacagatggtcagagtagaagtgtgtactcttgatacttccctcttccccctcaacagtggaatcttgctgggattttgtcagtgctgtttagatgggacgtttatccttatttgatcaatcccaaaaggcagcccctttgtggtagttttatactgtgaaaattagttttggaacattaagccaagaagtttgcaataaaatcaaatttgtttatgtattcatttgagacagggtcttgctgtgtcacccaggatgcagtgcagtggtatgatcatggcccactgcagccttgacctcctggtcccaagtgatcctcccgcctcagcctctggaatagtctggatggaccacaggcatgcaccaccatgcctggataatttgttatttttgtagacagagtcttactatgttgctcaggctggtcttgaactcctgggctcaagtgatcctcctgccttgacctcctacagtgctgggactacaggtgtgagccactgtgcctgatcccaacatacatttaataatctacattgcagggaattacattaggaaccatgtgtgggggaccagaagataagacttgcacgtagtcaatgcagtaatgagaagaccataagaaaagtctgtataagagagggcataggcatgactttgttctgtcctcttggccacatcctggctgtgtgaccttaagcaaattaacctaccaactacaaccattccttctgttgggaggagccaaatctgtgggagtggaaaaatcactgagaagaagccaaactctaggatgttgctgtagaaagggcctacacaccctgctgtagaaagggtcctagagtttggcttattttgtgtactggggatcactatgtctccttgcaaaccattgcactgggcgcggtggctcacacttctcacacttgtaatcccagcactttgggaggccaaggcaggcagatcacgaggtcaggagttcaagaccatcctgaccaacatagtgaaaccccgtctctactgaaaatacaaaaattagccaggcatagtggcgcacgtctgttaatcccagctactcaggaggttgaggcaggagaattgcttgaacacgggaggcggaggttgcagttagccaagatcacgccactgcactccagtctgggtggcagagctagactccatctattaaaaaaaaaaaaaaaaatctgtcttttcaaactctagtcttttatcaggtaaacattttctaagttttattcattttttttggaacaagtaagacagtttacttattcaaaatgtaaagggttacagtgaaaagttttgctcctgcccctttgcccagccaccaagttcacccaccagtggtggggaatgtggtatctttctagaactattcagtgtgtctggaagcaaaaggatatccttttacctttctgtatgcaaatagtaacgtaaatggacacaccattctgcacgtgcgcattttctcttttcagtgtattttggaaatcattcctatcattccataaagaacctcctcgttctggtccccatctctctggcacttgttttatgatttctcagtggttactgatagcagttcacagcctcattcccaagttatctccgtgtttggggtttaatttccctgggccaggatatttacattcatgagatggtttccttggactttagtttcctcccactaaggtttgagctacactttgcaaatgggcaaagaccatttttggatgtatatgcctgagggaagacagaaaaacaaagctgaaagagcatccagagggtttgccttcaccatcggaaaccactcagctccttttcagggctagcttttcagactgctttccgagatttctgcccactcctgtttggccatggccgtgtgccctattttcagtttctatatatgccctcatgttttcctgagcacatcaagaacgcctgcacggttacactggtttatttaggaaccgtcccctttcttcttcagtctgtcagttactcatttgaggtcagactcacaattctgcgaatgtcttagcctcttggaggagcatcgtgtgtgatgttggacaagctgcttagtgtctctcagctggtttcctcatccataagatggagttaatcgtgcccattacagagaattgtgacaagcaaatgaaatgacacatctgcagaactaagagcagaaactgaaatatagatatttttataaaatgtgatttttccctcaaataatcttctttaacagaatatcctacttaggaattatggcaaaacaaaaacaaacttaaaaaaatccacctgccttagactcttggtcatcttttaagattcttcaagttttgctttctttttttatttcctttaaaaggtttttttaaaattaaatctttattttatttattattttgttttttgagacagagtctaactccattgcccaggctggagtgcagtggcacaatcttggcttactgcaacctctgcctcccgggttcaagtgattctcatacctcagcctcctgagtagctgggattacaggtccatgccaccaagcccagctaatttttgtattttttactagagatgggttttcggcatgttgaccaggctggtctcgaactcctgacctcaaataatccgcccttccacctcccaaagtactaggattacaggcgtgagccaccgtacccagccctttattttattttatttttatgcaacagggtctcactctgttgcccaggctggagtgcagtggtgcaatcatggctcactgcagccttgaactcctgggctcaagcagccctcccaccccagcctcctgagtagctgggactacaggtgggcaccttcatgcccagctaaattttgtttgtagagatggggtgtcactatgttgcccagggtggtcttgaactcatgttcaatcaatgttcctgctgtagcctcccaaagtgctgggattacaggcatgagccaccaggcctagcttgagtcttaatttttttttggagtttccatacaccctctgcccccacacatgtacagcctctcccattatcaacatcccccaccagcgtggtacattgacatgacagatcattgtcacccaaagtccatagtttaagtttgggttcacttttggtggtgtacattctgtgggtttgaatgaatgtataatgccacgtatcggcaattgtaatatcacacagagtagtttcactgcccccaaaatcctctgtgctctgcccgttcatccctccctcatccctagtccctggaaaccactgatctttttactgtcccatagttttgcctttcctagaatgtcacatagttggaatcatacagtatgtcaccttttatattggcttctttcacttagtaatacacatttaagtttcctccatgtcttttcatggcttgatagttcatttctttttagcactgaataatattccattttctggatgtacaacagtttatttatccattctcctactgaaggacatcctggttgcttccaagtgttggcaattatgaataaagcttctataaatactcgtgaagctttgctttaagatgacatgtttttttctccccaagttaccatcacttatcaaccagttcttttttggtcaatattaaatttttccatttttggctccaactagtaaaaatagggccagattttgactaatagatgaaagaatattctggttagctgcagcaattcagagacaagcatgttgctccaggaagtaaggaactccatgtgcttgctagagaggtactcattctctacaagtggaggagctatggagtgacaggattggaagactttcatcaaagtcctttccaaccctgaaggggctgctattaaggtcaaagacctgttcttgggtacattttcttgtatcctcccatgtgggaagctctgttccaagcctttgggttacaagatagacagaagtccttgatgattcccaaacctgcatctcggatcccaacttgcccgttgtactccagaaacactcctcccactgtttgctgaaaatgtctggggaatattctgcatgtgtattcattcattccttcaatacatatttagtgtctactatgttccaggcatctttctgggtgctagggatgcagcagttaacgacaacaaaaaaagtccctgctctcatggatcttacatttcattctcaacatgtcttaaccaaacccatcatcctcgtttcattatagagttgtttaactgctttctctagcatctggatttgtcctaactgaagtggcatttctcagtcctccagatacattctagtgttatctttattaacttcctttctctcaacatgtaattgtcatctacagttgcatcttacacttcttatttatttatttatttattttttgagacgaaatctcgctcttgtctcccaggctagggtgcaattgcgcaatctcggctcactgcaacctccgcctccccggttcaagcaattctcctgcctcagcctactgagtagctgggatgacaggtgcccatcaccacgcctggctaattttttgtatttttagtagagacggggtttcgctatgttggccaggctggtcttgaactcctgacgttgtgatccgcctgtctcagcctcccaaagtgccgggattacaggtgtgagccaccgcacccagcccacttctttttatttcttttgcattcccctgacttcacccaacacagcatctcttacccaaagcacagtagcttcctgacttgagttgctgctggtggttaatgcttactctctcgtcctatgtgagtaggatcattttcggcccatcaattgaaaaagttggctaaaccagggaaacctaaaaaaattaaactatacttttaaacattttattttcacccaaaacatataactgcacatttgttcactcatctttagttatagagccaagacattgtcttacagtggtcttgttgattgaagtttttttaaacatctttccattcttatatctcctatgatttccagttttagtttttttaaacatgagaaagaacgaaaatacttaagaggaagattggatactgaatcctttcacatgtttgcaaatattcctctattataattgcttcagccatttttagtgactcatcttcattgagtcttttcaaaccattcagcatgtcttttgaggaagcgatatctctccctctttgtactcatatttcactagttaatgtacaaagttatggaaataaatttgcaagtacaactagcataaataggtttgggaacaaatatgcttgactcttactatgaagacaacccacatgatgggagcatgagtgcccaggtgtcccagagaggagactaccagccaaaagtgttcatcttgccaagggtgtcagtcagtgtgtcctgtaaacatggggtgcattggttattttggtgaattgattatctgtaaaatgttcagtagagagtgcataagagagcaacttctgtattaccagagtaatcttcctaagccacagctgtcatgagatcacttctctgctcgaaaaccttcaagcactcctcactggttgaggggccaagggcaacatcttgccttgtgattcattgtgatctatggctgtcttacctccctcccccgttggtgccttgactgtgaccttttcacagtcactctggtgaacaacgacggggcctgctgccggggccttgcttgtctaggctgtgcatgtccaagccaagcccctccctccctgctgcccccttctctcctcctgccactgcagaccttgatggatatgctgttcacctggaaaggacccgctcatagtagcacctccttcaaaaagcgtttcttgagctcctttcaacagggcatgctttttcctttaaaaacccttctgcagcaccccatgtgtatttgttaagtcactcccatatcctacctatactgcttctcctgcctaataactctctgttgccgtgagttgaacccagctcactggacctgctcgctgctcattcagcaagcaggcaactcctgagtatgggcgatgctgtcccctttatctcctcttcttcaaagactgtgtgtctttgaatgcgagctcaccaggctcccccaggcttcagtcatgctaactgattcagagcgaggacatggctcttttgaggttgtaaataatacatcaagtcttgaaggcttatctgcttgtctcccttgactttttcaagaagcagctttattgataataatttacataccataaaattcacccatttacagtgtgcaatccagtgaattttagtgaattgactgagttacaaccatcaccgcagatgagttttaagatattcctgtcactccagaaataccccatgctgctgtttccagtcaatatctgtttccaccaccagctccaggcaaccactaatctgttttttatccgtatagctcctcccttgactctccctgccacttcctcagaattggagtgttttctggactaatgtgtgtgctatttgcctaaggaacttttcttccgattcagttacgtaactttgtgatcttctctttcactcattctccccatgttcaagtttctcttggttttctttgttgtgtgaacctagtctctgttcaccgagttggcctttggcttattaagaaaactgagctttttcccctctttcagaatatggaaaacttgaatagtgtcatgtacaaatattgtagtgtcatgtacaaaccagatgctgaatgttatctaccgaatgaaggaatctgagccctgctaaggcatgggaaatcttgtcttctgttacattcagcatagtgcgtgtaaagtcactaaattattattttggttaataaatactttttattttttggtaaggaaaattacattgtttttattaagatgattcatgcttgatagcttaaagagtacaaacaaagtaataccttaaaaagaaaagtataatatgatccagtatttccacttctggttatatacccaaaataattgaaagcaggaacttgaaaagatatttgtgcgcccgtgttcttagcagcattgtttgcaataactaaaaggtggaagcaacccaagtgtccatcaacagatgcgtagatcaacaaaaatgtggtatatacatacaacagaatgtcaggccagccttaaaaagaaagaatttctgacacgtgctacagcatgtgctacctcaaagacattatgctgagtaaaaggattgtgtgatcattcctatgagggacctagagtcaccaaatccatagagacagaaagttgaatggtgattgccagcggctgcgggaggagggagtagagagttattcttttataggtaccaagttttggttgtgcaagatgaaaagagttctggaaatgggggtggtgatggttgtacaacaatgtgaatgtacttaacacctctggactgtacactaaaaatagttgagatgccagcctggctgacacagtgaaagcctatctttaccaaaaaaaaaaaaaccaacaaaaattagccaggcatggtggtgcgtgcctgtagtcacagctactcgggaggctaaggcaggagaatcacttgaacctgggaggtggaggtttcagtgagctgagatcgcgccactgtactctagccttggttgacagagtgagaccctgtctcaaaaaaaataataattgagatggtgagttttatgttacatatattttaccacaattaaaaaataaaaataataaagggaataacagaagaagaacagagaagaaagttaaagtactatctgaaacaccacgtcttagaaacaaccagtgtttgccacaggaatattctttataggaaaaaaaaaaaaaagcctgggcaacgtggcaaaaccccatctctatcaaaaatacaaaactttagccaaccgtggtggtacgtgcctgtggtcccagctactcaggaggctgaggcaggaggattgcttgagcccaggaagtcgaggctgtagtgagctgtgatggcactactgcacgccagcctgggtaacagagcaagatcaagtttcaaaaaaaaaaaaaaaagtccgagcgtggtggctcatgcctgtaatcccagcactttggcaggccgaggcgggcagatcacttgaggtcaggggtttgaaaccagcctggccaacatagtgaaaccctgtctctactaaaaatacaaaatttagctgggcatggtggcacgtgcctgtaatcccaggtacttgggaggctgaggcacgagaatggcttgaacctgggaggcggaggttgagccactgcactccagcctgtgcaacagaggtaagactctgtctcaaaaaaaaaacaaaaaaacaaccagtgtatggggatggttttctaagcatctctttcagcggtggtaccttcgtaacgacaaataccagtacaggttcagagtagggggaatccattcagagtccttgagaggaggcctgcagcagggatggggggctgatcacgcaaggcaggaaagttgtctgtacctgcagcagtgagtgcctgataggcctgtggggcggcttcagtgcccaccacagggcgtgggggagcccaggcaacagggagcctccttctgccattagtggagggaggggcctaggctgctgaggttgagcttcccaagggagttctgtagaggagagaataaagagcacactatgtgagttcactgagagtcctcgctttgagaaaaggtgacacactcctgggactcccagaaatactgcgggaactttgcagttgggacgataagtaaatgactagggccagaaaaatattatttaatactgtttttttcttttctttttttttttttttttttttttttttgaggcagggtctctgtctgtcaccgaggctggagtgcagtggtgcgatcacagctcactgctgccttgacctcctgggctcaagctcaagtgattctcctgcctcagactcccaagtagctgggactacaggtgcataccatcatgctcggctaatttttttactttttgtagagatgtggtctccctgtgttgcccaggctggtctcgaactactgagctcaagtgatcttcttgccttggcctcccaaagtgctgggattgcaggtgtgagccactgtgcccagccagtactgttaacatgaccccattggtacccctagacttgttggtctagggaaacatgagacacacaaaatacataggaaggtgttcagcctataattttcctttatatataagtgaacttcaaaatcttgaaggccaatgatgactttgatttttctgttttagcaatagggtcttgctatgttgcttagattagactggagcttctgggctcaggcaatcctcctgcctcagcctcccaaatagctggggctactggcatgcattactatgcctggctcaatgaagattttttatatttgtaccaaggtctcaaagaaggcagtgggcagataatagaggtgtcacacgctaggaggatggatcacctaatgaatcagtggctgagacaagtacagaggttttttttgtgtgtatagttttatagtgattgatatcagtcttctttcatttagattatagcaaggttattcatatttaagttaagccctattaaggctaaaaacattctaattcaagaaggatgttcaagattctctccttaaagatattacatattttatagtttgctgtttaaagaaactatttgttttctgtgaatcctgaaatgttgatttctctttgaagattctgtgtccagcttctactggagacaaagtggtttagtgtaggaagaacgagtgcttcagtggcaacaggcctgcattaaatttcagctccctacttttaatctatatgaccttgggcaagatagcgtaatctccctgaacctcggtctcttgcttgtaagtagagaaaaagaatggctactgggtcagaccacaccggattcgctggattgtaacactgaggaagtgtgccaagtgcgtaacagaatggaaagtaggtaactcagagggtgtttaattcaggggttcggcatgccaaaaagggtgcaggttctttccatctttttggtcgaccaccctgattgtgctggcttggccctctggccagctcccctcgtcatcacgagataactactagagttctggcaacctcaaaccgaggacagagtcccatggaagaagaaggtttcagtatctctttaagaataagagaactttccccagccttcctcccagcagacctcccttcaaatgtttttggtcagaactgggtctcatagcatccttgacctagtcactagcaaggaaaatggaatcaccaggattaacgtaggctgtgcatgaaggatctactactcagctaagaacaggccaccttctctcagggccagctccctggcaggcaggaaggaaggaaggaagatgtgggaaatggctgataggtagtccacagagactgccacacttgttttgtggtgttaatttaaggtctagtttattatttggatcaggaatgtttaaaaaattaatgggctttatcttttagaggtattgtaggtttatagaaaagttagtggaaagtatagaaagtttccatatataccccctcaccatcacctccagactcccaagttactaacttcttgcattaggatggtacatttcttggaattgatgagccagtgtaagtacattgttattaactaaagtccatagtttatgttagggttcacttttggtggtgtacattctatgggttttgacacgtatccaccattacagagtcatacagagtagtttccctgccctaaaaatcgcctgtgctccacccgttcatccttcctcctaagtgcctggcaaccactgatcttactgtctctacaggtttgccttttttgtcagatagctggaatgatgtagtgtagctgaaaagaagtggccttttcagaccggcttctttcacttagcagtatgcatttaaggttcctccatgtctttttgtgtcttgatcatttctttttagtgctgaataatattccattatatggatgtaccacagtttatcattcaactattgaaggatatttttgttgcttccaagttttggcaattatgaataaaactgctataaacattcatgtgcaggtttttgtgtagacctaagttttcagctcatttgggtagatatcaagaagctcaactgctggatcttatgataagaatatgtttagttttgtaagaaactgacgctgggcatggtggttcacgcctgtaatcctggaactttgggaggctgaggcgggtggaacatgaggtcaggagttcaagaccagcctggccaacatggcaaaaccctgtctctactaaaaatacaaaaaattagctgggcatggtggcgggtgcctgtaatcccagctacttgggaggctgaggcaggagaattgcttgaacccaggaggtggaagttgcagtgagctgagattgcaccactgcactccagcctgggcaataagagcaaaactctgtctcaaaaaacaaaacaaaacaaaactgacaaactgtctttcaaaatggttgtaccattttgcatttccaccagcaatgaatgagagtttctgttgttctacatccttgccagcatttggtgttgtcagtcttttggattttcaccattctaataggtgcataacagtatggatcgtgatttttttttttttttttttgagacggagtttcgctcttgtttcccaggctggagtgcttggctcaccgcaggctccgcctcctgggttcaagtgattctcctgcctcagcctcctgagtagctgggattacagatatgcaccaccatgcccggctaattttgtatttttagtaaagacagggtttctccatgttggtcaggctggtctcgatctcacaacctcaggtgatctgcctgccttggcctcccaaagtgctgagattaacaggtgtgagccaccatgcctggccatggatcatgatttaaaaaaaatactggcacaaggaaatttgaactctggctatttggtaaaaaattattgttaatattttttagttgagataatggaattgtgtgtgtgttttttaaagagttcttatctttagaaatccatgctgaaatatttaccaatgaaataggatgtcttggatttgcttcaaaataattgaagctagaggaagaagtgggtgatagatgaaaaaaattggctctgagttggaaactattgaaactgagttgagaggcatatggagggccattatattagttctctttagttttgtgtatgttgcggcttttcataaaaggtttttactaattaaagtttaatcatgtattatttaaaaatgatagagacagggtgcaatggctcatgctataatcccaacacttcaggaggccaagtagggaaaattgctggaggcctggagttcaaggccagtctgggcaacatagtgagatcccatatctataaaacatttaaaaaagttagctgggtgtgatgacatgaggctataatcccagctacttgggagggaggctgaggtgggaggatcatttgagcccaggagttcgagactgcagtgagctataattgggccactgtattcaagcctgggcaatagagcaagactctgtctcaaaataagaaaaaagatggacactttggtgtttagtaaaaattaggaactgtcttctggtcctacctttgcttaagtttagttcttaacagtattctgaggaataaatgaatatttgttgaatatatatgtattagagtttattattcaaggaatcttcctagaaactgaagatttttggtaatatgataaattttacttgaaattattatttttagagatagggtctcactctgtggcccaggctggagtgcagtagtgcaatcatagctcactgcaaccttgaactcctgggctcaagtggttctcccacctcagcctcccgagtaactgggactacaggtgcacactaccacacttggctgattttttattttttctagagatagggtcttgtgctgtttcccaggctgaattttactttaaattattttaacatttatgtatttttccaaataaatgtatttttaactcaaaagcaaaaagcagtacatgtgcactagaaaaaaaaaaaaaaggacaagcaataaaagaacttatataaaggacatcataatcttgcctactcagagagggccactctcaatcagtgccttgaggtataattgttgaaaccctttccatcttatccaggtatctgtgtctatatagtttttgtttatgtacaaaaatttagaattgtattcttttttttttgagacagagttttgctcttgttgcccaggctggagtgcagtggcgcgttctcggctcactgcagcctctgcctcccaggttcaagcgattctcctgcctcaggctcccgagtagccgagattacaggcacctgccactgcgcccagctattgttttgtatttttagtagagacggggtttcaccatgttggccaggctggtctcaaactcctgacctcaggcaatcccgcctgcctcagcctcccaaagtgctgggattacaggggtaggccaccacccctcgcccagcggattacattcttaacatatgtactgttttgcttttaacttagtatctgacacatagctttagagactgcataggaagccatcatatagctgtattatattttattaaacttggacatttgtgttgaacattgtaggtttttccagctttttgctattacaaacagaaaggaggcaacgtgcagttgttaagaacacaaactctggagttaaatggcatggtttctctgcagaaaagggtgaatgtagcaggtctgggactgctgtccttagaaaggctgcttccaaggttggcacttggctcgtgtcagggaacttggatttcggaagggttcctgccaccctaattggtaagagtggctcactgcataaactgtgcaaacactgtagtttatgctgaactcctgttttccttccaggagcctatgtgatcgcctggtaaaaaccctggatgctaagtctctagtgaatttccctggcagacatttcacacgtgttgtcacagctcattgctggaagaattaagcacaccctgaatgactacactggggggaaattcatggaagcttgcacctagtttcctctggacttggtcttgtagaccttttcccttttctttgtatccttttgctgtcatatatcatagctctgagtgcaactgtgtgctgagtcttgtgagtcctttcagagaatcaccaaaccttggggtggacttggggacacaggtttaaatcctggctctgctgctttctagcggagtaaacttaggcaagttactcaccctctcagtcattttctaatctttaatttgagttaaaaaaacagttttgttttataaatcgaaatatataatgtacttagaatagtgcctggcatgtaattatttctcaacaaatgttaagaattatcttgcaagctagatgtttgtgtatatttgtaactatttcttttcttctttttttttctgagatggagtctcactctgtctcccaggctggagtgcagaggtgcgatctcggctcactgcaagctccgcctcccgggttcacaccattatcctgcctcagcctcccgagtagctgggactacaggcgcccgccaccacgcccggctaatttttttgtattttttttttagtatagtagagacagggtttcaccgttttagtccggatggtctcgatctcctgacctggtgatctgcccgcctcagcctcctaaagtgctgggattacaggcgtgagccactgtgcccggccttttttctttttttttttgggacggagtctcagctcatcacaacctttgcctcacaggttcaagtgattttttctgcctcagcctcccaagtagctgggatcatccctgcactttgggaggccgaggcgggcagatcacctgaggtcgggagttcgagactagcctgaccaacatggagaaatcccgtctctactaaaaatactaaattagccaggtgtggtggtgcatgcctgtaatcccagctactcgggaggctgaggcaggagaatcgcttgaactcgggaggcggaggttgcagtgagccgagatcgcaccactgcactccaacctgggcaacgagtgaaactctgtctcaaaaaaaaaaaaaagtgctgggattacaggtttgagccaccgtgactggcctgtaactatttctttcaaataaatttctgtaagaataactgctgagcttaaggatatgtactttttttaatgtgttctggtcatagtagtaaaatatatttattaagacagatatttggtatagaaaaaaagtctttcctaattctatatttcagatatagttatttctaataatttgctatatacatgtcaaaatttatttctacacatattaatatggacagtagaatatagaaatttttaataaaaatgggaccacatatatattattttattgtttatgcctgtatataagggatctttatattcagtgaagttccataaaaacctttttgtcttccttaaaacgcttagattataggtgaagtaaaaaatatgtaattataatgtccaagttgtcaacttagttatacctttacatttgaaattacacattatagaaatacagtaatttagaaattacagacagtccctgacttatgatggtttgacttaggattttttgactttgtgatggtacaaaagctatactgtacttcaaattttgaattttgatcttttaccaggctagtgatatgtggagctacacttttttgtgatgctgggcagtggttgtgagccgcagctcctagtcagccctgcaatcatgggggtaaaccttcaacagtactgcgttgtcagcatttttttgaatattgtttgccagcatttttgcatccatcctgtctacaaagcccatctcgacttagaatattttcagtttacaatgggttattgggacgtaacccatcataagttgaggagtgtctgtacactgttgctttttttatagtcatcacaggcgtctttgacatgtcaccctgtcaccatgatcatcagagccacttttaaggtttacatcagatacacagcacatcagcttcacttccgcgtgttgcttgattccactggactctttgattccacaggaaattttatcctgttcatataacattcaggcagttggtttttcatttgcccaggatgtgtgactgccacaacctgactgatccctgaactgctttttaaaattatccatggctgggcatggtggctcatgcctgtaatcccagcactttgggaggccaactcaggtggatcacctgaggtcaggagttcgagaccagcctgaccaacatggtgaaaccctgtctctacttaaaatagaaaaattagctgggcatggtggcaggcgcctgtaatcccagctacttgggaggctgaggcaggagaatcgcttgaacccgggaggctcttgtctttgacatgctagttctgtgggagaaaccccagctgggcctggtggctcatgcctgtaatcccagctactcgggaggcagagggaggtggatcacttgaggtcaggagtttgagaccagcctgaccaacatggtgaaaccccatctctacaaaaataaaaaaattagccaggcatggtagcatgcacctgtaatcccagctacttgggaggctgaggcacgaaaatcacttaaacccaggaggcggagattgcagtgagctgagatcacgctattgcactccagcctgggcaacagagcaaaactgtctcaaaaaataaaataaaataaaataatacaagcattgacaggtacagaagtaccatgagggagacagcattgaattctgtctgagatgtgcaggcagaccaaaggggggtgataacagagcaagaatttaaaagatgatatatattactctgcttcagctgccataaccaattgcacagactggatggcttaaacagcagaaatttatttctcggagtgttggaggctggaagcctgagttcagagtgccagcatggctgggttctggtgaggagtcttcttggcttatacatgccaccatctcactgtgacctcacataacagaaagagagagagagaaagatctcttcctcttctttttttatttttatttgttttattttgttttgttttttgagatggagtcttgctctgttgccaggctggagtacaatggtgcgatctcggctcactgcaacctctgcctcccgggttcaagcgattctcctgcctcagctgagaaggtgggactagaggcacgtgccaccacgcctagctaatttttgtatttttggtagagatggggtttcaccatgttggccagatggtcttgatctcttgacctcgtgatctgcctgcctcagcctcccaaagtgctgggattacaggcgtgagcctccgccagcctcttcctcttcttataaggccacctatcctgctagattagggccccccacccttatgacctcatttaaccttaattacctcctaaaggccctgtctccaaatactatcacattgtggggggtagggcttcaacatgaatttaggaaggacacaactcagttcacagcagatgaataagcatttgccaggcagctcagttatggacgaggtgttgaaaccgacggaatatagcagatatgaaagcatagaggcctgaaacaatagggtgtgttcagggagctacagctggctcaacattgctgtaatataagttgggagggagaacttctgaaagctgaggctagaacaataggggtggaggtggagcacatgattatgaaggaccttggtatactaagcttagaaggacttcatcttaagggtagaggggagccacaggaacttctaggcagaggcatggcgcagtcagatttgcatttttgataattcaggtggaggagcaatttaagtagcagcgaaagtggaagtagtaagttagttgggaagctaatgcagtagcccttgtgaagcaaagatgcagcaaagacaagagaggcaaagtctggaaaatgttaaggtgatgaaatgtgcaggacttgactagatattttaaatgtgggaggtgagagagccataggagtccaggttgggttggggtcttacttgtccagtttccataaagagacatgttaattacttgacattttacagaattagtatattgactcattgatttccaaaactctttgaataagtatgtaactgttctgtagattgaagttgtgtcactcttaccatgatcacaaactcaggctctgcctatcattttggaactatttggggaagtcgaccatcttttctgggctagttacctttttaaaaggggagggagttgcacttggtgtcatatgcatttctgctctaacattgtttcctgctatttattttccttagtatatttgcttgtacatgctcagtattgtgctgtgttttatagattacagaaataaaactgtgactcttgtctttgacacgctagttttgtggcagaaaccaactcatggtactatactaccactaaaaagaagtaatgtgtatttaagggctaatttgtgtctgctgcctgcagcctatacattggttcattcatttgttttcattcatttgttccgagtctctgtgtttataaagtttacactctagtggaggaacaataattagtaaacatgtagtatatggaatggtgatcagtgtcacagaggccagcaaagtaggagagggtgtgtgctgagggtctggcttactatttaatgtggtgcgatgagagaagcccccttagtagggtgacatttgagcaaaggcccagggagtgagagagggtgagacataaggtctatgcagtgtaggtgtcgggaggaagaatgttgcaggcagagggaacaccaagtgcaaaggccctgagatgggaacatgccccgcttatttgaggaacagtgaggaggccggtgtagcaacagcaatgtgagaaggggaaggtgagttcactgatgggggaagaggaggattattcagggccttggaggccattgtaagggctttgactttccctccaagtgagacagaaagacactggagcgttgcaagtgggggtgtgacatgatttgacctaggctttagaagcatcactctcactgtatgtgcagaatggactataaagaggcaagggcaggagaagtgagactggttaggaggcagttgcagtaatcctggcaggagatgacagcggcttggatcgggggtagcagtggaggaggtgagaagtgctgagatgtagggctatttatgatacacatactgacaggcgttgttgagggacgagatgtggcatgtgaaaggagtcgaggtttctggcctgagtcactggaagaacggaactgccacttatggagatggagaggactattaaaaaacctaagtggaggtgtcaagagaaggtgtcaagaaggtagttggacaaatgagtctggagttagaagagggaaccagcctggagatatgtagatggtatttgaaagccacaagttggtaaatcaaagaccaagagagtatataggaaagaggtctgttggctgagctttagtgcccagggtgggtcaagatgaggaggaaccaacaaaggggactgggaagaggcttctaggggagtgagcagaaaactaggagagggtagcatcctggaaccaagtgaacacactgtttggaggcgttaggagtaatcagtggtgtcctacgatgttgatgcgtgacacctgagaatggaccgtagtgttcaagtgatgcacgagatagaaccagtcataccactaatggtttttttagtcctaaatatttttactgcaagatttcgttgttctaagtgttttcactgtcagatgaaggatgaaagtcgttcagggtaatttccattttagtaatttccgacagcggcagaacagtttctacttacgattggtatgcatttttattattagccatagtattcattttgggtgagtacgtctttgttagcgttatttttcttcaccacctcctcgagttgttcatccattcattcattcacccaaagaaatgcttattaagcgcctgtcctgcgctagtcctaggtttctcttgtcctgataggtctagcttcacacgagcaggattttgcctttccggcggcactaggcttccgcctcaccgcagtggggtttttccagcctaccttgtgcagctgcggttctcagcatccgcgggcggaggcctgcagccggtcagccggtgcgtcccgcccacggcgcggggccttctggcagccaagaaggaaatacagatgaggtgggcggacagtatgcagatgacgggggcgggccgcgcctggcgggcggtgtgcagttgaggtggtccggcaggatgcagatgaagggggcgggccgcgagggcgggcttgatgcagatgagggggcggggcccacgggcgcgggagagcagcggctccgccggcagctgctgggaactggaaggcgcccggtcctttctttgactggagcggacccgccggacgcaaccgcctcgccagccggagccagcgcgagctcggcacggtggacacccggtccgaggccggcaagccggctggtgcccgagtcggccaagcatgggcaaccactcaggacggcccgaggatccggaaccaggtctgtgcggctggcgggggtcgcgccgcagccgcaaccccaccccccctccaggcgcccttcccccaccgcctccggctcgcggcgccgactggggcgagcgaaaggctaaggtcctggggtgtgattcttgtcgttggaatgcgccgcttgggattgtgaaattacctgtgccgacgccgcgaccagaaaacgctgctcgtcctgaacgcgcacctgggcgccggggccgccgggcaggcaccgctgggtccctgccgcggggttccccactccgcgcctggcctgcgcctagaccaggtctcctgagcgcgcaggccgccctcggactttccgggcgtttgcggggagggcgtgccccgcggcctctccctgtcggccgccggccccgcagtttgtggcgcccgcggctctgcccctcacactcacgccagggctgccccgcgactgttcctaacccagaatagtccgtgcttgttctggggtgtcgggcgcgcctctggttatcccgtttttacttcctcagtcctgagtgagcttcgtggagtcagttgggccgtagttttcgtcctctggtagctcatgtcggcccccagcagagttagatgccgataagcagggttgcttttaaaaacaaaacgaaacatttctggactgtcacgtgaagcaaaagggatttagttttgcctgaaaaatggcatcttggctgataggaaagaggtggttgacctgactctggagtccttgtgggggtggggggccggtgacaggtatgtgtttctgtgggagagtcagaactgtaaatattttccaaaggcgtaatatttgaattttaatttgaatgaggactttgaggctctgagaggtgaagcgacttgtccgagtgaccttttccggagctgggtgccgtgctgtaggacgctgggtcgtcctggcctctgcgcattgcttctccttcatctcccagcgccccagccgccccaccttggccctatcctcggggtggggtggaggcgggtgcctccctgacacttggggtacattggactggtaccacagccaggatggaaaacttggacgggctgtccaagtttcttcacaggaatactatgaagaaaaatttcaggggccagcttactgcctagaggtgactttagttacacagcacttgttcagactattttttgggcagaataaccaacaataagcatattcataaaatgaaatatgcataaaataaaaataatatacttgttataaataaccctgttggtaaaggattggttcggtaaaggattggtaacattttaaaaacacttctcattagttacatgcttgtccaggtattgtgaaaacccctgtgtattatttcctttgtgttaaaattgtgaaaagagttactcttgttacagcttttaagactgattggatgcctgtgttccaatttttttagtgaccttactttttaaagcactgtgatggataggacataaaaagaatatgtttatgccagtgacttattttattgtatttttcaaagaatgcatatcatttcagaatgggaactctgatttgctgcaaatgaagataccggatttagggcatttttaagagatggtgtctcactatgttgcccagactggccttgaagtcttgggctccagcacctctcctccgtcagcctcccaagtagctgagactacagacaaatgccaccttgcctggctagaaattcgtggtaaaaactttaaatgctggattactgtctgaaagtgtaattttaactggccttctaatgctgtgatgaaatgctgtagagttcatcactgagatcctggaaattagagctttgttaaagatgcgtgggttttcagtcggctttaccacagggactgggatgaggtcgcatggccccaactggcagttgtggtacattggactagaatctcaacaagtgcttccgagggtcatcagagcaaggggaccaaaaggatataagggggaagcagaaggagaagggaggctggatgagtgatagcagcacacaagcctgagtgtcgcatggttcccgtattgtgtcagttttgtccatggagaacagacatttagaattaagaatgtatccaagacagacaatagggataggaagcagaattagaggagttcgagaccagcctgggcaaggaaagcttttgatcatgatgcagacccaacacctatgaaagggaagcgggaggcagcaggtttgggcagggagagcctcagataatgatgcagacctgaagtcttggccacttgatgggggagctccctagcaaagcccacccattagaggggtctcaggttgggcagaaaggacagtccctagtctttctgtgggtcagtcattggccagaggctactttggaagaacgtgccttcagctcagaagctaacacaagtcttgggatcctcgtggtgccaacagctggaagctgtcagccctctgcagtccttgcagatgaatggcaagttcggttttttttgttctgttttgttttttgagacaaggtctgactgtcacctggggtggagtgcagtgctgtgatcatggctcactgcagccttgaccttccaagctcaggcaatccttccacttcagccacccaagtagctaggacaacaggcccggctgtttcgtttttgttttgtttttttttgtagagatgggattttgtttttgtttttgtttttttttttgagatggaggcttgttctgccacccaggctagagtgcagtggtgtgatcttggctcactgcaacctctgcctcctgggttaaagcgatcctcccgagtagctgagactgcaggtgtgcaccactatgcccgcctaatttttgtatttttagtagaggtgggatttcaccatgttggccaggctggtcttgaactcctgacctcaagtgatctgcctgactcagcctcccacagtgctgggatcacaggtgtgagccaccatgcctggcgtagagatgggatcttgccatgttgcccaggctggtcccaaactcctgggctcaggtgatcctcttgcttcagcctcccaaagtgctgggattacaggtgtaagccactgtacctggttaagttctttcttgaaaaagggatcccagtggaacacctccatggttgactgccacaggacctcagttgcttggacagggagagtctctttaaagagtaaagaggtaaaatccccatctgagacccgctgtaggcgttgagattgcaccatcttttccagatggaagctcctcatcccctctggggtgtttctaaggcagaaggcagcttctcagctgctgctgcttttctagccctggaattggctgtggtggcagcaggattcctctgttgtggtatctgcagtcctccgagttgggacatcatgacttaacatggtattgcagaatggataagataaatagatccagtaaaagatatgaaaatttcatgtctgaaattttcagcctgggcagagaaagttggtgaccacatctcatgcttcctaaaaggtcctagttaacagtccttcagtttccaaccaggttgtcatcacctcattgtcagggctgctgggcatggttgtgcaatttgtgtactgttcaaaggcatctgcttagagagttgagtgggcctggcagggttgtagcaacccagaggaaggggtgccgttttgcaattttgcctttttatattcacacaaaggtgcccaaagtgttaaagaagtcttagaaagtgagtttagaaggttttccctagtcccagtaccagcttattatttgttttaaatttgcatgtatgaaattaaaaagttaatgcaaattacatgaaataaaagctgctcaggtgcactctgtattagttatagttaatgctaactgtggttacagataaattccaaaatagccacttaagacagttaaagttgattgctgcctcatgtcgcatctggtgtgagttgggggccatcagcaggtggttgttagagactcaggctggtggatgctcctcttcagcatatggctcccaaattgccctgaatctgccagcagtcgggagaggagaaggcgtgtggaggaccctgcccgaggttttaggggccaggcctagaagtggtgcacattatttctacttatgttccactggccagactcagtcacagagacccactgacatgccaggggactgcatcaagcagagagcatgcatattggtaaacattagtgtctctttgtagacatgatgaccattctcaaccacatttgcatcagtattttattacaaaaattttaatcagaaaaattaagacttacatagtaaacacccatgtaccaaccacctagattctaaattaatattttgctgtatttgctttatttgtacatctctatattcattcctctacccacccattagtctgtcttattttttgatgcatttcaatgaaatggtagttacctctacaattctacatgatatactatacccttattgtttcttgatttgttagttttcaagcctctctactactaacctgcactatgaaagttgaggaattaagcacattttccctgctatatattctcctcactccccgtttctgcaagtcatacttaaattttccaaatccattgttagtataaaaatgctagtggtagaatacaagtagtggtatacagaagtttactgtaaaagtccttccactttgctatatgaaaatttcattttgagaccagcctggccaacatggtgaaaccccgtctctactaaaaatacaaaaattagtcgagtgcggtggtgggcacctgtaatccgagctacttgggaggctgaggcaggagaatcgcttgagcccgggaggcggaggttgcagtgagctgagatcgcgctactgcattccaacctgggtgacagagtaagagtgtctcaaaaaagaaaaaactttaaaattctaaggtaatctattgttttccacttctatttcttgactcaccagctttaaatagtgtcctaggcttcgtcacaggtaaatgaggatgtagtgcccctaaatgtcttctgccttattctcaagagtccccctcctgcacttattcccagtctgcctctggacctttcacatggctagaacattttcattctgttccataattagtattagtaagtcttctgtgcatcatttataggttaattctaaaaatggaaggcctatcagcatttaaaatatcaggatctcatgtattatttaatggagaaccaggtagtatgtttagatttatagagaagacagtggcatcttacattgcataacgcgtgatctgtgaagacaggaggaaggagtaaggagaatggaaaggagttggtatgaatatgctctttacttttaaaattaatatgcttttatcctgttactcagtttctgtcttttgcagactgtaagagggaatttcttttttcttaaaaacaagaagctagtctgccttttcatactcagttctgtcacttctttttttctttcttttttttttttttgagacagagtctcattctgttgcctaggctggagtgcagtggagtgatctcagctccctgcaacttctgcctcccaggttcaagagattctcctgcctcagcctcttgagtacctgggactacaggtgcgtgccaccatgcctggctaatttttgtatttttagtagagacggggtttcgccatgttggccaggctggtctccaattcctgacctcaggtgatccgcccacctgggcctcccaaattgctgggattacaggcatgagccaccgtgccctgctctcatttctgtcacttctgccctcagacttcgggcaaataattttttatttttttatatatatattttttagacagagtctcgctctgtcgtccaggctggagtgcagtggcacgatctcgcctcactgcaagctccacctcccgggttcacgccattctcctgcctcagcctcccaagtagctgggactacaggcacctgccactgcgcccggctaattttttctattttttagtagacacagggtttcaccgcgttagccaggctggtctccatctcctgacattgtgatccgcccaccttggacccccaaagtgctgggattacagacgtgagccaccgcgcccggcccaggcaaataatttttcctcgagcttcaaattctttatctaggaaagggaagagtaatataacctacattgtaggattgttgtggtgattcataggttaaaacatatgaaggcttaaaatagacacacatagaaagcacctgataagttttagctgttaattcttcttaaccctccaacataatactttggtttggactggttgctttctagtcccatctcattctcaggttagttcattatttcttggatcctttttctcttttttggattctctttgcttttgtaaaagtgaagatgtggctgggtgcagtggctcacgcctgtaatcgcagcactttgggaggccaaggtgggcggatcacccgaagttgggagttcgagaccagcctgaccaacatggagaagccttgtctctactgaaaaatacaaaattagccaggcatggtggcacatgcctgtaatcccagctacttgggaggctgaggcaggagagtcccttgaacctgggaggcggaggttgcggtgagccaagattgcaccattgcactccagcttgggcaacaagagcaaaactccatctcaaaaacaaaaaacaaagtgaagatgcatacatcaaatatcaatggtaatacatagtaaaaaatctaagaaggtcaaatatatgttactgtaataaatgtcagtgggttaagctccccattaaagagcttcccctaattaagacagaaaatcaaatatatatactgcagaaaagcttgtttatacgttactttgatttttaaaattaagtcatttaaagttgtggataataaaaaagtagctcttgaaattttcaagttcaacgtcttgttattccatatgttctatttacaaatgcagtaaaatttaataagcactctttaagagcatctggttaaattgagttctgtttacaaactttgctaataaaattaacattttaatttgtgtttattaatttagtatatttaggttcttgttaaagtctgacaaaaaaatccagtttttaaagtcttataaatttaataattattctaataaacttagtgattcttaagtcctcttatatattccaaaacatttatattctctctctctcttttttttttttttgagacagtttctgtctctgtcacacaggctggagtgcagtggcagggtcagagcttactgcagccttgacctcctgggtgcaggcggtcctctcactgcagcctcccgagtagctacgactacaggagcatgtcaccacccctggctaatttttgtgttttttatagagacggggtcttgctatattgccctggctggtcttgaactcctgggctcaagctatcctcccaccttggcctcccaaagtgctgagattttataggtgtgagccacagtgcccagcctgtattctctctttatatgtgtgtatatgtagatgcaagctttccaatttaaaattacaaattaattactcagttacatattttgaattggaatcgcaaggttgaccctgtaactctttaatagatccaattctcataaacattaaaagtataattctataatgcagatatttcttaatatggaattctattactacttgtctgattcttttgattatttccccacttgttctaaatctttctaggattaaaagatgtttacataagtgttttattccaaataatattgggatttcttcccatgtaatttttttttttttttttttaaagagacaaagtcttgctctgttggccaggctggagtgcagtggtgcgatgctggcccactgcagccttgaccttcctctctgccccagcctcctgaagtagctgggactacaggcagtgccaccatgcccagctaattaaaaaaaattttttttttggtgcagacggggtctcactgtgttgcccaggctagtctccagctcctggcctcaagcggtcctctcacctaagcctcccaaagtgttgacatttgccaccatgcctggccccatataatttttggggttgtcttctcagtttgctgaggttttttttaataaacagagatctctgacagggacaaggttgggattcttaccctacccagacttcagatatcagcttgagcaacttttgctttggttggaacatattctttaacatatttggtttgagcatattcagggatattctgtgcttgttagttttctcaaccttcatctgaggataatgttttgcccttaccctttatatactttgcccgggtatagaattcttgttcaccacctttgtaatctttctgtagcatggacttcaaaacttgaagaaagaggtgtcataatactcatgtgccttagattcaaattacatttaatttgtgtagcttctaatagcctgagacccccattcgaacggccatatcacctgattagagtttacacttctttagcacttaaaatatataaatattttcccatttaactccaaagaactttgacttgatagaatactgcctggtttttttatactttctgtctcttaaagcagtatcttttttaaaaaaattaattttattttaagttaaatttattttaaaaagttaaatttattttaaggatacacgtgcatgacatgcaggtttgttacataagtaaacgtgtgccatggtggtttgctgcacagatcaacccgtcacctaggtattaaagccccacgtgcattagctgtttatcctgatgctgtccctcctactacccccgccctgacaggccccagtgtgtgttgttccccccaccccctgtgccgtttccatgtgttctcattgttaagcttccatttataagcaagaacatgcagtgtttggttttctgttcctgtgttagtttgctgaggataatggcttccagctccatccgtgtccctgcagagggcatgatcttgttcctttttatggctgcattctgttccatggtgtatatgtaccacattttctttatccactctgtcattgatggacatttggattgattccatgtctttgctattgtgaaaaatgctgcagtgaacatacaggtacatgtatctttataacagaatgatttatattcctttgggtatatattcagtaatggaattgctgagtcaaatggcatttctggttctaggtctttgaggaatcgctgcactgtcttccacaatggttgaactaatttgcattcccaccaacagtgtatttctccacagcctcaccagcgtctgttgtttcttgactttttgataatcgtcattctgactggcatgagatggtatgtcattgtggttttgatgtgcatttttctaataatcagtgatgttgaactatttttcatacgtttgttggctgcataaatattttctttagaaaagtacctgttgatgtcctttgcccactttttaatgggttttttttttcttgtaaatttgtttaagttccttgtagattctggatattagacttttgtcagatggatagcttgcaaaaatgttctcccattctgtaggtagcagtatccttcttgacagttaaaacaaaatgtgatttaattgtggatatctttcttggctttgtctatcttacaagataattctactgaaacaatagtatcagttaaaaacacaatacaccacagagtgtcttaaatgagataggaccttttatattgataaaagtacaattcaagaataaaaagtagcagttacaaagtccactcactaaatagcaaaacactggaaataactaaagcaaaacctatttgaaacacatggaaaaactcacaagtaaagtgggagaatttaactgtcttacacaaaccattttttcaaaattatcatggaatggttaatatattgatctattctaaggccaggaagaaaacgtcattactgttgttcaagggaaattttactggtcactctgtgatcgtaatgcaataaaactgtaaataatgaaagttgacattttaaaaacttattctatttggaaattttgagtcaaataggaattgaaaactacaattatagatcatttagaaaaataattatgaaatactaataaagttacaaataataagcaaatttattcctctgaaaacttttattatcaaaaaataaagaatgaaaattaagttctacacaaaggacattcaaaagaaaagaaacaacaaaagaaatctgggataaccggagggagtttttaaaaacggcagacattaatgaagtaagttacgactgtgtctgtttcactcttctctttcctcagtacctagcccagccttgtccctgtcagagatctctgtttattaaaaaaacctcagcaaactgagaagacaaccccaaaaattatatgggaccaggcatggtggcaaatgtcaacactttgggaggctgaggtgagaggaccgcttgaggccaggagttggagactagcctgggcaacacagtgagacaccatctgtacaaaaaaaaatttttttaattagctgggcatggtggcactgcttgtagtcccagctactcaggaggctggggcagaaaaagcctaagagtatgttctttgttaaacaaatgaagtaaagttttagttagactcatcaagaaataggataacacaaataccccaaattagctatatatatgtaatgtgtatatatatattatattatatataatttatattatatatagtgtatgtaatatgttagctacatatatgtgtttatatatatactatatatataatgtatataatcaggaatgttggatattttttaaaaactagaataaaaaatagaaaatcttgatgaaattaggaaaacaaaattaccaaaatcaattcataaagaaatgaaacacttggacagaaaaatattcttggaagatgtcacaaagtgacttaagaaaatagctcccagctgggcgcagtggctcacggcctgtaatcctagcactttgggaggccgagatgggcggatcaccaaagtcaggagttcgagaccagcctgaccatcatggagaaaccctatctctactaaaaacacaaaattagacgggcatagtggtgcatgcctgtaatcccaattactcgggaggctgaggcaggagaatcacttgaacccaggaggtggaggttgcagtgagctgagattgtgccattgcactccagcctgggcaacttgagtgaaactacgtctcaaaaacaaaaagaaaatacctcctcaaataatcctgaatccagatggtgttataggtaaagtttttcatatatgagaaaaatgtaatttctgtgctatttaaagttatgtggtatgtttcccaaagatattggatattacatattacagaggatataataagatatgtacagatgattatttcttaatttaataattaacatatgctagaaaaactataacttgtacatttaatctatgtctgttgcttaggatcaggttaagtcaaagaagaaattagtcaatattaagtttatgcagaaaaatattaaacacataagacagctgaatgcaaatatagccaaaattatgaaggtgatattcaaataatagaaacttgaaaaatattccaaagtacagaaaagatggaaagcattccgatttgttttgataaaagtagtactaatactgttaatactgtttctgataccaaagcttttcaaagatggtatgaacaaagaaagccacagtatattcttactaatgtagatgctctccttaactgacatatcagccacatttaatccaaccatgcatttaaaaaaacattacaccattggctaaaaagtggcttattctaagaatgcaaaaatattattatataaatagaattggaaatatcagtacatttaaagataaaaattaacatcatactgtatgtcagtaatgcatttaataaaatttaacatctacctcataaacatttaattcctgttggaatagtctggatcttttctgaagataaataaaatgctctaaaagcagcacataccatgcttaacaggaaactaaaaacatccccataaaggtcagggacaaaacagtggtgcccatacaagactgtatgacactgttttcaaatatactagccaaaccagtaagattttaaaaaaatggttattaaaaaatgagaaaaaattagcattatttgtagatactagaattctcttgttagaataaccaaggagatcaactgaaaaagcatgagaacttatggcaatttagtaaggtaaccagcttggaaatgagtatataaattcagatatatatgtgtgtgcttgtatgcttgaatgattcagatatgtatgtgtatgcttatatgatgtagatgtatatgtaacagtagttttatgttagtaatcagaaacgatggtatattttattttatttttttgaggcagggtcttgctctgtcatccaggctggagtacagtggtgctatctgggctcactgcaacctgtgccttccaggcccaggcaatccttccacctcagcttcctgagtaactgggactacaggcatgcgctaccacacccagctaatttttgtattttttgtagagacggggtttcactatgttgcccaggctggtcttgaactcctgagctcaagtgagccacccacctcagcctctcaaagtactgagattataggcgtgagccactctggccacaatggtttgttaaaaggtttcattcacactatgaacaaaatgtataaaacctgaggaagaaataagaagtgtgcaaggcctctgtgggagctataaactatctactcaggggcatagatacaaactatctcctcagaggcactggtgttgatgtggtaggtgtcctccattaagtggaggaattatcattatatattatagttctgaaaatcagaaatagctgctgaattttccaaaatgccttttgggcattcacacagatctatttttctttttagatagaatgatttgatggatttaaatatcttcaccttacaataaactgtgtcaggtttttctaaatcttccttttggaatttttttttttttaacatgaaaggtgaattaacagcattaatttttcttggtcccttattgcgttatatataaaataagggtatgtgtgcatggttagttctaaagttcctgataattttaacattctgtgatcttatggttttagacattttttcccaagagacaggggcttgctctgttgttcaggctggtctcgaactcctggcctcaagggatcctcctgccctggcctcccaaaatgctggtgtaacaggcatgagccaccgctcatggccagacttttaaacatttctaactcagagaagtgtttggattttacctcttgaatgtgttgcgccaatttgctttaggtacgggatttctagtttgttgaattctattttacttacaaaaattttttatatggctccaatcagatcaaaccagcctatgtagtatcatagaagtaacattaaaatattgagaattttgaagggttccaggtatcctgaagactttaccgtcacaggacaaaaacacttatagggctgtccttccaccagacccagcctctgctgttccattgcccttgctgccctcctccgtccagtttgtccgctaccttcttgcttagccaggatgtgtgttgtttggcatctgccttcacatggacattgtgctgcagttggttgcttctccagctaagtaagaactgtctgaggatccatgtttatctttgccatctccatggtctccaacactctgcagagtccttagcaaaatgtatggttttaatgaattgatggcagctgtcccttgtatttccaggaaagttttgaattctcaggagaaagtaggtttgatatttcaaaacgaatgtggttggccaaatgttttatattgggattaaagaaattattttagtaccacaaacttccagaaagcttgtccataagagtttttcctcaccccacaccactacaaaagtgacccagaaatcctgagccagtggaactcccaggggggtgcaggtatcactgggaccttgcccaccctactgtctcctttcatccctgtcccagagacctaacatcaccatggtctcctttccctcagtctttcataagtatttgtaaatactcttttaccaatatcattctttctctgttatttttcctttttaactgttgctcttttacttcagaaaaatttttcttttttcttttatgctcccctcatttccaacttcctgttccaaattaagcctaattatggttgagtgttaagattacggtttatgataaacctagaaagataaagtaatacatttttatgtgaaactatatctagtaaagaactggtaccaaccacctccaaagcccttgaaaatcccctttgttttatctgccagagaattcatctctttctctaattggtcctgcttttctctctagcacaagcagccaaattttaaaaaaatcttggaaggttacattataagcagtctaaccttttgatctgtaagcagataaacagagtctattcatagtggtaaaaaactgttatgaaaattatctgtttatagttatattttggcctcttttgctctcccctcagtcgtatgttatagtatgctgaagatacatggaattaatatacttccaaactggaccaaaaatgtcatataacagcctgtatttgcaggttaacaaagtatgagtgagaggggtatgtggctctgagtgctttgtttgcctgtttgtatttgtgtttctgtgttcctcctgcacaacttccctgacagcctgtgctttatgctttcatagggattttgaatcataagggaaagaagaaagattgcaaatcaagagataccagtaatcagatcaatgatgaaattttagtgtaaactatacattaaaatgacttcttctgtaaattttggtatccagaaccttatgctaaccctttcagatagaaaacagggcttgaagtatcacaaacatgcctttttcatttactgtttttttcattacttaggttattcctatttttttttgagacagagtcttgcgttgtcacccaggctggagagcagtggtgcaatcatggctcactgcagcctcgacctcccaggctcaagtgatcctcctgcctcaacctctcgggtagctaggaccacagacgtgtgccacctcacttggctaatttttttaaatttttagtagaggtagggtcttgctgtattgctcaggctggtctcatccctattaatgtgaattctggtaccagctttgactctggagatgctctggggcttcttgatggctgtggtcagcccacaccatggtcatgtgcttgccagcattctggtcattcctctcttatctgctgcctctaatctgttcctgtgtgcctggagactggtagccaaacctgccagaactgtatacagaccagaagtgcttctcctagtagtatgcaggtgtggagtttagggcacagtcattttgagcttctctggagctctcttccttttcccgctgatgacattatctcaggtagctgagtggccatagaactgagtcttagataaagtgtcactgcacaagcatgtggtcaggtgctgttcccctgccctggcacctgtggaaggtgtgtgggcctcctttctgttgctttcttgtaccacaccacaccccttctggcctcagggctcctgcatgggcttctctgtgcctggatgctcctctctcagcgtgttacagctgatcctccatgggttgactgcaaggcccagtttgcacaggatacttccagttaacacctgattgtggatcagtttactcctgttatttttactctcaaaaagtgccccaatttggaagataaaatatactgtctcctacttaaccatttcaggtctcagtccagtgtcacctcttcaggtagacctttccctttctctctcagggggcaagtctcctggtttgctgtgactgcagaataaaccccagggcttggttgggctgagccagggtttgccagcagacaaattcaggcttctttctatgtgagggcccatggcaggccagcgtgggaggacgtgagatgggaggggcagccaggtgctgggagggttgggagagacatggggaggaagagtgaggactgaagccagggggaagaaacatggaagtgtgctgtaagctctgtgcccactagcccttgatgagttttaatctgctttacccctcaaggctgtaagagtcagatctgagtgttttgaaaatgagacggtgtgtgcgattaacttgaagagaactgatacaggagagatctttggtgaggcctgattataagtggatgacaagcttcatttttcctaggtgataggttggactgttagacaaaactttggattcagagaaaaggcactctaggtgcattttgcctcctttctttaccttgatggattttcatgttggtcaaatgaagacttgggctacatctatgaaatcccttccaatttttagaagtatataattctgttgtacgctctagtgagtccagactataaagcattttgaattttactatttcttttcccctaattgtgggccagaaaggaaaatttccaaataaggatgcacagtccactctgggaaacacagggaaacaataactagaatacaagtctagcctttgccctggcatgaaaagaatgcagactgttagctgacctaaaggtttctgttttatttcacgtttaggtgaaatggtcagctttgaccattactcccaaagaagtttctctccagactttaagatatttgtgcaacattaagatggttttattatctgtgagacagctgtggtcacttttatttatcaaagtgccatgtttattgtatatgtatcaggagcagtgctggaaagctaaatttagagaaataaacctgggctcacaaatgattatggtgacattcagtatacccccaatgacactatcactataacattgctaggtcgcctcccagcagtctagccatctcaaccataaaggaatggcgaagtaatgatggcaacttgccttattggagagtgtgtagactgccgttttaaactgtaattgtcaggattagacctcaaccgtggtgaaatgttgggcataaaggtacatgaacaaagctaagtgcaaagttgtgtgaatgctgattcagtctttgtgaaagtacagtccacaggacacaaattggcaaaattcatttgccttacagtgtttaaagttttttgaattataacattttgggcctgagttctccacttgctgcagtttctgccagcccctttgttctttacttggctcttgcaaacatttatttacctatttagctctatagacagttgaagtttttggtgttttttttttttgtttttgtggagacggagttttgcttttgttgcccatgctggagtgcagtggtgtgatctcggctcactgcaatctccacctcccaggttcaagcgatcctcctgctcaacctcccaagtagctgggattacaggcatgtgccaccacatttggctaatttggtatttttagtagagacagggtttcaccacgttggtcaggctggttttgaactcctgacctcaattgatccacctgcctcagcctccaaaagtgctgtttacatgcctaagccactacacctggctggcagttgaagttttgacccctgtttaaaaaaagaaaagactattataatactggaatttaaattacaataaaggtgatttttaaataaaataaattttaaaaattaaattgatatactgtaaatatgcagttaggagataattgatcttcctggttacttcccagggaagcaggactcaagacccagatttgtgtgcagagtttatgggggttgcttctgggaacagtaccaatgagggggtgagggaagccggttgggcagagggagaagctaagatggatgcagctgcgatagctgcctcttcagtcccaggggattgagctggaatgggccttcaccgtgtcccaaatggagaccaggtggtcacatcagtctctcccccccatcagtcttggaggggagtctgcagagaatctgtttctttgccttttccagcagtcttgcccttcatttcctttatacatctcaaacactcaccgagtattttcttctttcaaaagtttattctcggggaggtggctccctggctgaccacaggtcccgccggcattcagcctggctgactcaggaggtcagcgcctagacctgactcattttcttccgctccttgccgacctcaccagggcctgcttcctggcacctcatttgaccaagccctctgccttggtcaaaatgaccaaggcaaaattttggtcaaaattttttgaaatgttagtttcaaaaaaaatcttaacctcctctttgcctgtggtgggtgggcaggccaggtcaggctcaccctgcagtgtggagggtggggtcagaggcccctggacagcctggggccgcctctgtgctccgcagctcagttttggcgggagagccctggccagttgtcaagaaagtgcgcctctgtttctggggtaatgctgtgggcccaggaccttcagcctgcagcccccagaggggatgtagtcatgccaaagctcctgatgccatcatcatcacgttagaacccctcaccaccacctccactcataagtcatttgccctaagccagcacagcacttcgaattcaggcagttgatcatcatctaagcgtgaataccattttattaatttttgcctagaaattggcactccctttaaaatcttttaatgcttttgtttactgcaagttttcttccattactttttcttctgtgtgtgccctctcctggctctctggctttcctgttatacttgtattggatcttttcagtcctctatgtctcttaaatttttaaaacttctattcatttcagtattcttagtcggtcttctcattcattgattggattttctgtagtgttcagtattgctagtgatcattattttgcaagtgacagcaatcttttctgatgtgacattttcccttttaacaaagatgtttttctttaaacatcttactgaaaattggttgactttctgaaggactattactacactggccttgctgggtatgtgggtacccatgactgttctgctcctggagattaagtactgggacttctgtagctcaggtccctagggggcctgggcctctgccgggtgggacagtgggctggatgcacatgtagggtaggctttagtgcagcattcctagtctgtgaacttctcctgtgtcatgccaagggatttgaatccaggtgtgaattcaactactcataaaagagaaccatactgacctatggcacattgagtagagagtattttttaaatgaattaggcctgatttaaactatattcagcccccttggcttatgtaaatgcgcaaatttctgcagattctctgcatagaagtttttttcttcatgctttctggagcgaaaattcttatcctggcttcctttatttactagctgtaggatcgcaggctagtttcttgcttgcttgctacattcccctcctgtgtaaaatggggctgttagtatttccttagggagttctttgaacaaagcccagaagttaataagttctcaatgaatgttaataaatgttaaataaattatcagaaaatgttagtttcaaaaaatcttaaccccttctctttttcttttgtcttctccgcctcgttttcctacttttcagtcattttacttgagggtaggcaacatttcatttctcaccaaatgcagacaggtgcttctccctacttccgtgtccctctccttctcccactacccttcttgccttctctaaggtattatttatgtagtcagggagtgtattggttcctgttgctgctataacaaataactacaaatttagtggattcaaaaacaatgcagaattatttcctggcagttctagaggttagaagtctaaagtcaaggtactggcagggctgtgttccttctggaggcttcaggggaatatcagtttccttgccttcccagcttctagaggccacaagcattcctcagcttgtggccccttcttccctcttcagagtatattgcttcaacctcttgggctgtcatcacatctcctttttccgtccctgattgtcttgcatccctgttgtaaaaccctggtgattatattgagcccagcagagaattcaggataatctctttatctcaatatccttaagcacatctgcaaaatccctttgttgtgtgacatactcacaggttctagggattaggatgtggacatatttgggggattgttattcagtgtgctgcaggaaggtagatgtgtaaaccttttatcatagcatagtgcaggtgggacttgcacagcggtaccctgagccaaaggtgtggacctcagacaaggaagcagttatttctgaggacattgggaaaagtttgatagaagagagatgtttgagctgagtcctaaaggatgaagaggccagggaagtttggaaggcttttaggctgaggaaacaacacttgctaagaaatagacttgtaaaaaaaatccagcaattttgaggaatagtgaaatctttgatgttgctaagacacagggtatattgaggagagtggtaggcaaagaaaattgtaggttaaaactagaatgtgctgtgataatgagcttctaatgtatcctgtaaagagaggggagccagtggagttgttttggtggcttttcaattataaatttttgtctgattgtgtaagtagttttcttcttctagaaaatgaagaaaccaaataaatagatcaagaaaataaaatcattcaaagccctgctactcagagataatgactgttgacatttctgtgtagtgtcattattgagccatttgtgtgtctgtttacccagttgaaacctcactgtatattaaatttcatatcttgaattctttagttaacggcatatcaacatttcttcatgtaattaaatactctcaactatccttaacatctccataatatcctattgtatatattaccataatttatttaatccttcattgttagattcaatatttttgtattttattttatttattattattttttgagacagagtctttctctgtcgcccaggctggagtgcagtggcgcgatctcggctcactgcaacctccgccttctgggtttaagcaattcttctgcctcagcctcccgagtagctgggcccacaggcatgtgccaccacgcccggctaatttttgtatttttactagagacggggtttcaccatgttggccagaatggtcttgaactcctgacctcgtgatccgcctgcctcggcctcccaaagtgctgggattaacaggcatgagccacctcacccagccatattttattttatttatttatttttgaggcagggtctgtcttgccctgtcacccaggctggggtgcagtggtacgatcactgctcactgcagccttgacttctcaggctcaagcaatcctcccacctcagcctccctagtagctgggactgcaggcatgagccaccactcccgactcctctctattttaaataatactaacacatagatctgtgtttaagtttttgaatgtttcctcagggcaggagtgcttctcctctgtttattctcttgagacgtgagatcaggtagaaatgttcccgtgtctaggtggaggagaccccagtgtgccctttcatttactcctgggctctagagtggaaacttctgtgtttttctctgtgtgatgatttgtgtgggtgccaagggccaaacccacatttagcaaagaaatagtgtgatccacttaaaagggggtttaataacttgagatggagatatcaagctgaacattcacaacaagcataactaaatcagagaggcagaagaaagcattaaccagaaaaataagtactaacttttaaagagtgattactcctgatttaaaacttttactagatgaaatacaaagggtaacagactgtgttgagaactgaattaattttctggaaggagtgtcttgtaaaacaaagatattgtgaggtgaaaaatgtaagatgcttaagggatctatgtaggagacctaataattgaatgataggattcttagaaggggacaaagtaacagatggaaaatacatcgtattataaaagaagaaacccatctgagctgaataaaatgttagacttcagattgaaaggactcatggaattcttttttaaaagacaattgctggactgcagcaataaagatagaaatcctgtcaacttctaggcaggaagataggtctgttttgagggaaattgggatgccataggaattcttacccacttcacaaagaagctagaatagagtctgtatggattattgactctaaggaactaatataaatcttctgtattcagacatatcagcctgggtttttacttgcatgccacagaagctgattttggttggctaataaatttttaaagatgttgagttgctgtgaaattgttagaagggctagagagagatgtctgcaggcactgcagccagggacagcgcatcaaatcttacacagaattggcccaggccggatgctgctgctgtgttcctgggcgtagacagtgtagcttgcaccagatgctgcaggcactaaagtctacagtgagtgccttggccactgctttctgggatcttgatcttgctgcagctaccattcttgcagtgagcattttccatcatagtccttgctttgcagcattagttcctgaatcaaagtctgggacaggtgtaaataatggcagggtcaagggggcctcctagctgcaagggggcactgagaaggcaggcagctggcatttttagcttatttaatgggaggtagaccctacctttaactgagactaataaggtgggaaagtccccaggcttaggaaagaagggttcaaaagctaggtagtcagaaagaatgtcagagatcaagtactcttgcccagatataattcagcgaaccagggcaaaagaagaatatttttagccatgagggattcatccatctcatttgaacaaatattcagatgtccaattggatgctggtaattggctcagaatagaaatatgaagatagaagaaaatgaataatataagtaacagtagagagcagtgaatgttgcagcaggaaacattgcatacataaatggaagatattaacacggctgaagattcagaatgtaagtgtaaagtaagaattcttggaaggatcgtactgccttggaacatctaggaaatagcgtggaactaaaaattctagaccatctcagcaaaatcctgaactaggattgcaggcattcagatataaaattcctctaaaaatttcatctttgttggtgtgggactggggggcatggttatttagtttggatgaaggtttaattaagagtgttagaaatggcaggtaactactaaccaagtagtaaaacatagtattcccaaaataacagggatcaaggatgatagtgagcacagaggtaagcaggccaggaaggaataaagagaagtaatatcaaattagcaaaagcgaggagaggaaaaagatgaaatgagttaacaaatagtaaacaaaatcaagtggaaacagtaaagccaaatgagcagccccacagtaaatactcatcagctaaactcacctattaaaaaacaaaggtccagaatattagtgtcagagcaagatgcaagaacaaaagcattgaacaggactaagaggtactatatattggtagaaaccaaaaatataaagtataactgcctttaagcagcaaaatgcatagaacaaacaccaggaacaaaagaatttggtaagaaacatattctactaagagatgctaattatgtgtcttttctaatttgacgggtcagctaagctaaattgccaacttggatgctcacaggggccggtgggtggcatgaatatgtgaattatatggtgagagaccagggatggtgggaattgcacagcgaactggataatgcatgtcttgcctaaaggcattgaaattcatacattttaaagcactttgccagccaaacaaaatatatttgtagcttgcttgcagcctgccagttttcaacctttgaaacaaaaaagcaaaagtatagaggttagaaacaacatatgcaacaaatgtattgcatatgttgcaaacatatttattgcgaaaatgtacagggaatgtacattttcccctaggtctagggagtatttacagaagttgatcatgtcatttatcacagaaaacaaaaagtgaaatatgaaaattttgatttttgtatgcaataacctgtcctgtcagtccagtgaaattagtggtaaaaaaaaagagatgattataacaacaacaacaaaaactaccttggagttaagagccactgttgtaaaataatctctgcaccaaaagaaaatctagacaaattataaatcatctagaaataaaagaaatagaagccttttgatatcaaaatttgtagaatagaactgaatctatagtcaggaaaaagtataatcttagatgcttttattagtataagaaaagaaagactgaaaatataagagcgaaatattcaacttatgaaactagaaaaaagtacaaaataaagagaaaggtaaaagctgaaatgaatgaaatagaaaataaaatggtagagaagataaataagaacaacactagttctttgaaaaggcaaataatggaaattattcttgattaaaggaaaaaggaaaaagtattagcaaagaagaatccattgttataggtatggaataaatgaaaaattaaatctgcagcaatatttgtgaaactctggaggaagtgggcaatttcccctcaaaatataaattcacaaattgttttctagaaaaaatataaaacctgaagtattattgctagtatttaacattgttttggtattgatgcaataaggcaaaaacattttttgttttaaatactgaaaaagaggaaaataaacttgacctaagaataagagaatttgtgattatatataagataaatataaaaacaaaataccttttttctatgccatcaataactggttagcattggaacgtgaaaaaaaaattcaattcacaaataccataaaatatctaggagtaatttaaactagaaaattataggacataaagtgaataaatattaaatcttactgtggttcataaaacaagacctgagataatggagaaactgcagtatgttccagggtgggtagatataatgttataaaattgtccttcccaagtagcctgcttaagagactaattctccccagaatttttcattaggaaaaaaggaagctccttacatttaagtcttagaaagtgtctttttaaacttggcatgttcttaataactttatttttgaataacgaagtaatacttcagacaaacctcaattttttctttttctttctttttcttttttttttggagacagggcctcactccactttcccaggctggagtgcagtggcatgaacttggttcactggagcctcatcctccagggcccaggtgattctctcacctcagcctcccaagtagctagaactacagttgcacaccaccatgtcccgctaaactttttgtatttttagtagagacaaggttttgccgtgttgctcaggctagcagcaaactcttggactcaagtaatccgccttcattggcctcccaaagtgctaggattacaggcatgacccaccacgcccaacctcttcaatttattttaaattgagttttatagaggccaccggacagaatcggtttaaaaaaagatagacaattttgttttatttagtacttattccattgggtatgatctcatagttacaagtattgttgaattgaggctttgaaagactatataacaatgcaataattggttaggttgtagagatcacaaatgtatacctacaggaagaatgtttttaaaaaaactgacctaatgtcatataagtacgtatttgtgacttagtataacattttcaatgacagcgtaatactatcattggattcagaaagtactgagtctcaagtagcttagaggatagaggaaaggggtgaagaaagagagaaccaaggtgatgcatgatacctgcactgcctgttaaagagagcttccagaaaatgcttcatccgcttggccagaacctagccatctggccacacccagctgcaaaagacgttggaagtgttctggaaccaccaagtgcccaacaaaaagttgagttaatgaggaagaaaagagaacaaataatggggtacaactagcctctacttggacataggtagtactctgggggaaaacattataaaatatgctgaaatattagtacgcttgtaaacaaataaaagtaaatgccaaaagaggtggcggtagaggtcagtaggtatagggtgatgagcaatcaagtggcaaaaaagaaaaacaaaggtgttcaacatcagtagtaatcagagaaatgcacatcaaaagaaatcacttttcgaccttcaaaaataataacttccagtggtggtaagtgtacagagaaacaattactcctatatgtctacccctgtggtgtgtgaatgattgcaatcttttttataaagcaatccggcaataattttgagattgaaaatatgtttctcttgaggaatccaggaattctgtcttgtagacataaaagcacaagtacatacttaacgttgcaaatgtaggaaaagtttgctaattgcagtactttttttgttctggcccgaatctaggaatactgaatgtccctcagtaggaattggttaaataaattatagtacagtcatcctcagtatccttgggagattcattccagaatctcctatggatactaacatccacagataactcaagtccctgatataaaatgctataaaatggcatagtatttgcatttaaactacgcacattctcccatatagtttaaatgatgtccagattacttatactacctaatacaatgtaaatgccgtgtcatttgttgttatactgtattgtttagggaataatgacaagaaaaacatgtctatatacattcagatgtacccatccctttttcccccaaatatgttctatctgtggttggtagaattctgggtggggaacccagaaatatggaaggccgactatatcattcttatgaaattttattaaataagaatgatgtcaaccgggcgtggtggctcacgcttataatcctagtactttgggaggccgaggcaggcggattgtctgagctcaggagttcgagaccagcctgggcaacacggcaaaaccccatctctacttaaaaaaaaaaaaagacaaaaaattagccaggtgtggtggcacgtgcctatcgtcccagctactcgggaggctgaggcatgagaatcgcttgaacccgggaaatggaggttgcagtgagctgagattgtgccactgcactccggcctgggtgacagagcaagactcctgtctcaaaaaaaaaaaaaaaaaaaaaagatgtagaggtaagaaatattattaaaaaggacaagtgagagctatttcctgaagctatgaccaggatgtattatcaggtgacaaatataactcacaagagagtgtttacacctttatgtcatagtgcctatgctgtgatcccaaacgaaaggctaagcatgtttgtgtcaacacagagagaatgtattcttggaagaatacattctttccaggctgttcataatgattatcccaggcaagtaggggattttgattattttgctcttagaaacagcatgtattgtttttatatgtgagggcttaggggagtttagtgattaaaagtatgaactttggagcccgcatttcctgagtttgaattccagctgaagctgtgtgatcttgggcaagttatctctactgtgcctcagtttcctccttggtaaaatatttgtagaaacaggacctactgtatatagtttcaaacaagtcagtatatgtaaagtatttggtaccgtagaagttctacatgagagttctatataagagagggccggctttattatttttaaacattttaagtattattattaaagtaagtcaagggtagaggaaaggtcattgtattctttccgtggtaaagtgctgaacatattttcatcagtcctagagcttgattttgaagaacatggtgatgcagcaaaatatttcttaattatgcctttgcctcgttttcagtggagtgaagaaacaggatcagctggcctgagaaagtgcgaagcacagagttttgtatttaacagcgagtgggctttatagctgtcttcactgtgtttttggaattggctgattgtccacagaattcacactggttcgatgtctaaacacttcagtgatgcaaaaatcagtttgggaaatagagacacttgaatgaatgggttttgagataaaaatctgtcttgtcatcctcctgaggtggagcagattgcattttccagctgaggctgtgactctcccttgtcccacatgccctcctacagtgtgactctgccacttcctctgttaagggatctacttcttgaatttgggcagccctagaaccgcttcagctggtagaagagggtggaagtgctcctctgactgctgaggctaaattataaaaggctgtgcaggcccctcttgtttgcgggggcacttgtgcttggagccgtgagccgttctgtaataagtccaaccactgtgaggctaccatgctggggagactaccacatggtgctccagcccacagtccgtggagctgtcatctcagccagggtttcggatggcaggagccacctcctagtgtctatgtaagaatggcctagccaagctcttcccaaattcctgaccggcaaaatgatcagaaaataaaacggttgtgttaagtgatgaggttatggggaaatttgctctgaaacagtggtggcaggaatgtaagggttagtaaacagcagcgactctgtgatgaaggaattcattcattcatgttggaaagacctttgcagagccaacctccactactccttgcacccagattgatggtcccatgaaccagaagcatttgtctagtgataatcacaggagtcttcaagtgtggtgtcctgttttgtatttttatttatttattttttttgaggcagagtctctctgtgttgcccaggctggagtgcaatggcacgatcttggctcactgcaacctctgcctcccaggttcaagctattcttctgcctcagcctcctgagtagctaggactacaggcgtgtgccaccacacccagctaattttggtatttttagtagaggcggggtttcaccatgttggtcaggctggtctcgaactcctgacctcaggtgatccaccctcctcggcctcccaaagtgctgggattgcaggcatgagccactgcacccagcttgtgttttgtattttttatttcacgttgcattttaactacagacacatcttggtgatgttgtgaattcagtttcagaccaccacaataaaatgaattacatgaggtttttggtttcctggtgcatacaaaaattatgtttacactatattgtagtctgttaagtgtgcaatagcattacatcttaaaaaaagcaatgtacatgccttaatttaaaaaatattgctaaaaaatgctaacgaagtaagcccattctgttggagaaatgacactgatagacttgctcgatgcagggttgccacaagccttcaatttgtaagaaatgtattatctgcaaagcacaaaaaagcaaagctcaataaagcaagtgcttgtattgtgtctcatgtatactaaaagtatgccaaatggtttacgtgatttttgtatgtatgtatctgcttatgagacagggtctcactcccatcgctcaggctgaagtgcagtggtacaatcacagcttactgcagccttgacttcccaggctcaggtgatcctcccacctcagcctctcctgagtagctagagctgcaggcagacaccaccacacctgggttttttttgtattttcagtagagatgggtgtctcactatgttgcccaggctggtttcaaactcctgggctcaagcagtgctcctgccttggcttcccaaagtgctgggattatagatcataggtgtgagccactgagcctggccaatttttgtttttaattgttgcctgatgtcccctgctgggtcctgaagtcttttgggttggtttgttttcaactggcacactacaccagttctatgtgctgtattaattatacaggtttgagtatcccttatctgaaatgcttgggaccagatgtgttttgaactttggattttttttttgtattttggaatacttgcattatacttagcaattgagcatccctaatctggaaatctgaaatactccaatgagtgtttccttttatggtcatgtcagcactcagaatgtttagggttttgtatttttttctgaattagggatgctcaacccgtaccagtatactacaccagggaactgactcggcattggtcagaccacattttgaacactttttggttgacttcccagcatttaaccccgtcttctcccaggaattctctttagctaattcccactttaaagtgagtcagcatatcaccctggtctcagtgagtcaaggatggcagagactcaatcagaatgagtgttgagtagatgttttttggggtgcctgggagagagtccccgctctttgctggatttgatggtgtgcagatgtgagccctggagctgccagtaccatcacatagccatgagggcaggcagcttattgatgaaggtgacctgtggaggaagggaggagcagaagatggagagaaattgaccctgagagaacatctttcagttgagccagacctgaagttggacttgatcctagactttcagttatgggagtcaaaacctctttttattgttgtaagcttgagttgggttttctcttgcaaccaagagatttttaactcacagaaacccacatctgcagtgtttctgagattctgggtaatatttcagagggaccttggtaaatcagaagctctctaggcagtttatccaatgaatggaccccgggacctatgaggcctggtgggaagaattaggaatgttttgagtgaagatttagaagaccaatggggaaacaaagctgcctgcagacattcagatgtcacgtggaagaggcaataaatttgttctttgtggttccagagtgtttcagaactggaatcggtgtgtgccatgttaatgaagatatagaattcagcctcatataaggaaggattgtccaactatttgagctgctcaacagtggaaggggctgtctagtggtgggtttccttttactgaaaatattcaatggtaactggaacatgagactttagtagatggcaacagaagttggatgctattgatgccactttgaatgaaaaattaggttatatgatttctgtttcttccagttctgaaataacgtgattttgtatttccttaggtatcaaaagacatccttttttttttttctttttttgggacagagtctcactttgtcacccaggctggagtgcagtggtgtgatctcggctcactgcagcctctgcctcctggattcaagtgattctcctgtctaagcctccggagtggctgggatacaggtgcgcaccaccacgcctggctaatttttgtatttttagtagagacggggtttcaccatgttggctaggctgatctcgaattcctgacctcaggtgatattcctgacctcaggtgatctgcctgccttggcctcccaaagtgctgagattacaggcgtgagccaccgtgcccggcttgtattagaagatatacttatgatgtgaccgttgggcaaattatgaagtctctcagactttgtttctttatctgtaaaataacaataataatacttttatgaactgagttttgtgtgcctcaagttaatgtatgtgaaagtgcttacaaaaccaaagtgctacacaaaggtaaagtgctgttatccttcctacatagtaaactccgattcaaaggatacggacgattccttaaatttctttgtgtgttttgacccatgggtgctttgaaaaaacaactcccacccccaaagtgatattaatagaaataaacaggattttgcgtgcccagtccatctaattatctaatttctccagttacaaattcaggtgaatttattatgttttcctggtagaacttggaagtttctcagtgatctctgtgaggtataactgaggtacacctgagccataactgtaggaagtcagggcctgattatgatctagactagactaggtggttctcacttgcatcgagcctccgtaacctggaggttagcttttcccatctgtcctgaaagtaaggctgcacgtgaatatggcagatcttttagttcactaaagcctgcaccctcagctcctccttattctcagtgtttggtgcctggagactgtgggctttattttcccacagtgctgctgggagatttctgttcagaggtgccaagctctctagttaggcaatgaggatttcatttggcctacacaatgggcaaggaagctaaggcgcagtatgcagagagaattctgggacgaagcgctcctccagccacttcagtttcaatggaaatttgatgtccctgcctgctttgcacttttcaaatggcctgtcaggagttgccctcccagagctgcttggcattctggcttctcctggagatgactaatggcagctggttgtgtgggccgcctgctagaagctagtcagaccataccattatctctcctcagaaacactgaggctttgtctgctgccctatctcccctgcatcctgacacagagcggtcactgtgtcctctccaggcctgagccccttcttagtgttagggggcttttgttcagaagctttattgtccccctctttctggagtgctgttcatagtggccgtggtacagcatgagtatttgggaaacaggaggagtagatttacaagcattttgaattctaatccaatttgctgagcaagtggagtgtgaggaaaattaattttgcattcttcccaaaaaaagtaaaatggagatgagatagaaaatgtttatccctttacaaaaatcatctttacacattgacactgctgtttgcttttaacaaaggaagtaaaatgggtgagtaatttggttcatttgcatgagtgtaggactcttttgtgtttttttccctccatttgatttgcaaagacaatttctattgacttttagtacaagttaggtatgaatctctagaaagcacaccactgagacgacccaaaagacagtccagctgtggaaaaaactacttttctgtcatagtcaaggtggggccccaagatttgataacagacttagttccttatggctgtgcatctgcttgctgaattgcctcaaacttctgttatctcatttgttctaagtccaaaggatcagtgctgcctataaagctgacggattgctaattgcctgtttccacactgtactcataaacattcatatttctttttcctaattttcattatcaaagtagtatatacaggggttaaaataatgaaccaggacaaggagcttattatgaaaagcaagactgctgctgccctgctgccctaccccttcccatttcttgtccctcttctcaaaggtaaacactttattatgcttttactgccttctaaaaaaataaacactcttttttaaagagcagttttaggcacagcaaaattgagtgaaaagtacaagttttcctatagtgtactcctgttcccaaacacactcagcctcctcattatcaacatcttccaatcagtgaacccacaccgatgtaacattgctcagagtccgtggtttacattgaggttcactcttggcattgtgcattctgtaggtttggataaatgtataatgccatgtatccaagttttttgtagagacagggccttgctgtcttgcccaggctggtctggaactcctggcctcaagcaattctcccaccttgcctccctcccttgggggtgggggatgaatgggcaggcacagtagctcacctgtgcctggctctacttattcattcctccctccccccaacccctggcaaccattgatctttttgctttagcaagcaaaaggaccatagttttacaaaactacggtctctgtagttttgtcttttgcagaatgtcatagttggaatcatactgtgtgtagctttttcagactgcttctttaacttagtaaatgcttcagttaaggttcctccatgtcttttcatggcttaatagttatttcattttaaggggtggatgatactaatagtccattatctgggtgtaccacagttggttgcttccaagttttggcagttatgagtaaagctgctgtaaagatccatgtgcaggtttttgtgtggacatatgtttttgactcatttggctaaataccaaggagtgctattgctggatcatagagaacaagtatgtttacttttctaggaaaccaccaaactgtcttccaacgtggctgaattattttgcgttcctaccagcaatgagtcccggttgctccacatcctcaccagtatttggtgttcttattgttttggattgtagccattctaatagttgtgtagtgatatctcacttttgtgttaatttgaaattgcctacggatgtatgatgtggagcagctttttttttttttttttttaattatactttaagttctggggtacatgtgcagaatgtgcaggtttgttacataggtatgcacataccatgatggtttgttgcacccatcatcaacctgtcatctacattaggtatttctcctaatgctatcccttccctagcccccccacccactgacaagccctggtgtgtgatgttcccctccctgtgtccatgtgttctcattgttcagctcctacttatgagaaagaacatgcgatgtttggttttctgtatataccccttaatgggattgctgggtcaaatggtatttctagttctagatccatgaggaattgccacactgtctgatgtagagcagcttttcatagctcattttccatctgtatttcttcttcggtgagttgtctattcaggtgtttttccatttttagtcaggtgtttcgttttccatttttttctttattgagacagtgtctcactctgttgtgcaggctggagtgcagtggtgcaattatgacttactgcagccttcacctcctgggctcaagtgatccttcttcttcagtctcctgagtagctgggactacaagtgtaagccaccatgcccagctaatttttgatttttttgatgagacgagtctcactatgcagggagaccccttgagacaggggtctcaaggctgcccagactggtcttgaacccctggacacaggtgatcctcccgccctggcctcccaaagtgtgctgtgctgggattacaggtgtgagccattacaccgagccctcattatcttactgttgagttttgagcattctttgtatattttggataacagtcctttatcggatatgtcttttgcacatattttctcccagcctgtggcttgtgttctcattcttttgatgttgctatttttttccccaattttgttgattcctcttatgatagatgaggatttaacacatggccctgcaaccctctcctagtgtcataatatcactgtttttagtttctttcttggttattgcttttagtaatgtatttcatctttatttcttgtcttgtcaactgtatatagtatctttgacaccctgtttgtaaggtgagggtggatattattgctgccatcctttttgcccactctctctgctttctcttctacctcccagtttctttcatctgtactttacctttttcactagcaaggatgacagtattcatatgttctagaaaatagtcttgcatgttctgtgtgtagtatggatattattgtgactacatatatattgtgccctgcagagtgaagttatgtgctgtgattttgttatctgtcttatacagcttatttttatgaagtttcttgttttgtgactatttttgttacaggaaagggggcccgatccagaccttaagagaggattcttggatctcgcacaagaatgaattcagggcaagtccacagtgcaaagtgaaagcaagtttagtaagaaagtaaaggaataaaagaatggctactccatagagcagccctgagggctgctggttgcccatttttatggttattttttaatgatatgctaaacaaggggtggattattcatgcctcccctttttagaccatatagggtaatttcctgaagttgctatgacatttgtaaactgtcatggcgctggcaggagtgtagtagtgaggacgaccagaggtcactcttgtggccatcttggttttggtaggatttagccagcttctttactgcagcctgttatatcagcaaggtctttatgacctgtatcttgtgccaacctgttatctcatcctgtgacttagaatgccttaactgggaatacagcccagtaggtttcagcctcattttacccagctcctattcaagatggagttgttctggttcacatgcctctgacatttcccccctcccttttataagagaacgcttaatcctaagggttgcggagggatgaagattcatcttctataactccttcaggctgaatagaggtgatgatattcctgcctgactattagggtctcttacattcagagtagagaggagcagagtcagaaagcatcagtatggtaaggtccattcataactcttgagtttcgacagagggtggtatctggaagatgaataagagtttaagaaaacattcagtaagcttgtcctgtattcctacacaaaaagtataacagcaatatattccacaagagtaaagcaaaataagtaaagttattccaagtaaactaaattagaagactttccatgaactgggcaactgttggaattaagctgatatagggttgttagctgattgtaatgtgcccagaattagaatactaatccagatttttacattatccatccctcttgtttcttctgagcagcagtcagagatcactggtaggttcacaggaataagcaggtgtagactaaattgcagaaacaaactgaaaaacagatgagactagaatttaataacaggtgtaccatagttcttgaaacatatttctctctccagttttccatttttacgaaagacaaattatggtaagactgatttgttttattatacttggcctgataatttgtataaagtgcagcaagaataattatttttcacataggctttttaattgactttaatggaactctgttttgtaagggatctcagataagactttttaaaagctgagccccatcatgggtttgtaccctcaaatacctatgagttgggtaaattcctttctttttgaggtcccaggataacttggggctcttcgacctgtgagaaagtgacattctttacttaccccaagtcagaaaccttgaacagggactgttgtagacaaggtgtgaggccagttccacacaggcttttattggctctataaatcaagtttaattccttaaaggaaaacacaccattccagtcaaaaccttggtaacataaccaatttctccaattgtgttctgttagaaaagagaacgaatttttttttttttttttttttttgagacagagtcttgctctgtcaccaggctggagtgcagtgacatgatcttggctcactgcaacctctgcctcccaggttcaagcgattcccctgcctcagccccctgagtagctgggactacaggtggcgccaccacgcctagctacttttttgtattttagtagagatggggtttcaccatgttggctaggatggtctcgatctcctgaccacgagacccacccgcctcggcctcccaaagtgctgggattacaggtgtgagccaccatgcccagccaagaaaacagattcttattgcacctttgcaaataactattttgctgtaagttaagaatactcacaactagttgccaaattctggagaaatcaggtagagagaaacaaatatgctcagaattttgtgcataggagtatataaactgttaagagctataatataaatagctcaaaaggaaagtttccttgactctgaaaaacaaaggatcagtagtgttttatgcaaagtttgaaatattacttccgttttttattggttcagtgaatttaggtaactcctgttttgcttgatattcatgaacatttcatctctccatgagagtcctgaaagtttttcctctattctgttgttacgctctccaaagttacaagaaaacatgcattgaagaacacctgttagagttctataattgattataaaccaccttctaaaggagattaaaacaagacagtcatctctggatgataaaaagctttaggacagccactattaaagccacatttgataaggaaattttgttacttctgtgatacacagaattttacataacaattataattattaataacacactaaataatattagaattataggagtttcccataactttagaatataccaataacacatttatgtaaatatagtccaaagaaagcaaaacaccatttcacattcgattatgcttcctgtatgatttttatatcaaataagccaaatgtcactgttgtattagtgcattatagatataaaacccaatttttttttttttttgagacggagtcttgctctgtcacccagtctggagtgtagtgacgctatcttggctcactgcaacctctgcctcccgggttcaaacagttctcctgcctcaacatcctgagtagctgagactacaggcaccagccaccacacccggctaatttttagtatttttagtagagatagagttttgccaattcttaataaaaccttataaataaataaatctttccaatcttaatcagtttgaccataaggtaagattctcataaactttttataaccctttacaagtttttgttaaagagcaggtcataagcaggtttttgctctaagaaaccaattttaatttatagaaaagctgaataatacccctttaatttagccaatgtccacacactggctattttaatttgctctaagaaaccaattttaatttatagaaaaactgaataatacccctttaatttagccaatgtccacacacagaatctcttttacaattaattttttacaaaccttccacaactgttcaaacctttagctttattctaacttaaagcaattctttaaccctttaggcaaaaaacccatattcccatgccttcttataatcttttaccaaaaatatattctactttccttacacaccttacaggtaaaactatttcttcaatagtctcaattacatgttacaatgttaacttttagcaacttttatttttggtgaaaaccctggttagtaagcaattttaattgtgtattaggtgtggagcctagccttaggacacgccaggcagaagtgcagataagggctgactctccagcatagctagggggcatggctaactccacatgtccccaggccttaccttacttaagcaggcaagttatacagtaagagtcatagtggcattttatgacgcatttaggaggcctaacaacctttgaattgtgcaacatttcttgcataaattttctttcaaaaatcctttcacgacttacacagaccatctgagacattcttggactttctgacttgccctaaacatccctccttttaaacaaccattttattttaggagaagaatttaccataccaagatcttttcttatataaaatctttctttataatcatctttgtatagctagggggcatggccaattccacatgtccccaggccttatctagaatctaatggctttaaggcaggtaaattgaacaatttttaaaagttaaacagtttatgaccttaaagcatttaacaaacttaatatctgacctgcataatttagactgaatgtttttattttatcagtaatttttaaagctgtttgtatttcccgaagattactaagattacatgaactaaaaggcattacagtttttgttttgctttcaaaatatttgatttaagcacttatttttgtttcagccaattagacttcttttatataaacattacacataatatgtatatagctacccagaaagaagaatattactacagtagttgtaagatttttcatttgccagtttttaagtttcttaattggattactggctttaaggtggagccgttggaagaacagggccaggaaagggggtccctggtgcctcctgtttttcccaaggagttcaggctgttagagcttgaatatctgcttttaattaaactgattttaaccatagcactctttaacaaagtctttttagaattttttatgccaaacagccaatatttctggcttttgaactttacctaaggtaacctccaaggtgcttagagaaaggaaaatttaagacagtccatggaggagaagagaatagacaaggtcacacagatattaaaccagaaacgacttcctagggaaggaatcaaacccgaactgctactgtgaaagtgcaaaaccctggcttctgagctacagcacgggacagtctctgtttcctttcctagaaggaatttagagtagttaattttgagcttgcaaaggcttttaactaatatgatttttagatctaactatgacatgaaccctaaaattcctgttccctggaaggcagagaccaaaagtactgccacatggttacaaggtcaagctcccaaggacataaacaaggtggagacttcatccacttttttgtttgtttcagggatctgtagccaagtttgttactgaccagctagcttgctggcttatcttgaaaagtgggcctgcaggtattctaagcccgtgttttatcctaaagcaccccttgacacggaaaaagaaattcatagcacaaaatacaccagcttaagactagccttagaatttttttttgcattaatcaaaacattacagaggagataaatactgatttttccccccattcattcaactgtttgcatagagagtgagaagctagaaatctgactggcaagaaattcttaccctttggccagcatgccaggcttctgggttccctttccctgagtggcactagtgatctggcttgcagcaccattgccctgggggccaagcctcatcataaaggaaaattacttttttttgttctggccagagcaaaatacatgtgataagacatagacattagccactctgcttaacacccaatatcaaactggtgaggcttaaatttgcccccaaatgggccccgtcatctttaatccagcctcagacttacgtggcctctgggcaaggtggttgccctgagtaacagaaaagataggaaaggaaaagtagagagagaaaagcattgcctgtagcagggtggggaaagcgaaatgatcagggaggtcagagaaagacccacccattgcagtgacattgaaaagttcaggtggctgctcctcagtagcaaagggatcttttccagccatcccatcagctcttaagtttccccttttagggaagaaaaagttccccatgtcccatagtcctgtacatacctgactctgtcacccacagccattagcaaagagtgcaaggcagattaatccaaagagaatagcagttaacatcccatagtgccaaacctgttcttacccaagaaggcctttactgagacgggcctctaaccccctaaatcttagaagggactctatccctcataagttggacctctaacccttgccttttattaagaggggcactttgtcctcttgaatcagagactaatttttcagacttgtttcatggatatcattttgagacttctcttgactggtttcctgtaatagagccactgctttctcttcctctttggtttcctcccttgtttttctggaacacatcctcaaataacttccttagaaagggtattaacagtttaattttctcagtttttgcatgctttaaaatgtattctacctctgtgattgatttatagttcatctgggtagagaaatctaggttgaaagtcattttccctccgaactttgaaggcttttgctttgttgccttctaggctacatatgtggtaatggaattgcaggatcttatggtagcttttttttttttttttttttttttgaaacagagtcttactctgttgcccaggctggagtgcagtagtctgatttcagctcactgcacccttcgtctcctgggttcaagcaattctcctgcctcagcctcccaagtagctggagttacaggcatgtgctgtggcgcccagctaatttttgtatttttagtagagacagggttttgccatgttggccaggctggtcttgaactcctgacctcaggtgatccacctgcctcggcctcccaaagtgctggaattacaggcgtgagccaccgtgctggtttttttttttttttttttttttttttttaaatagagacagggtctttctctggtcacccaggctggagtacagtggtgtaatctcagctcactgcagcctcaaactcctgggctcaagtgatcctcctacctcatccttccaagtggctgggaccacaggtgcatgcccccattcccaggctaatgtttaaatatttttgtgtagagatagggtctcactctgttgcccaggctgttcttgaactcctagtctctagtgatcctactgccttggccttattttaaactttttgaggaaactccatactgttctccataatggttgtactgattgacattctcaccaacagtgtacaggggttcctttttctccatatcctcaccaatacttgttatcttgtgtcttattttattttattttttgagacagagtctcgctctgttgcccaggctggcgtgcagtggcgtgatcttggctcactgcaacctccgcctcccggctttaagtgattctcttgcctcagcctcctgagtagctgggactacaggcgtttgtggcaccaccgcccggctaatttttgcatttttagtagagatggggtttcaccacgttggccaggatggtctcgatctcctgaccttgtgatccacccgccttgacctcccaaatgtagtacccattctaacagaagtgatatctcattgtggttttaatttgcatttccctgatgattagtgcatttttttcatatacagtttggctaactcctgttttctaatttattgcacagatgtaatcataaaagagaaacagtaacattactcacagaccaaccagcttaatactcagctgttctcaatatcatgtgttctgttatagtttgtgaatgcttattttatatgaattctatgaatgcttagtttgatgtactcgtgattgaccacagtataatttttcattggcatttaaaaaatgtcacacttcaaacatgtttcttctttatgattgtgttaatcttcataattatgagatggagcttgcttttatgttaacttcttggaatcagccagcctcaggaggatggtacacataagtgatgacggggtgggagcagcacaaaagatccaatggtgctggctgagccaatccctgttccactggcccttctctccactgtcccttatgtggtgctgtgtaaggaagcatggccagtctcaggacttcagagtgctttggttagcagtgaggtctgactcccactgcttcaaggaggtgtcgtaagctgtagggctgttgctctttacttttccctgtcagtacccacgaggaggtgtgtttgggctggaggcctgggctcacatggtgggtgcacaaccaagaccatcatcattggtctgatgatgaatttttagcaactctgaacctaacctgtgctctgtaacagtttctgaaatgaggtgtacagagatgggaagaatcttttggaaaacagagacagacatagtaaaaaaaaaaaaaaaggaaaaagaatagatataacaaaaatatggctggattgtacatttcataatacacatccattcataaatatactttagtttcatggttttttaaaaattcctagtagtatagataaggcagaagtaacacttatggggagaacagactgcaatttggcagcaaaaggaaggtgttaaactgtagctggaaataacagcagacttgatctgttctatattaatttttccagcttcaaaaccaacaaacaattgaaggtttaaaaaaaagaaagtggctgggcacggtggctcacgcctgtcatcctagcacttgggaggccaaggcggggagatcacctgaggtcaggagatcgagaccagcctggccaacatggtgaaaccccatctctactaaaaaaaaaaaaacaaaaaaacgaaatacagtaaattagccgagcatggtggctcgcgcctgtagttccagctattcgggatgctgaggcaggagaatcacttaaactttggaggcagaggttgcagtgagctgaggtcgcacattgcattccagcctgggcaacaagagcaaaactccatctcaaaaaaataaaaaaagaaagaaaaagtcagccttaatttagtgatgttattaagaataacaaatgccagtgtgatgatcagtcctggactctcaggtttgcctgttctgactagagttatggtgaaactttagttatcttccagtttttaatacggtccttgctgcaatgactttattctagagaactagcattactaaaacattttagtgcttagtggtttttaatacttatttcacaagaataattaaataagtcttttcctcgttgagtgtgtagtatgatgcaggttaggtatctgtgacacctataagtaaggctgacccatgaacaacactagcttgaactgtgtgggtccatttatatggagacttaaaaaaaataaatacattggaaaattatttggagagttgcaacagtttgaaaaaaattcagatgaactgggtagtctagaaatatgaaaacaattgagaaaaagttacatatgtcatgaatgcataaaatacatgtagatactaataatcagttttatcatttactaccataaaatatacacaaatctattataaaaagttaaaatttgtctaaacttatgcacacacagactgtacatggtgctattcatagttgagagaaatgtaaacaaatataaagatgcagtattataactgcatacaattaactgtagtacatacagtactcctgtaacaattctatagccacttcctgatgttgttgcagtgcgctcaagcattgggggtagctgcttggaaggtactgtgatgctaatcatctctgtgggagcagttcctctctccagtacacctcagatcgcagtaaaaagtgacctcttgagattcttgagtatgttttgttgtgtttagtgcagtaccacaaaccttgaataacactatgggacccatacaaagtgccactagtgatgctggcagtgctccctagaagccaataaaacccctgacagcattgaattgcttgctagattgaggaatggttgcctgtcgcttcagacagatgattcattttgcaaacagaccatgtaaacttatggtattgataaatacagtatggtactgcaaatgtatttcctcttccttatggttttctgaataacattttcttttttctatctcattttatcttaagaatacagtatataatacatataacacaaagtgtgtgttaactgtttatgttttcagtcaggcttccggtcaacaataggctattagtagttaagtttctggggagccaaaagttatacacagagttttgactgcatgaaaggttggcacccctaacctccaagttgttcaggggtcaactatattaaaagtctatgatatactcttggctttccagaaacttaatttgaagaagttaatttaaaaaccatagttttctatatattaatttgacagttcagcctttattaggtcaaagtttcaaaagagctcagctgttagatgtttagtaatgaatgccatcagcctttatgtcatcaggattcaggatgtttaggtgtgtgtttgctcagggctcagaaatagtcttggtggtgggtttacagctgcccatcttgttaggtgtggaacctgccttagcgctggggctgctgccagtctatgggaacattccctcccgtgcccttcctacactgtagaggcctacaggttgatgaccacttctgggacccttcattacacctctcactgaaagcatgtagagttgtgtaagtgacagcagccagccttgactcatcaaatagtctttcagtttgtaaaaaaaaaaaaaaaaaagtccaggattttattttacactgtaacatctgaggtgggtttcaattctagagcacaatggagactgatgtctgggtttcacccctagaattgtttttacattgtctgtgatatagtacagatgaaaataaaagagaattatttacaccttacatttgctgttacaagtattctgtattatgtctatatcatgtcaagtaacataggtatgttcttatttcatttattcttgtttctccatgtacacaaatgagtacatcatttccacttacggcaaaagtgatatgtcattgtatcagatccatctctcagtattatctgtatcttctgatttcttaatcaaatttatgctgtcaaaatatgttaatgatgttttttaaagtgtttattgagaaattcacaaagaacttgtattttgtcaaaaggccattgtttttgttgccaacattatcagtgcagatgtactaaattgcaagttacagaaaacccagctcaaggtgacttataggaagggtatttactggcttgcctaactgaaaggccagctataggccaaacttcagggttgatttgatttagcaacttaacaatgctattgagagtttagtttccttcttccttctctgccatctgcattcccaccttcctcttgaaagggcagggtggttgccagccattcccacacctacacattttctcactctggtcccgtggtgtttaatagcttgcccagaaaaccttccctttgtcacattgatcttaattgagttgtgtgcccatgcgtgaaccagcaactggctggggatggggtcatcctgagtagctcaggcttggagtcagcctcacccaaagtatagggctgtggggaggaagcacagaaaccacagtcagaactgggtaattagctagaggaggaggaaatggatgaagagcgacagccactgtccactgtgccatgtgatttacagtcatttgggttttgtttataagaatgcttgctttattttttcatttttttcttcttctgtctttaaggggcctttacaacaactaaacggacaggcattccagccccacgggaattttcagtaactgtctcaagagagaggtctgtgccacgtggtccctccaaccccaggaaatcagtgtccagtccaacttcttccaacactcccactcctacgaaacacctgaggaccccttccacaaagcccaagcaagagaatgaaggtggagaaaaggctgcgcttgagtcccaagttcgggaacttttggcagaagccaaagcaaaagatagtgaaattaacaggcttcgaagtgaactaaagaaatacaaagagaaaaggactctgaacgctgaggggactgatgctttgggcccaaatgtcgatggaacatcagtctccccaggtgacacggaacctatgataagagctcttgaggagaagaacaagaactttcagaaagagctttccgatctagaggaagaaaaccgggtcctgaaggagaaactgatctatcttgagcactccccaaattcagaaggggcagcaagtcacactggcgacagcagctgcccaacatccataactcaagagtcaagcttcggaagcccaactggaaatcagatgtccagtgacattgatgagtataaaaaaaacatacatggaaatgcattacggacatcaggctcctcaagtagcgatgttaccaaagcttctttgtcgccagatgcttccgactttgagcacattacagcagagacaccctcaaggcccctgtcctccaccagtaacccctttaagagttcaaagtgttctactgctgggagttccccaaacagcgtaagtgaattgtccctggcttccctcacagagaagatacaaaagatggaagaaaaccaccatagcactgcagaagaactacaggctactctacaagaattatcagaccagcaacaaatggtacaggaattgacagctgaaaatgagaagctggtggatgaaaagacgattttagagacatcctttcatcagcatcgagagagggcagagcagctaagtcaagaaaatgagaagctgatgaatcttttacaagagcgagtaaagaatgaagagcccaccactcaggaaggaaaaattattgaactggagcagaagtgcacaggtattcttgaacagggccgctttgaaagagagaagctactcaacattcagcagcagttgacctgtagcttgcggaaggttgaggaagaaaaccaaggagctttagaaatgattaaacgtctgaaggaagaaaatgaaaaactgaatgagtttctagaactggaacggcataataataacatgatggccaaaactttggaagagtgtagagttaccttggaagggctaaaaatggagaatggatctttgaagtctcatttgcagggtgagaagcagaaagccacagaggccagtgctgtggagcagacggcagagagctgcgaagttcaagaaatgttgaaagtagcccgagcagagaaagatctactggaactgtcttgcaatgagctcagacaagaattactaaaggcaaacggtgaaattaaacatgtttccagtctgctggccaaggtgagaagagacagctctttactggtatttgctcatccttgttcacatttctgcccttaacctctaaattcacagagcacagagaagcatttgcttagtctgtttcattcacgaagccagcattccagcttgaaggcctgttagattgcacacaggttgggattgggggatacaaaaaggaaacacccaaatttctgattatgggcggttcaaaatgtggggatgtagagtcaaatcagagtatgatgcagtgataaaagaatatcatacagcctatgcccaggctctagtctagtgcaaaggaggggcatctggtgtaacgtgggggttgggcgtagcacagaaggacttcctggaagaaatagcaactgagctgagttctgaagattgagtgggagtttgccagtctgtcagcatgcttttagctgccagtaacagaaaatgaaatcactcccaattttcaactaaaatattaccactattttggtgttttcttccagatatatgtgtgtgtatgtgtatcatacaagttacacaaatttataatcatcctgtacatgttattaactttttttgcatttgacattttagaaatattaaaacttttctcagcatattcctatcattaaatattcatttaaacattattttaaaggccagatactattttaatataaatatttcatatttaccctgttgttgaacatacatgtattgtcaaacatttgtggtctttccagtctttcaatattataaatacttttttatatctatcttactgtttatttaggaaaaattcctagacgatgacttaccgagtcaaagagtataaacattttaaagactttcaacacattcagccagattgcccttcagaaatattatgccagtttattcatcctagcggtcatgagatcatgagctttcctgagcctttgccagcacttggtattacattgttatatcatttaaatctgttaatcatttcatttttttaaccttttttgcttgggaagatcttccatagcccaagagcaaataacttttctcaacactttaatcagcctgtaattttgtttttgatgcaagaattgtggtgattttatgatattctgcccacctcccagagcagtgctggagaggtgcagagagatggcctcctatttcttgttccctccaagttctgggtctgatttagggatctactggcaagagagattcaaaacatcttcctaccttagtttaggggttgtcattgtttcaaggagcaaattatgccatgagctctcagggagatttttctccactgcttcgtctgtcttaagatgagtctgttgcagcctgattctgcaatttggccatctgatgagcttagtggtgggtcatgttaaggagtttctctctttgtctgtattctaaatttgtaggtattttattgaaagtacggaagtaattccattagaggttactagtcaggcttggcattgggttttaatatcttgtggagtaagattattctttttttactttaagattactcactactctctggcaaaatgttttatctcccatgtgcaccttcttgaagttctttatcagtccctctgtgtttttggtagtttggcattacattaaatgtgcatatcagtgagaaataatttgacatcttaaaaatagcttatttttttctgatcataaaatatttttattacagacgatttaaaaagtacagaaaagtataaaaaagaaaagtattacctttaatttcaccacttggagaaaaactgctaaccttttgctgtatgtcctttcaggccttttctcagtttatacatgtttgagcatgcataaaaacttgcattgatatgattatgatattttgtcttcctatccagaagagtagagtatgtctgtccacattccattacaaagaatcagttggattagtttatctattccactattaatctgtttctgattaacttgtttctacttttatctttattaatttttttgtcttattttttgtacattttggtttcttgactaaaattctttgttcatttaacttttttttatccttggttgataatgaaagcatttaaagttatagctttggtaaatagaggcaataaaatctggaatcttctggaataaactaaatgtaatttaaaggaaagtgtgcattttctgtagagtgcaaggcacaacatatatgtttaaaatcaaactgttattattcatgtatcctacatcttactgcatgctaactagaagtatcaaatactgatagtaagaagggaaaggtcctagctagtatttttaggtgagagtttgaggtaaagatgggggcatgctatcacatagggtttcttgtatatctatcaagaccctaggtttgtgattttgtgctgtcttatgtgcacagagactgatttgtaattgcagtggacttgtaacatactaatcttcctacccttttacattactgtagaaaaagcaaaacatagacctcctaaatggactaatactgattgtatctctaccacagactatcaagtaatctgccaacaaccatgaatttaaatgataatacttaagagactcatgtccaaaggataacaggagaagttttagcacaaaactatgatgaagggtctaacatgctggactgggtcctcttgacttacccagtgagcaatgatgtgaccttgggcaggcccctttacattgtgcaatgtcgaatagaagcgtgacggtggatggatcctggtctcgtatctaattccaagggaagcatttaacatttaattatgatgtatgttttttgtaggcatttggtacataccttttattatgttatgcaagtatttgctaagaggtgttttgtttggtggtttatttttagagacaggttctcgttttgtcacttaggctggagtgtagtggcgattatagctcactgcagccttgaactcctgggctcaagcaatcctcccacctcagcctttctgggtagctgggactgcagccaggcaccaccatgcctgactacttggcttgtttttaaaggatgaggattgaattttttctacagctaatgacgtgatctgatagtttttatgtaatcaagtttttttctcctctaacttgttagtgaggcaagttataacaacagattttctaaggtgctctagtgtaaaatcatgcttgcattcctggggtaaatcctaattcttcagttttcagtggtttcacttgactttttgctgagaacttccaaatatagctgccttcagcaggtatcggagtaactgtcctgttgagcaccaagcaacaacgtgtaccccatgagcagtgcattcatccactctaatgcttggcgaaaggtgaatattattaaaaaggatacaataagctatttacaaaaggggaaagtggtgccaaaccatcctatgatctaatagattccgtaaatctatgtaagtttcaagttaagattactcaagcaacccagataccgtcaaaagaacctataaaaagccttgaaaagtacttttttaaaaataggaggtaggtgtcttcctcaaacaataaatggaaaattggtaggatttctacactatcttgtaggctttttttcttctcatttctttttcttcattggtttgctgatttctttatttttttcaacttctctgatataccccatatgcatcttgatggccgcttaatctgtagtcacatgacatacttctgtacaactttgaggacgggtctgatttccacagaacccaaagccaccactcctatccttgccctagctagcaagcagcatggagttgtatgggattgttgtttttccagacaataacatgacccagctttaatttacttttttaccttttcagttgtttgggatcttggtttcaagttagaatatcttttctgggcttgaaacctagaagttttaaaagaaaattatctatttattcccgtgaggttgaagcttataggtggtatccttagaatcttagttctttctgcagaaacttcagtccgcttccagaagagtaaggagattataaataaccccttggcatgaatggtttgcgggagtcagcagaggtgaaatgactagtgttctgcttgtgtgggtcctagagccaaactgatttagagtggccagtggtcagagatggcagaaccagaatttgagggaaatatgtggcaaatagatgatcctgtagctgtgacattggaataggatgccttaaaggacttaagagatctggaaacctggtttaaacagtcaggtgggttggaagtgtatccaggtgatgtattgatatatgagaaactgccctcctgtcagcggcttgagccaggggacactccctccaccccggccccaagggtgggagattggctgtggctgcccatgatgcaggcccaggctgtggctggcagtgctgtggttctggacctcctgccaggggtacaggacagctcagcattgccaagcatcttggtccacctgttggcgacttggggcaggcatgtcacctggacatctgggtcctatggggagagggtttcccagagctttacctttacatctgattggtgagaactgcgtcacacagtgcccccaggccacctctcttgaaatcacagttgcagcctgattcttgaacaaaattgggattctgttaggaagaaacaaggtgggggtggcttttggtgggggatgggcacttgccccaccaggcctccactccctcaccttttcccacaaagtactcacagtgatctgatcatgtagcgccttccggtgctgcctggggcaccacatggcttcgcccagtgcccagctcccaccacacctccacttgcagtcccaccccacatccagccatattcccacccctccctccatgccaggcctggccgggccagtgactgtctggcagtcatgtttgctcagggggttttctcggcctgaagagaccccaccccattgaccattacctggtccctcctgaagctttccgcctcagttatggggtcttcagcgaggcattcagctctgcggggccctgtcccatggaacttcagactcatctcagtaaatgacattattgtcactcagccaaggtcactcatgggaatggcctgacccaccctggccctcagaggattcagatgtgcaggcaaaactctttggggccctgcagggaagctgagggaacctgctgcctgagtagccactggctgctgctggagaggtgggaaggttactgagctgaaaacatggagatttcagtcatcttcagctcacacataaggcatcccactggcaccaaatatcaactctggtgagcagaggcctgtggcttcatgctgggaaggaggcctgtcagcagctcctgtcaacagggcctgttttccagctcccctgggcaagccatgaggatgtggaagtcgaggaggcctgtggaggctgttggggagagccccacagctgttgcaccagtaagcctctgctcaaggggctgtggcctggggaaaattgccacaggcctcagcctggctgtgcagagccagtttagcattaggagcggaatcttctagagattaaactacaaagccagaatgcctgtgcagccttttattttgtgggatgtgataggcatgtggcccggaactcatggcatgtctgccaggtcctctcccgacacccccaggtctctgttcttgaagccccttgaaaaggggcagaagtttggtggagacagtcagatagtttgaggaagggtggtcttgccagttgggcagatccacagaacctgtggctccgaccccttgctcttacctgtgactccacagggggctgcttcccaatcctgcctgaccctgcttccctgcgatggacttgttttctcctggacacgttaatgccttttgtgaggtgaggcctaagcagtctcttcctttcacatgacctcaggactcatctgcgaacctggtgttgcccagcacttctctctccagtccgagttcttgggaagtacctgcgtggggccttgttgcttcgaaaggtccctaccagggtacagccactgcttctgaagcttgcctctgagttcctaaaggtgaaatacagatgtttaccctcatctttgagttttctaacagcctttctccactatacctgaagtgtaaataaactaacatttcctcctctcccttggtggagcagcattggccaaaataataataattcaactttaggccaataagaatgaactatggatgattatcagcagtgtctattcacaacagggctaagaaccgagcagagggagttttgcagtacccaagctagatgccagaacagaaacaccccactttcttactcattgaattagcccgttttcatgctgctgataaagacatacctgagactggaaagaaaaaaaggattaatgaacttaacagttccacttggctggggatgcctcacaatcatggtggaaggtgaaaggcacatctcacatggtggcagacaaaataagagagcttgtgcagggaaactcccccttatataatcatcagatctcgtgagacttatactgtcaggagaacagcacaggaaagacctgcctccctgattcaattacctcccactggggtccctcccacaacatgtgggaatacaagatgagatttaggtggggaggcagccagtctgtatcactcatggtaaatttactcaagctgtcattccaagtttatttccttttaaactatatgtaattttagcattgcaattccttccatctattaggtgttcagtaaatacttttcagacgaatgaatgaatgtcagagaaacttgcagcagaattgaggggctgctataattatattaatatgtttaaaaagtaaagtttattatattttaataacagcaactaatattttgggctatttgtatgtgctaagcagtctcagagcttttccatcatttaatcttatttatcttaattttatgctgttgattctgttgtctagtattttttcatttgagcaaacagaatgatttaagttattagtctaatggattgatgaaatgaagccagcattcaaagttgggtctgaccttagagctcttattcttttttttcttttctttttttttgagacatggtcttgctctgttgcccaggctggagtacagtggtgcgatcatagctctctgcagtctcaaattcctgggctccagtgatcctcccacctcagcttcccaagtagctggaattacaggtgtgcaacactatgcccaattttttatttttattttcatagagacaggatcttgctctgttgacaaggctgatctcaaacttatgatgatcctcccacacctcagtgcctcccaaagtgctgggattgcaggggtgagccaacgtacccagagctcttattataatcactgatttagactgctgcccagttacctgaaagcaaagaagagacagaaaaacacttaaagcagacctaagactaatagttgtcactgtcatcttaaggccaaagccctttgaagaaaaccacctttgaaagccttgttgaactaggagagttttacctgattgtaatacaatggagaaattcacagtgaaaacctgagtcatcaagaaatgttattttgtttgacctctacctgagtcttgaggggagagggggtgagttgacccctgagtgtatggggtggggactctgggaatgctgccagaagagaacagcaggtcctaaggccagaaagcctggccaccaaggaagtgatgcaggtagtttgtccttgttggagtgaacagggtggtcagtggaagtggcctggtggagacaccagccaagcagttaggattttatcctcaagacagtgggagtctctgaagaatttttttttttaaatagcagcttttattgagatatgatccatttaaatcacgtaagtctgtgggttttagtgtattcacacaattgtgcaaccatcactacaatcaattttagaacatttttatcaccccgtaaaaaaatcttaacccacagcagtcaccctccaagaccgcctccctcccagcccctggcaaccacaaatctatgttttggctctgtggacttgggtcttctggatgttttatacacatggaacccacgccctgcggcctcaagcagccctcccactttagcctcccagagtgctgaagagttctttctattctttggatacaaatcctttaccagataaatgatttgcaaatatttcctctcattctgtgggttatcttttcattgtcttgataatgccctttatggcacaaaattgtttaatttttatttttatgaagtcgaatttagttatttttctttggtggtttgtgcttttggtcggaggaattttaagagttatggaatcacatttactgttgagaaagatgacttgggccacagttaggtgagaaagaatgaaggacagaacagggagtgagttgggtgggaagatgagggctggaaagacattcattttatttacttatttatttttgagacggagtcttgctctgttatccaggctgagtgcagtggtgcatctcttcacgcactgcagcctccacctcctgggttcaagcgattctcctgcctcagcctcctgagtagctgggattacaggcacctgccaccacgcccagctaactttcctatttttagtagagacggggtttcaccatgttggccaggctggtctcaaacccctgaccttaagtgatccacccacctcaacctcccaaagtgctgggattacaggcgtgagccactgcacccggcctggaaagacatttagatgttagatgtgtagaagggaggctcagtagggtcaggtgactgatttgatgtcagggacgggcaggaggaaggcatttcagcctattcatagatctccagcttgtaggattgaatgtgcggttgtgctgcttcctgggagaggaaacacagaatgtggggcaggcttgagaagggagcgttatctgctggagctaacaaggatacccaggcctgcaagcccaggctgctgtcagcaactgccgatgcagccacagaggagatccgggagcctctgcccttccaggccaagagtcctccaaggccggggcctcgtgcctgaggtctctctttgcccctccagtacctttagaagctgtagaaatatgtctagacaggatgttccatgaatgcatttcacatatgctgaggtttgtgaggagcctccacagtgtcagaggaggttgcgactctgaagatgagcaggtgcgattctgaattcttgaccattctctgccctggtagatgatctctttttaagcactcgagaaaacttgattgaatggactatataatcactatataataaacagattaagtcaaaagccaagtaaaatgacagacttacacaagaggcagttatggggggtttatgagtcaggtatctttcttctccacttgttctgttttctaataaaactgtctgtacaactttaatgttactggaatttactcagaacttattatagtgatctcattctgtccatgtctctatagtaccatgtttttggcatgtaactatttgaatgaaagattaaatgatttctcatagccagggcataattcttcaagatactgtctttgctataaaaatttacaaaaaataactaacactgaaatgtttgagccgcattttgtctcacagaatgcttttacttgaatgtactgttttctttgttctttatatattgataatgttgggtaatctataaacctaattccttattctctttagtctacagtctctattcttatggctgctttgtgtaggagaagagcttggttcttagatatctctagcttgatttcctttctgcttttgttcatcacactaaagaaagctatatagatgccctgacagagatcttttttcagtattgtcaaattatctggtatcaaaaaacagaaacccttaagtaacttcacagcttctcacaagggcttgctgcataataacaggcagatatttttatattcactttacagattaacatatgaagagagggagaaattaaatcacttgaaaagaacaatccagcatgtatcaagtggctgagaccaaaccctacccttggtcaaaccatcacaaacagttgtttacccctccgagagaggagaatctagatgtgtgtgttgccaccagcataggagtgctcttaatatctgcagtcggggagagcatcccccccacccccaagcacttcctctttgcaggagcactcatctggagatgcccgaggcccattgcctttccttagggtgctggttaatgtctaatctaattctttgatccaagcttgtgaagtgacagtgattcttttggggagaggatggcaagtagcatgactcagcctccaggcttaactttatcttccgagtaaggagtttgggggtcctgagactttattttcctttacatgtgtctgacaagcatggtgtgggggtggggtgggtggaggaggtgacccttgataggattctagaggggtctgacttcagagctgcctgcttatcctctgggccctgcgtaggaacctctgctgccatatgccttgggcacctgatggaaaggagtggctttctctgtcctctctgcaggaacccttcttgggaagtttgtttgactctatttatagtgcaattccactggctccatatctacagaaagttgatctttgaaattgagagatgcatgagagtgattccttttttcaagggaaacgttgaaaatcacattgctgggtgtctaagagtgtgattcttgacctagagaagttaaactctaaggagctggccagtcagacatgttgggtggtctccctgtagttccagcttcagagggctgaggcaggaggatcacttgagccccggagttcagcctaagcaacatagcgagaccccatgtcttaaaaaaaagaaaaaaaaatctcaagggaaatgcaaaggagctggccagcagagagaccagcaatgtgaatagggcctggatcccctgcagtcgtggaagggtaggctttggtctcagccacttgatacatgctggattactcttttcaagtgatttaatttctccctctcttcatatgttattctgtaaaatgaatataaaaatatctgcctgttattatgtagcaagcccttgtgagaagttgtgaaatgacttaagggtttcagtttttttattgtgtgtgtgtgtgtgtgttttttttttcttgtaaatagctttctggaatatattgttaaacttgagatagttattccaacatccaagaaggatgtagtgatgtgtgcatgtgaaacaactgctgatttgcaggtcccctcccccatgccgagttacctagcttgtaacttggcgcagagcctttgagggacagcagcctcacctgcaagcagaggctttgctcagggtgctcgacctctaggctgcctcgttacatcctcagtttaattcctggcccacagttgtcccagccaaaccacatgcatgtttctagactccaggtgacaggcccttagcctgaggactctacaacatgcagccaggtagttatgcagaaggccacagtctgccccaggatgcaagactcaaaagccaccttctattgctgcttttcaaatgatttcagacatcagccttccaggatctaaaatgcattacttcttttctccttaaattcatcttctggccaggcacagcagctcatgcctgtaatcccagcacttgggaggccaagatgggaggatcacttaagcccgggagcctgggcaacatagcaagaccccacctataaaaaaaaaatgaactgggcattgtgatgcacacctatagtcctggctctgagggaggccgaagtggggagaatggcttgagccaggagatagaggctgcaatgacccgtgatcgtgccactgtgctccagcctgggcaacagagcaagaccttgtcccttgactccaaaaaaactaaaaaatagtaaagtcagcttctgtttaataaagtagctattgctaagtatatattggtctttcatgtattgtgatttttcttggtcaaactgacctgtattatattactacctagtgttgtatatataatacatagggcaattgtgagagaaagaatgactttcattgacttttactgttacatgttccaggcactatgataaactctccaagtcattatttcacttaactgcccaccccccaaccctgcattgttagattatgaaacagaggcagagggattaaggaatacaaggcttgattcactagaattggggtttaaaccctggcggtctggctccagaatatatgtccttagtcatcttgatgcatttaagcagctttcaagcttcagagcacaacctgcaatgatctattttgtattacaatccagagtctcacgcctttataattaaaacacaagcttcacagagcagtgctgacccctgagcacaggcagggctctctggctgtttcccaggctgtttctctctctcttctcctgtcctttccctccgtcccttcctcccccctcccttattctttttttctaatttttaattgttatgggtacatagtaggtatatatatttatggggtacctgagatattttgacacaggtatgcaatgctgtagtcaccctgttgtgctgtcaaataataggttttattaactatattgtatccattaaccatccctgtttccacccctgccccaccacccttcccagcctctggtaatcattctactctctatcttcatgagttcaattgttttaatttttaactcccacaaatgagtgagaatatatgaatttatctttctatgtctggcttatttcacttaacataatgatttccagttccatccatgttgttgcaaatagcaggatctcattcttttttatggctgaatactctgttgtgtatatggactatattttctttatccatttgtctgttgatggatacttaggttgattccaagtcttggctattgtaaatagtgctgcaataaacttggtgagtgcagatatctctttgatagactaatttcctttcttttgggtgtatacccagcagtgtgattgctggatcatatggtagttctatttttagtttttttgagggacttctgtactgttttccatagtggctgtactaatttactttcccgccaacagtgtacaagggtctgcttttctctgcatcttccccagcatttgtcattcatgacttttgaataaaagtcatgacttttggataaaagccattttaattggggtgagatggtatctcattgtagttttgacttgcatttgcatttctctgatgatcagtgacattcagtatgttttcatgtttctgtttgccatttgtatgtctttaaagaatgtctagtaagatcttttgcccactgtttaatcagactactagatttttttcccccattgaattgtttaagctccttatatattctggttattaattccttatcggatgggtagtttgcaagtattttctcccattctgtgggctgtctcttcactttgttgattgtttcctttgctgtgcagaagctttttaacttgatgtgatctcataggttcatttttgttttggtattctgtgcttttgggctattactcaagaaatcattgcccagatcaatgtcctggagagtttccccaatgttgttggttttttagtagttttcatagtttgaggtcttagatgtaagtctttaatccttttgatatgatttttgtatatggggggggtgtctagtttcattcttctgctcatggatatccagttttcctagcaccatttactgaagagactgtcttttcctcaatatatgttcttggcacctttgtcgaaaatgagttcatgtagatgtatggatttattcctggattctctattctatttcattattctatgtgtctgtttttatgccagtaccatgctgtttgggttactatggctctgtagtataatttgaagtcagataatgtgattcttccagttttgttctttttgctcaggatggctttggctattctgggtcttttgtggttccatatgacttttaggatttaaaaaaaattataaagaatgtcattggtattttgatagggattgctttgactgtttagattgctttgggtagtgtggacattttaacatattgacttatccagtctctacacatagagtgtctttatttttgtgtgtgtgttttcttccatttctggtgtcaatattttatagttttcattgtagagatctttcacttctttgattaagtttattcctactttattctactcacagctactataaatgggattactttcttgattcctttttcagattgttcactgttggcatataaaaatgctactgatttttgcatgttgattttgtatcctgcaacttcactgaatttatcagttcttaatagttttttttttttttttttttgtggaggctagttttttccagatatcaagtcatatcatctgcaaaccaggataatttgacttcttcctttccaatttggatgccctttatttctttcccttgtctgattgctttagctgggacttccagtactgtgtgtgaataacagtggtgacagtgggcatccttatcctgttccagatcttagaggaaaagctttcagtttttctccattcatatgatactaggtgtgggtctgttgtatatggcttttattatgttgagatatgttccttctgtacccagtttattgacagtttttatcatgaagggatgttgcattttctcaaatgttttttcagcatcagttgaaatgaccatatggtttttacctttcatttggttgataccacattgcatatgtcaaaccacctttgcatccctaggataaatcccacttggtcatgatgaataatcttttaaatattttgttgaatttggtttgctaggattttgttgaggatttttgcatcaatgttcaccagggatattggcctatagttttctttttttcatgtatctttctttgtctggttttgttatcaggataatactgctttcagaattggtttggaaacattcccttctcttctatttcttggaatagtttgaataggattggtatttttctttaaatgtttggtaaatttcagcagtgaaaccattgggtcctgggcatttctttgctgggggactttttattctggcttttatctcgttacttgttaccggtctgttcaggttttggatttcttcatgattcaatcttgttaggttgtatgtgtctaggaatttatccatttcttctaggttttccaatttattggcatatagttgctcatagtagtctctaatgatcctttgaatttcggtagtattggttgcaatatctccttttttatctttgattttatttaattgggtcttctctttttcatagtctggccaaagttttgtcaattttgtttatcttttcaaaaaccaactttttgtttgttgatcttttgtatttttttcattaaaatttcatttatttctgctttgatctttattgtttcttctcattttgggtttcatttgctcttgcttttctggttatttaagatgcattgtttgtttatttgaagtttttctctgtttttgatgtaggcgctgattgctgtaagatttcctcttagtactgcttttgctgtatctcataagctttggtatgttgtgtttccattttcatttgttttaagacattttaattttttcttcttaattccttcattgacccactggtcattcaggagtgtattacttaatttccatgtattcgtataatttccaaagttcctctttgtgatttctagttttattccatggtggtcagagaagatacctgatatgatttcagtttttttttttttttttaagttttaggagttacagggccaggcgtggtggttcaagcctgtaatcccagcgctttgggaggccgaggcgggcacatcacctgaggtcaggagtttgagaccagcctggccaacatggagaaaccctgtctctactaaaaatacaaaattagctgggtgtggtggcatgcacctgtagtcccagctacttgggagactgagacaggaaaattgcttgaacccaggaggcggaggttgcaagtgaagcgagatcgcaccaccacactccagcctgggagacagagcgagattgtgtctcgaaaaaaaaaagtttcaggaattattttgtggcctaacatgtggtctctccttgagaagaatcatgtgctgaggaaaagagtgtgtattctgcagccattagatgaaatgttctgtaaaggtctgttagttccatttgttttgttttatagtgcagattaagtctgatatttctttgttgattttctgtcttattaactttttgttgttgtctgttgtttctatttacagcttattataccatgtcttgaaaagttgtagttatttctcttgatagattcatcttttagtctttctgtttaagatacgagtagttgacacatcacaattagtgttaaaatattctgtatttgtctgtgtacttgctgttaccaatgagttttgtatgttcagatgatttctttttgtttgttaatgtccttttctttcagatcaaagaactcccatttgcatttcttgtctgctgttgatgaaatttcttaggttttgtttgtctgggaaagtctctatttctctgtcatgtttgacattttttccttcagtactttaaatatggcatgcctctctctccctggcctgtaaggtttccactgagaagtctgctcctttgtttcttttttcttgctgcttctaggatcttttcattatctttgccttttgggaatttgtttattaaaatgtcttacttgggcaaagtctgcttggtgttctataacctattgtacttgagtattaatatttttctctagatttgggaagttctctgttgttatccctttgaataaactttctaccccaatctctctctctacctcctctttaaagccaataacttactagatttgcgctttttttagactgttttgtagatcttgtatgtgtgctttattttttttaaattttgtctcctctgtatattttcaattagcctgtcttcaagctcactaatttttcttctgtttggtcagttctgctgttgagactctgatgcattcttcagtatgtcataaacttttagctccataatttctgctttatttttaaaaaattatttcaatctcggccgggtgcggtggctcatgcctgtaatcccagcactttgggaggccggagtgggcagatcacgaggtcaggagtttgagaccagcctgaccaacatggtgaaacccgtctctactaaaaatacaaaaattagccgggcgtggtagcgcctgcctgtaatcccagctactcaggaggctgaggcaggagaatcgcttgaacctgggaggcagaggttgcagtgagccgagaaagtaccactgcactccagcctgggcgacagagcaagactttgtctcaaaaaaaaaaaaaaattatttcaatctctttattaaatatatcgaaaggattctaaattctttcgctgtgttatcttgaatttcattgagcttcctcaaaacagctattttgaattttctgtctgaaagatcacatctctgtcactctgggattggtcactggtgtcttatttacttcatttgatgaggtcatgttttactggatggtcttgatgcttgtggatgttcatagatgtctgggcatggaagagtccggtatttattcagtcttcacagtctgggcttgtttgtacttgtctttcttgagaagactttccagatattcaaagggaattgagtgttaggatctaagcctttggtcactgcagctgtgtccgcattagggggcaccacaagcccagtaatgctgtgattcttgcagactcattgaggtatcaccttggtgatcctagataagatctaggagaatttcccggtttatgaggcagagtctcttgttccttttccttactttcccctaaacacacagagtctctctcttcatgctgagctgcctggagttggagcaggggtgatgcacttctgtggctaccactactgggactgtgctgggtcagacctgaagccagcccagcactgggtctcagtcaaaacttgtggtgactattgcctggctactgctgatgtttattcaaggcccaagggccgtttaattagcagatggggaatctagccaggcttgtatctttcccttcagggtgatgggttcccttctagcccagagtgggtctagaaatgctacttgggagctggggcctggagtcagcagctttagcagtctgcttggttctttattttattgtggctgagctggtatccaagttggaagacaaagccctttacccttccctctccttttctcaagccaaagggatctctgccagtggccaccgccaccccaagcctgtggcagcaccactgatgtttattcagggcccaagttctctttagtcagcaggtctggatctctcccttcaggtccacggtgggtctagaaatgctgtccaggaactaaggcctagatgggggactttaggagcctgcttggtgctttattttactgtggctgagctgtgcccaagttgcaagatgaagtcccctttactcttccctctgctttcctcaagcagaagggatctctccctgtggccaccacagctgggaatgcactgggtcacacctgaagccggtacagtgtgtggcccatgatgagtactgtgtgggtaccactgatgtttaatcaaagcccaaggactctttggtcagcaggtgatgaatgctgccaggactgggtccttcctttcatgacagtgggtttccttctggtccaggctatgtctagaaatgttatctgggagctaggacccggaatgggggcttcaggaatctgcttagtgctttattttactgtggctgagctggtatccaagttgcaagacaaagtcctctttactcttccctctccgcccagagctgtgagctgtgctgcctggggttgggggaagagtggtgcaagcactcccttggctgctccaggtggtgtctcactgggtcatgtgcactccaagtccactgtctgagcccagcacagcaccaggacttgcccagaaattgcagcccttgtggcctagcctctttcagatttacttaggactccaaagtgctttagcccacagaggtagggcttgccagaactcagattctcactggaatggaagattcccctctggctagggctggtctaaatgctccttttatgggtgctggctgaattctgtcctgtgttgctttctgctgtgatgggacagcaccaaattccaatgcaatctcacaatcattgtgctttccctcccccggggtgcacagatgctgtctctctaccatgtggttgctgccaagggatgagggagaggggatgttggagagtcaagacggtctttcctcccctctccggtgcatctttccttgatatgatgtgttaaaaccaggcactgtgatcgttcatctgatttttggttcttatgaagatgctttcttacgtggatagcagttccatttggtgttcctgcagggaagccattgctggaggatcctttttggccatgttgttctgtctccaggtctctcctcctttccttatcctttgtcacaatttcccagtgaatgatcctgcagtgctgcctcccagtgttcattcaatcattcatcaaatattcattaaatgcctcctgtgtgtgatgctgtgtagatactaggggtgcaatggtgaattaaacagacaaggtccctattcccatagagcttatagccagaaggttttgcacatgaaatgtaattggaaaaaaatttcatttcatacaaagaaaccccacccccagcgccagattacctggtaaatatacagctatttagtaatgttaattaaaggactgtagaaaagggacaatgatgtttattgcagcatttttgtaataataaaataatatagtcaaacagtggaatactatgcaccaattaaagtaatgacttagcatgatgtgtatcagtgtggatacatttcaaaaacacagttaaaatgcaggagcatagtaagcatagtattgtagaggacaaagcatattaccatgttataaatgcagaataatacagatacagtataatccactgcaaaagcacaatatagtgtagcattgtgtaaaaggacaatactatgtattgtcatggacacatgcatatatagtaaaagtgaaaaaccattcaaggattgaccacataccaattttaggataatgcttattactctctgaggtaggagggaagattgaggttttaaaaaattcttattaaagtaaaaagattttgcaaatgtgacaacatttaaccattgttaagtctgtttggtgcatgattattatttttggtgcttttctgtgtatttaaaatgtttaacaattaaaaaattgaacagatgaagcgattgtgccgtgccacttttctgcttctgtgtatgtacgtttttgtgtgccttccgccgacattctctatcacatttttgctgtgatagagcatgaatgtgatagagaatctttagagtttcctctaaagaagcattgcagccccaagtatcttatctctaagggaacctgggggtgtgcagattagcctggcttcagggttgttgttcacagctcagcagcagagggcgctgctccatagcagatgtgcggtgggggtggccacaccaggcagctctcttggtgcagggccagtgcctcccagggaagcactgctctcccagggaagcactgctctccccagctgtgggaaagaggaatatttaagtacgtgcagattccctcctgcttgtaggagggggcacagaatccagccatttggaagcatacatcgtgtttctctgactattcacagccttggctgtttctgaggctaagaatgcaagaaacagcacatgccaagggcgtctttgctactatgtccgtgagcctgctgctgacttgtggggagcttttcgtaatgttttattttagattgaagaggttcatgttcaggtttgttacatgggtatattgcatcatggtggggcttggccttctagtgtacagatcactgtgggaatttttttgttgttaactgaccaaggaaccttccttttattttaggtggaaaaggattattcatacctgaaggagatatgtgatcaccaagccgaacagctgagcagaaccagcctaaagctgcaagaaaaagcatcagagagtgatgcagagatcaaagacatgaaagaaaccatatttgaattggaagatcaggtggaacagcaccgggctgtcaagttacacaataatcaactcatcagtgagctagaaagtaagtggggtctgccaggcatggtggctcacacctataatcccagcactttgggaggctgaggcaggaggatcacctgaggtcagaagttcgagacccagcctgaccaacatggtgaaaccctgtctctactaaaaatacaaaattagccgggcgtggtggtgggcgcctgtaatcccagctactcaggaggctgaggcaggagaatcacttgaacgcaggaggcggaggttgcagtgagccgagattgcgccactgcaaaagaaagcaaatgaggtcaagcccaggagaaatgtggaatggagctgagtaggacactaaagaaaccagcagcagtgggtgacgagggggggtgggtttgactgtatgttggctggggtttatgaagtctctcatttgagtgcgctgtaatctcctaggaagaatgtcacctaagaaacaatcattaatctccagtttaaaaactagagattaagagatcaatgatcatagcagttgaaaactgggatgacagaagaacaggctgttgaacatgagtcagcagtgtgtaggtgattgcgaaaaatagaaatgcttttcattttgttttttttaagaagtcttgctctatcaccctggctggagtgcagtggtgcagttgtagctcactgcagcctcaaactcctgggctcaggtgatcctcctggcctctcaaagcactgggattacaggtgtgagccaccgtattgagctgcaaatgttttttggctgtgctggatgtgttttgtgtgagccatgctactgctgctgtctccaggcagcctgatcagcttgaaggccacatgttaggatactttagctgtgactgtgagagttcacagggacccttcctaaggatattttgcagggtaggagaaggttattcagaagaaattgcttgccagtcatcaagtactgacactgtgttatctcttgtatctgacagagatggatgataggtatcagagtggatgaacaatgtgtgctcttggtctaagggagaaaacaattcccgcatgtgtcccattggtggtaggatatcaagtaacttctagatgtttgccacttagttgctgaagagacatcagcatatggcttatttatgaactcatagtttgctttgaattgggaaagaaatttttaaaagagattaaacattaccttctttgtccaaataagccttaccaaattatcacatctaatgtgttttcttttgtaacaaaagatttaatgcacaaagcatttagtcacaccagccattactaagaatagcttggtcagttgcctgagaagttccttaccccatgcagtcgatcctccttattcacagatttcacattggtgaattcatctgcttgataaaacgtattttaaccccaaaaccaatacacagagcacttccacagtcattttcagacatgcacagagaagtgaaaaggttgtgtcatccagtgcttatgttcccaactcgggtcagacagagacacttggccttctcatactgtacatgtgtcttttttacagtctgcttaataccatgcttttaacatttttgtgcttttgtttttggtgactttgctatttaaaatggccctgagtgcagtgctgtccactgtccccaagcacagtgaggttgagacgcacctacagagaaaacacgtgtattagggaagcttcatgcagacgcaagctcttgtcccgttgtgcgtgagttcggtgttattgaatcaacaaagcgcatcaggctaagtgcagtgacctcatccctgtaatctcagcactttgggagactgaggcaggaggatcgattgagcccaggagttcgagaccagcctgggcaacatagtgagaccctgtcttgacaaaaaaataaaataaaataaaaactagccacgtgtggtggcgcatgcctttagtcccagcttctctggaggctgaggtgggaggatcccttgagcctgaaaggctgagactgcagtgaaccaagattgtgccactgcactccagcctgggcaatagagcaagactgcatctctaaaaaaataaaaaaaccaaaccaaacaaaaaagcccaatacggtgcatcagagaaagggagaagtttgacaatatgtatataaggctgccctgagacatgctaaagcgatgtgctaaagcagccaaattcatggatttgtgagatgacagccagttttaaaaagctgtgggcaatattgttgtgtggctgaaaaccaaagcaatatttgttcacatcacccagggtcaggaaaatgttaaccccttcttggctagtgctggttggctcccaagtttcaaaaggccataaagtgtgagaaaggttaaccttgcaggcaggggaggttctgcagatcaggaggctgaagaagaatttaaaaatacttgctaagtgttattcaggaagaggaaaaaaggaaagagtgggtttccatggttgatgagcctggcttgtttatagagacattggcagatacgtctatataatgcaaatggcattttagttgatgagaatgttgtgaccagaggcttgcaggaacctaacctgtatttttcctagagacaatagttcggtgtttgctgatttggtgtgcatggcaactctctgcaactaccatgattattagaattgactatgtatttcagacattgactagttggttagagtgacagttgacagcacctgccccatttctccttgaacatgacatgtagtagaactgcagaacctcagcgttcagtgtcagtgccatccaggctgttctcaggatacaactgaaaacctggacgccatcatcatcagtgtatccttccaaacccagcaccatgattgagaagaaaagtcaagacaagttctgttttgtttttgtttttgtgatattttgctgttgaaaatagggttgtattgtccctaaatccttaaaagtcagcacagacacactaagaaaaccagtgtataattaatgtccacagcaaaatttagacacatgcctgtggttatatcatcatatatccaagactgacaacaatgcaagccatcttttgaaaaacttttaaactttttaaaaggatattgaggtattgttaagatatgtttttgcacagagacctagggacacataaatccagcctagaccaatcacttcttcctataagatcctgatgggaaaggaatggactggaaaataaaaggaagttagggagtgttttctactgtgcagcattgattccagacacaaactctcagtcccactagaactagaactgctggggtaggacctgcccacagcatctttttagcctactctggtgattctgatttgcatccttcatagaaagctaatgctctaggttagagcatgaggacctattgaggaatttcagctcagtgactgacaccatcagatttaaatttgaatgactctgatagccagatggagagaattggaggcaaggagaacaaggggctgcaggtgtccttaagtagggagaggcaggcaaccacctgggaagatgttaaatgcacacatccccgggttctgtctgcccttggagattctgcctccaggtgtctggagtgtgggactagaacatcggtgcttttgaaaagcttcaccagtgatttagaggcttaactgtgattgagacccatgactctagaaagtgctttacaaatcacaggaggaataagcattcatgtgctctgttatgtgaaagcctctatctcacagcaataaaggacacttaggacgattgtgtgtgagtgcgagggaggccggactcggtatgcaagtgtgcatggccatggaggcctcttcccgtagtgctgctatttggttgtgcattctgtctgctgagactgtaacctcaatacacatcacatattttccagatcatcctgttctttatctcagaggaggctcttgtgtccattccctggtttacagggtaaattgaaattgctaaaagttgcatttagagtagaatggatggatttggatgcctgttgtggcatctggagctgcccctttctttgctacctagcgtgtcttctcttaagagtctcacagcttttctaagccctgtctgaattatttatttctaggtagtgtgatcaagctggaggaacagaagtcagacctggagaggcagctgaagactctgaccaagcagatgaaggtgagatgcgggtgggagccttcaccaccatcttcctatgaattacccgctccgaggtgtggatcactctctctatcctgctttctcttggaacgtttccacggcatggtgggccctggaactgtaaattcttgttggcaggaagtaaaatcaaaggagtcatttggtgtcaggatggagaattctcataacctgaaggtgtaattccaccagtgccttttcctagcagtgagccaccgtgtaagcagggcctcaccaagcactgatggcatttttttcttggtgaccaacacggggactctggggtccctgcccaggcactggccctggcaggcgtctgacataaggatgggctctgacattttcaggaggagaccgaggaatggaggcggttccaggcggatctgcagaccgcagtggtggtggccaatgacatcaagtgtgaggcccagcaggagctgcgcaccgtgaagaggaaactgctggaggaggaggagaagaatgcccggttgcagaaggagctgggggatgtgcagggccacggcagggtggtcaccagcagagccgcccctccgtgagtctggtgggcaccagggccgtgcttgcttctcaatcactatgtatggggctccctggtggggatgggactcttcatgtctgtgccaggttctgctatttcctttctgagatcaccctgaattactagcaccaccttaccactaggaacattctgtacagtacccagtccctgccatgctgcagcataagaggctgctaagctcctcacttacatatgaagggccagttctagccaagtatcctgctaggcttaaagaatagaagtcctgtctagaatgctccctgaatcttagtatttattaatgcaggggagtgcacactaataaatacgaatccaccaccttgtacaggtcactcccatgcagtgggagaagctggaatcactcccaaggggaggagccgccggagaaggacacattcctctgggcccaaggatgtgcctgcttattgagaacacccatgagctacgtcaaaaggccttgacataacctattttattaaaaaaggatgagagtagaaaacatgcatttggctgatgtgtgacattcccttctgctcttgatggggagaagcacacagtgtatcagcccagggagctctactaacagtgacatttaagaggaaggtattcccaaagtgaatgcaatgttaattattatctgaaatttagatggtttacagacaaatttataaacagcattttttgctttagctaatattatatttacccaatgaggaatcagtgtccttaactttgagattcttggatattaggaaatgattttgaatttttaggtgtctctcaaatatcaaacatagtctttttagatcaaatttcctgggttttgaatgttgatcaggtggccctagtgtttacatgtttccaagatcagtggctagctcctgagccttttgatctgatgtttggttatcatgaatttcatgacattggaaagaggagatttttcagaattcagctgtgattctcctgtcaattctgctccaagtaattccttatttctttgtttataacttttacataaaatggcctttggggaaggatgaagatcagatatagctagctccacaattcactgttgaaaaatcaatatcgagatcattattttatttagttatttatttttagagatgggggtctcactatgttgcccaggctggactcgaactactgagcccaggagattcttctgcctcagccttctgactaactaggactacacatgcgccagacaaggtcattactttatagacagagctctccctctggacaccaaaggatgtgaattttaagtggaggtagagggagaataggaaaactaggtttcacagtgttccctactgaaacagtagtgaggccgttctgggtggcctctgtgtctgcttttgtttcgtttgcctctgtcttgcttccctattgtctgtcattggaagaaaatccgagtcagaacttgtgttgcttcacatgtacgttattttaatgataaatggtaaaagacaagtcctgagtttctatggtggccctgaataggttcttgtatgagatgctgtgtttcttacgtatactctgagacacaggccaggttcttctatgagatgccatgtttcttatgtatattctgagacacaggccagaccatgcagcgtgaaccctgatattctaggaaatctccgcatacgtcctgccagtttaggactccctatgctgcatcctgcatcttcaatcttaacgtcacgtttttttttaagcacagaatgtttcttttttgattttccagtgatttgcaaacctacctcccaatctaacagtttaatcccttctcaaaaaacatttcaaaattttagaatggacaccaatgagaacatgtcatggtactgaaatcaggcatcagaacgtttctgtctgtcagtgcatttggcaggaagtcagacaagtgccggagatgctggtttcttgtctgattttgcacttctctggcaagctgccccttgtaaagagttgactatatggcagttagttgctggtggttcagccacttccagcacctaccccatgagcaagacttgaaaccaactcacaccctcaaagctccggaagccacctagtgtttccatcttgactgaatgagttcttgattgaaactcagtttgactttgacagtcatctagtgagaactcaaaagtcattcttggttcagccacagccaaagaacttgcagagcattctctgacgaggtcctcaaggacaactgagagaaggtaagatcacccaaaaagcacctggatccagacatgagattacctggttcttaagctctgtttgcgtccgtgggcactcacagggttggttgcagccaggctgataagcacgagatgaagcacctgggcagaaatgcaaaccagcattcattgctggaactcagtaactaaacagtgggatattatctaactcatccatgatcttcggtcctgttacactttcacagatatttttatttcagagtcagaataactgatgttaaggtatgtggggaaggaaggcggtagcctcatctttgcagtcaaccagcaatatctcattcccagtgtcatgtttgcagccaaccagtaacatctcattctcagccctgcctcttgcctctgttaaaagaggtgggaagagggggtcgtttttgaggtctctttaagctctgctgttctctggactggttggttagctgacctttccctggtgggagagtaagaaactccagtgccagccttagagttattctggtgcaatgccttgaacctctttgacacagtggcatctccatatcttagttgtggcttgggagcctgctctttctcttccagaaatgtgaacaagccagtgtgtttttagggacctaaaagtgatctgtttcattggacacatataatgtaatagatgaaaagataataactttttcagctctggctcctcccagttttgaaaactaccaattgagaaaaaggctttgaaatgaaaactctcactgaaatgaacccgtcacatctttttcctgaaaagttgagtcctgggacctggcaaaaacagaaaaaacacaggcagctcaatgtaatgatatattgtgccgcatacaagctttctaatgaaagacatggttcgtgagcagtgcatggcacaggcttctcaagcagcatcagggaaagacctctgtgtttgtggcatttgttcctcttgttctgaaacagcaaatgccattacttttagggtgacttatctgattcttactgtgtctgtcatataacaccaataaacatccatggaaaacgtctttaaaagagataattaaacacacttaatatctgtgcctaattaatgctgttggtttctaaatagaatgtctgtgattcgaatgtgtttcattttgcctataccacaagttcttgcattgtcccctcttggaggtgagcagtgtggcagcgcagcacgtgcagactccactggaattggcttaactccatgtgtgcacatccgtgtcagcctgagtgtcactgtgtgtgcctgtgctgccctctgtgttgctctgatggctctaatgggtcacagccgctcagcatgtgttctccagctaccatggagaggggaggggcggaagttggaggtatagattctttaaggtcccttttccagctgtcttgccacagatgctctgatactgagcccctctcccaggtggaggggggctgttctcctgaggattcttaagcagtttctgaacagacctcaccttagcacccatgacggcatgatggacaggggtctccagcatttaatttggcccttgatgcagaacctggtcctctcaatgtgctcttattccagctagcattatctgttccctcacctagtactctttttttcatagtttaaatgtacatttatgacattagacacacagtctataattctaaagagctgtgtctgcctccctgttctctgacccctgattttacagatttcaacaatgtggacataagcttcccttaggcctttaggatttttaggttgcagttataaaagcaagaaggtttttggccttgacagtagagagaagcatgagcctctgtaaattctggaggggcctatggtgttcatcctggacatctctgcttcaccacacagttctttgctggagaagttctggtggaggagcctagtacaggcatttgcagtctggctttttttttttttttttttatgtctgaaaacctttggcttccaaaaaattggaacagtaggacttaaaatctgttggcctatcctggacattagcttttccctgtgggacagtgtaagctggaaattcttgcgtttgtgaactaagactgtattgccttaggtaactcctttacagcctctccctcccgtttctattttcacagctccctgggctctgtcagctagcagagcatttggtggaagaaagacagcccagctcttgccatgattgggagccgcagccatctctagatgaaagggggaatgtgtagaggagaaattgcctctttataaagagcccagttgtctccttgtgacattctctgtttctcagagtcattgccgtcgagtctctgctttttgtccacattttgggatcagcttactgcatgatcaaagatgatgtttccctctttttacttttcctcagaagattgagctgtcttttatttggagaataaaatgaagttctgaaaaaaacaaagtacaagtcttatgaaaagttatttgcagctggagtgctgaaaagggcacagtggcagagcagatgcagagctgggtacagcgcaggcccgagttcttttgttttttgttgttgttgttgttgttgttttgttttgttttttttttttttttgagacagagtttcactcttgttgcccaggctggagtgcaatggtacgatctcggctcactgcaacctctgcctcccgggttcaagtgattctcttgcctcagccttccaagtagctggaattacaggcgcctgccaccacacccagctaatttttgtattgttagtagagatggggtttcaccgtgttggccaggctgctcttgaactcctgacctcaggtgatccccacctcagcctcccaaagtgctgggattacagacatgagccaccgcacccagaacctaaggcccaagttctactttttggtgttcatttctctgcttccttttgatcgtggtgtctgatcatcttggaattcacattactcaaggcaaaataggaagccatctgcgtgatgtcacattccgaagaagtcagaaggttcggcgagttggagctttactcttgttgcccaggctagagtgcagtggtgcgatcttggctcattgcaagctccgcttcctgggtttaagctattctcctgccttggcctcccaagtagctgggattacaggcatgtgccgtcactcctggctaattttgtatttttagtagagatgcaatttcaccatgttggtcaggctggtctcgaactcctgacctcaagtgatctggccgcctcagcctcccaaagtgctgggattacaggcttgagaccccatgtctggccccttctgtggggtcttgattgagccccttcacttggagtctgacttcattacctcgtctgaaacaaggtgcctccaagctttgggttgatttccagaatcttgttgggttaaacataagtagaagtttgatcataaaggatgttattaagccggataggtaagcacggtgacaatggcaatagaaatctaatggaaaacgattgaatgacaactacaccaaagtttcatggatgaaactcaccccagaaacttagtgttcaaatcagagtgatacacaattcaaaatgtgattttaaacttctggaaatatgtgtgtttgtgaagatccaaatccaattcagcaacctccatcaggcagaaaccttctgcaatcctcacatgaggaactggttcacagtgtacacagcatggagccattagtgacgttatccaaaggatgagacaagacaaaagttactgtctaataaaaggaaaattaggaacaggaatgctctttaaactcaggaagatcttttggggtgtcaaactggacagcacagaatcattagaaaaattagcttggcgtgagaagagacattgaggtcttctctgtaaaatttacttagatacttgtgaataggactgaaatttatattttgggcactctttacctcagattcagagttcttaggattatttaaaattcatttgctggatgttttcaagtataaacaataagaaaactgcaacttcaacttaaaaggcactgctgtatttgcaccctatattttgacctgtcgttaggtactgttgaatatttttatctgtaagcatttatgaagtgcaaaataaacatgttattatatagaagcgtctgctgcttagttttaatcaccagctacgtttctgcagggcctttatgtcgttttgttctacatttttttctgaatacagtttcagaacttcaaagtcacatcaagtaactagaatttgaggtagaaaaaagctggatgtaagttgtaaataggaggttgacatggaatatgaacagtttcattagtagaacaaaagggcatggagtaaaaatgctaattttgcataaatttttaaaactctagggtctcagaaaatatagcatggacttaaagtctagatgtgttttgttgacatttaaatatgaatagattgatgatttaatgtattggattttttcttaattatgaagtattatttaggtatactaataacaaaatggagacgtgtgaagaaaaatattaatctttcttctccctcagtaccacctgtgaggaaatcagtgttaacagtgtgtacatttttctttactcatgaatatgtatagggttcattttcatatttttaataaaaattggattatattcttttcagtactctgcacctttttattttatcatatcataggcatccttccaggtcaatacatagaaatctatcttattttaagagcaacatgaccttccataggaaggatatgtcctggaatattaaaatattgtcttactaatgcacaacaaggttataattttttttttatgagtaatgctataatagcagtccttattcatatagtcctatgtagttgtggttttatttttatagaatgggtttttcaaaatactattgctgctctaaagtatatgcacatttttattttaatagatgtctccaattactcacctgagtgctgtgacatttcactcttgaacatgcccatctgtatacatcctgagcagtagtggagagccttgatcatatttttgccaataggataatcaaaaaatactatcttattagcactttaatttgcatttcgctgagttttttttttttttttttttttttttttttttaaagacagggcctcactctgtcacctaggctggagtgcagtggtacagtcatggctcactgcagcctcaacctcctggacttgagcagtcctcccaccccagcctcctgagtagctgggactacaggggcacaccaccatgtccagctaattttttttttttttttttttttttttttttttggtagacacgaggtctcactgtgttgcacagagagactggtatcgaactcctgggctcaagtgatcctcccaactcagcctcccaaagtgcagggattacagccatgagccaccatgcccagccctttctaagcacatctttgtatgtttactaaccactgcattttctcttctaagaattactagttttgcaacttttccctgctttttcactgagctgattgtttttttctcatcagcttataagtcagtattttattagggatacggttgtatcccctatattatgagcctttatcatatttttcatgtgatatggctttatctttatcatagaaaattttatatttttatgtaaactgttagtgttttcctttactcttttttttaagattccttctccccagtattatacaaatgtgctattaaatgtcttcatctacttgatgcacacacatatgcaggccatttgatccacctctctttatttaatctgatgtgaggtgtggttctttttctcccactgggtagcactgtttattaccagagtcatcctttgtccactgaattgaaatcccacctttacatggtttatgtcatccacattcagagagacctgccctagatgtgctcccatttctttctcttttgagttagctctgctttaaaatattcatagattattagattgcttatattacttttaactcatcctttcatttaaaatttttattttattgaattttaaggcagacagtatcagtgttgaactctgtttccagtcatgaatttacaaacgccagtcctctcttgagtgcagtttccccttcactttgtattatgaactgtttgcatcgagcagggcatgattttgcctgtcaccttctcttgctgaagcagatccaggtgtggcagggcctgacgtttgccccaggtccgtgtctgaattctgctcagatccactgcctttgcctgacagtgcttctgatcttcttctcatgacttaaacgtgttgggaggctcttgaaggtacatttgtattacatacttggaggtacagaagcccaggtagagtagagaagggtgagtgcctagttgggaaattcacctgtacccagtttcttctctgcctggtgagcctggaacgcagagccagctctctggatctctttgcgtgcccctcatccattttaggtgcacactgtggctcttcctatcctgccccttgtcactactgccctttatgcctagggtaaaccaaccttggccttctcggatgtaaattcttcttgttcctgatcctttgccaaaacgccgtgcatctctctgggcttctcatgctcctctccagccttggccctctagggtgggggacattagttggggttttcccatatctccattttctttggaagggaattgagggaaagcccttggtattgtattttcattcccccgaccgtgtactctctattagcagaaattcttcagaatctaagccacgtcaatgatactcgactacaggacttttactatttgattcttattgttgggatttgtagattatgatgctggtgttcaaattactttcttatcctgtttgtttttattgttatatatgcttttactgaaatttgaaagtgaaatttagaagatattgtttgacacctaagagacaaagtacttcataatttctgtcttcaaatagagtgaaaaacttctgttagatttgttttatgcaaaataagtatttagaaaaaattacattccaggcaagggcatagaatgagcaaaggcacagaggcagggcataaaagtaaaaaacttcaggtgaatagtccaaaactagatgggcagaggggagtcttgggagattaactgaaagacctggggttgggctttgttcaggtgttcagtaaagagaccggcaggcgtgagcatgtggttgacatgcgacccgccctcttcacaaatattaatctgccaattgtgaaggtagcagtggtgccatacaacactacccaaatggagttaacctttgaatactttaaaaatcatcatgtacaggagctcacctgttcctggatcagaatgaacaatgacataaagtgctgtttttaggaagtaaatgctgtagaccatgactgacatttgaaaactctgttctctaacataacaaggaaagcagcaaattagagaggttaaataaaagttttaaagggaaataattagagacatgtatgtatatgtgcttaaatgacaaggtgaggcatggaaggcagaccgacattcagtgaggagggccatgtgccttgctgtgctccatggagacactgtctgcttatggagtgtgcatcacctgctgtgtgtgacacagcatcaggcggtctggcctgcaactgttgttctctagtatctggcctgcaactgttgttctctagtatgggttgccgccttttaagagcagattattgtataaagataggaacactgaaataacttggtagtattttttaaatgtacttaaaatttaggaagaaataccatcagtattatttctagaaccttgtatatctctcacagaacatttatgcattatagaaaatttgagaaatgcgtggccagagctggatttgcaccccagtttcaccattcatgaatcatgtgaccatggtcaaattttcctctaaaataagggataataatatctagttttgttgaaaattaaattagataatgcttttaagacacatggtactgtgcttggcatatacagtggagttatacacattcatatttgttttgctgaaattatcgattattatcccagttttatatgctgggagcaggtagaatacttgcttcatttttgttgttttaagcatggcccctaaacactaagcacctatttaatgtgtgatgtaactgaagaaagagccaatcatgaaatgctggagggaatgcaagtatgtgagacttctggagagttggtgtgtttgtaaacagtcatgtttacaaaagcatgtacttttgagtgactcaaattattttcatggtttatttgactacatgtgtgattattactttgcaggttgattttagaacctaacatcagccttagaggcagtagcaagccttgaacaagtgtttctccagtagtggtaccttgcagtttttcttttatttaatgctaagacatacctggctgtatacttacatatttcttaatattcattatagaatacagagtttttattcttccttggaacagaggaaatgtaagacttcatttatggctgaggctgttactaattgatcccagccaattctaaaataggctggtgtaaggattttcagcctcatttatgatttaagtacatactaataagccaatagcattcttaataaccattttctttggttattcaattcaggctatgttttgtgaatccctctcacatacacagagagacacacagacacacacacacataccactgttacataacacagtgggtatttctcttctcaaattatacagggttttctcatactgactcttattgttctggccaagtagacttagtgtttgaaataccatctttggatacctgaagcctgaggtaattgattcttgtggccttgctttttaaatttatcatttgatattttgaattgcagataaatttagataactgaaaggaataacctcagcagaatgtaggcgtctccattttgttcttattaaattatcaaagaatgaaatgtaaaatgaattatttaaaatgattgtccttgggggcctttggtactgagtcatttaaatggactggtaagaaggtggccaggcgcagtggctcatgcctgtaatcctggcactttgggaggccaaggcaggcagattgtctgagctcaggaggttgagaccagcctgggcaacatggcgaaaccccatctctactaaaaaaaaaaaatacgaaagattagcaaagtgtgctggtgcttgcctgtagtcccagcaagctacgcaggaggctgaggcattagaatcgcttgaacctgggaggtagaggttgcagtgagccaagatcacaccactgcactccagcctgggcgacagagcgagactctgtctcagaacaaaaaaaaggtggcccattttgtttgttgatgaccttcatgagaatggctagcacagaccgaggaaattattttctgctcaaacctaacctgatttctttttctttctgcatttttgccacctgattttattgtatgggaaagtatgaaaaccagttcctctcaataaaattatttaaaaattattttaaaaacccaacctcctacaatttctgaagtgcctgataatttcttccaatgaagttttcagtttactgattttttttttcactcataagaagggactgtggagtgaagattgtaaggcagtgtggtttaactgttttaagttctgtttctcttaaatttattctattcatgttatttacagagcaacagaagaaagcttagagaattaaagacaaattcaactggagaagcttatgagtagtagctagattaatttgaaaatgatcagtaaataactattttatttactgatttattttaaacttccaccgaccttattgaaatatacttccagaaacattctgtttgaactattatcataaattagtcatcttgcaaaacagctgtggcaatatgatacaatgaagagagcagtgatttagcaatgagaaggttgggagttcttgtcttggctccttcacagggagatcacatgacatgccaaagtcccctatatgaggaagccatgcattgagaggattgaggattgggtcaatgatctatcatagaatgctttctatgagtctagaagcctcatgaagaacacaccaggaaacttgggtgagagcaggagcttcacctcatgcagaattgcagtgtgattttagagtgctgttaccattcttatgcttagaagtcagagtgtctgaatcaggattctgttgtgtataatggattgcactctcgttggcttaggcagaaaggtgttaaatggtttgcagaattgttgggaaggctgagcttccaggagcagctcccaaagtctccacacacaactggaccaccagggaacctgctccctccaccaggacaggagccttaacttcagaaagctgcccacccagttggaaagctgccaccacagttgccagcaccatagcatcttgtctctgctacagtctctgtctacatagtgaatgcccggtgccctgcctctcttcctctgattcaggtcccactccaggtcttgcccaagtctttctgattggtggaacttaaatcacacccaaaatcccagctgtaggagagctgtgagatttcatctttccaaactctgtgtactgcatgggggttggagcacatgtcggcagccggtccactgcattcaccattgacagtaggtgaaatatttatggtcaataacatttgcattttttcacaaaaaatgcacaatttgcagagtagccatacacactttttatttagagctaatatcaagtcactctacatataaaaataattatttctgaccatttcccaagaaaacagctcttctaaaaattgagagcaatgcctacattatttcctaaagatgcaaactggtagagaaaacaggatgttaaattcagaatttcccttccagcttcatttattttctccacatcagttctgttttcctctgtgtctttttctcccatggggatgtcctccatcttttcaatctgatttgctctttgccatgcagacctgtggatgaagagccagagtcctctgaggtcgatgctgctggtcggtggcctggtgtctgtgttagcagaacatctccaacacccccagagtcggcaaccaccgttaagtcacttatcaagtcatttgacttgggacgcccaggtatttaatcattttttctataagcaaagctccaaattcaaactttggcccgacatttgatatgtctactatctctactccaccctggccctgtgttgttacaaccacaagggcgctttccaggtcctaccacgtgcagccactgcatgcaggagcctggctgaggctccagggaggcactgatggagagcctggctcatgaataacacaaatgcagcctcttcctctctaccgcttccttccatccagttcctgccttgctacctttcttttctgcctctcatagccattaaattcaggtcactactatttgcctttttgtcatctcatgagaattatgagggtcagctggagacttcatctcctaggaaacgagacatcacatctctgcacctggccctcttggaggcacccctggccatccccatcttgcaacctgctagacgtttttctacctggtcttgtacgtgagcacctgtgctaatctgtcactcctgatctaggtgtgttcccagcttttcctggtgttgtctgatggtctcacaattcccctttagtcatgcttatcttcctatatgagaaagatgcgtagctatacttcatacatatactgtacacataaacatagcaaatagaagaaacagaatgtgcatctgtctacagtaacaatatctttcttccccagagtgcaacaaacatgccattgtattgggagactgtagtaaaagttaatcctaggatgtacctggttgtctctgctaaaattgtttgcacctaaattagattaagactagactctacatattcaaagacatgaaagcctttcatgtctgtgaagacaggaaatgaattaacaatttgtacaagaacttttctgttccttccttctctaggcatctcattatttatacagtttctttttgctcagctatccttcatctaagactgacctccactcagctaaatcttcccttcttgtttccccaaagcagctctagtccggagaagaaaaggataatagagtaaatattacactaaacacggatactccttaagccaccaaaaaaagtaacaagaaatcaggaacaagtatatgctattttgaagtggaacaacatataaatgttcccatgttttttcttggcaggtggagctggacagaatatttctgtccataagacccccagaagtcccctaagtgggataccagtgaggactgctccagcagctgctgtctctccaatgcaggtagatgagccccagaaataaccactgcttatggtttgctgtgtatccctctagatgtttttctttacacatattagtgtccgtgtgtgtatgtgtgtgtgtagagtatgtgttttgtaaattggattgcactatgcattattccaatacttatttcactttatcatcggaatgtaagcttcatgaggtcagatatttttgttcattttgcttgctgttttatctcttgtctgtaacactggttggcacatggtcacattatagtagaagttcaataaatattaaatgaatgaaggaatatgttttcaaattttaatatttgcagaaacgattctttttataaaagattacataatatgtggtgatttatttagccactgttctactgatagaagttaggtttttttggatttaacttattacaaaaaataatacagtgaagatactgatacaaatttttgaccacttaaggggctactttttaaataagggtatatcaagattcatttgtaagtatcagagatgactgtagttaagcagaaaggaatttaatacagggattttggtactgagggctggagaaaggtctaggctgcactgagcttccaggaaaggttcccagagcatctgaaagttggcccattaaaggagcttctgtttctgccagaatcgggaagtctttctctaagtgcttacccaggactgccactgctaccaagatctaggatcagcctggtgactacactgccacaggtgcagtccatgccagaaaagcacactctgtgcctgccccatactgaccagaaaacggtggaacagaccccagaacctctgctcccctgccacagaacagcgaatgccttcccagccatgtttaccaggagaagctgcagaagggaagccttacactcccttgcaccttccagatcctctgagaaggggcctgtttgacagaagctaggccacttgatgagccaagctttaaaggagtttgccaagtacaccctttagcttcccagtcccttatagttcaataagtcgccctacaaggagatgaggatggagttgagtgagcccgtcttgagatcttctacaaattgattcctagtgaaggaaaatggagtcctagaaaaggaaatgtatttgacctgttccagcatgtcgaaaaacttgatagacacattgcccttcagtttgccctcccgcttacagtactattttccaagaattttgacactgtctataatttttgaagatcaagtaagtgaacaataatatcttgttttactttatcagtaaggtggagcacttcttcgtatgattataggccatttatctcttgtgtgtcggtgtggaaacttacatactttgcctgcttttcttttgaagtgttagtctgtttatgttttgtaagaagtattgatatattgtgctttttaacattttttcatatgtaattgtattaccttttttatcttttaatgtcatattaatagttatcttttactgaagagaaattttacatgtttgtgttgtgttttaagattttgttttgtttcctgccttaaaatgtcttttctagctattagatgattaaaatattctccctaaatatcttaaggaagtcttttatttcttcagtcttaaaacccatagaaacatgggtttggatttagatattcttcccctatcttaactgccttctggaagcagaagtaaatactctctggaggacaattacaccatctagatccttaaattatagccacattttaaaaaatacaacgttatatagtaactttaaacaataccaggcatggccaggtgcagtggctcatgcctgtaatcctagcattttgggaggccgaagcaggcagatcacgaggtcaggagttcgagaccagggtggccgacatagtgaaaccccgtctctactaaaaatacaaaaatcaactgggcatggtggtgtgtgcctgttgtcccagccactcaggaggctgaggcaggagaatcacttgaactcaggaggcagaggttgtggtaagctgagatcgcgccactgcattccagcctgggcaacagagcaagactccatcttaaaataaaataaaataaaacaaaaaaccaggcatacaaatagataataccaaatgatgaaaagccaagagaaaaaatagacaatagaaacagacacggaagattcagatattgatattattagacatagaccctaaaacaactgagattaatgctgtcaacaaaataagtgacaaggtagagaatttcagcagaaaaccacaatgtataaaaaagaatctgttagagattttatgacttaaaaataaaatacctgaattaaagactcaataaagtttagctgtagcttaaacagtttaagagaggcttaaagaactgaagacaagtcagtataaatatctgaactgaagcacagagaaaaaggataggaaatagagaaaaggacataagaaacatatgggatggaataaaaaaatctcatgtgtaattggagtccccaaaaggggagaaaaagagcagaagtgatattggaagggataatgatcaagaatttccaaaactgataaaagatgtcaagcccagattcaagaaacaataagaaccccaagtgagataagtacaaagaaaaccacccagacacatgaggttaaaactgctggaaatgaaagagaaagcatcctaaaagcacccaaaagaaaaaagatacctcaatgtccaaggaggaagagcaaaactgacatctttcttctcaagaagaatgatggaagccctgaagacaatgcagtggcatctgcaaaatgctgaaagaaaacacctgctttcctttacctcatgaaaatatgcttcaaagtgctgtacctggtgaaaatacccttcaaaggtgaacacaaaagaaagatgctttgagtccaacaaaaccagatgttttttcctaggatacttgcagtgaaaagactatttaaaggagttctgcatggagtttgttcttttaaaagactattaaaattcaaaacatctgacaagaaaagctaatgcaaaattacctgtatcaggaatttgtaaatgggtacatcactaaagatttcataattattaaagcaatagtaagagaatattatatattactactttgtgctataaattagaaaatattgatgaaatggtcaaaatcttagaaaaatgtaacgtgctaaacttacataggagagagtagtagaaaatctcaatcacctataatttatatcttttccttaaaagaaatgccagggccttatggcttcaccatgaaacctcccaaacatttaaggaagaaataatgtcaatcttacgtaaattcagagactaggaaagaggtcagcatagctttgatccctaatagttgcaagaacattaatagacaagaaaattaaaaggtctttctcacgaacctctttgcaaaaatcctgaacaaaatcttggaaaaccttattcagagacacatgaaaaagatcatgtcatgttgggtttattccaggaatggaaggtggttaatattgaagccaaccagagtaattcaccacattaacaaaggtataaaaagaatatggttggccaggtacaatggcttatgcctgtaatcccagcactttgggaggccaaggtaggtggatcactggaggccaggagttcaagaccactctggtcaccatggcgaaaccccatctctactaaaaatacaaaaattagctgggcgtggtggtgcacgcctgtaacccccagctacttgggaggctgaggcacaagaatggcttaaatccaggaggcggaggttgcagtcacctgagatcattgccattccactcctgggcgacagagtaagactctatctcaaaaaaaaaaaaaaaaagcatatggtcatcttagtaggtggtggcaggaaaatgtagtcgataaagattaatatctttcttgatggaaattcttagaaaagtaggaatagaagggaaagtctttaatctgataaagggtctgtattatatatctacagcaaacatcatacttaatggtgaaatatcggatgctttcccacaggattgtgaatgggataggaatgccccatattgtcacttttgttcagccaacttcaaaagcaagatttaaaactacttttgaaaactgtataccacgaccattatatttttgtgggatgtggatacatggaattgtgtttaatatgctatgaagtagagcctctaagagaaaataatgttctggaaagcctcagaatggccctgcacaggcaaatgtaccaggttgttcattgcagcattgttcctaatatcaatatcaacatgaatatcaatagagaatcagtaaaataaattatggtaatgaaaatagctaagatctactgaatgcttactatctgctgggctgtgttttgattgttctaactggatttaactcatttaatcctcccataaccctttgaggtaagtacgtttagtatcgttgccattttataaataaagaaaataaggcacagaaaattaagtaacccagagtctcacaggtgggtggtgccatctgtccccagagccacttacttggcctcttgtggcacttctcagaggaagctgccaagatggtgggtgatggtgggtatagaatgacttctaagatacagtaagtgaaagaagcaaaatggtgtacaaaacaatataatgctatgataacagttgtgtttttagaaaaacagagggtgtttttcaaggtttttccttgaataatatcatgcttacttgcattctgaaatgcttttttaaatggcagtaaaaaaaatacaccatgaaatctactctattaacaaatttttaagtattgttaactagaagcacaatattgtatggcaggtctctagaaaaatttttttttaaatttttaattttatttcagattcagggtgtacatgtacagatttgttacatggatatattgtgggatgctgaggtttggggtatgattgatcccatcacccaagtagtgagcatagtacccaacaggttttcagtgcttgcctccccctcctctagcactccccagtgtctcttgttgccatctttctgtcctctagaactttgttatcttgcctgactgaaactctgtatccacggaacaattccccacttcccctccctgaggcctctgggagccaccactccactgtctgcttctgtgattttgactactttagattcctcacgtacatagagttatgccgctcttgtccttcagtgactggtgtatttgacttagcataatgtctccaaaactcatttatgttgtagcatgggacaggatttccttcttttttaaggctgaataatattccattgtatattctataccacattttcttcgtccattcatctggtggtggacactggggttgcttccacgtcttggctgttgtgaattatgctgcaatgagcaagagagtgcaagtatctctttgagatcctgttttcaattttcttggataaatacctagaagtggtgttgctggatcatttggtagtactatttctaattttttgaggaacctccatactgttctgcgtaatggctgcaccattgtacattcccactaacagtacacaggagtttcattttctctacctcctcaccaatacttgttctttttcagttttttttttttgatgatggtcttcctaataaatgtgaggtggcgtgtcactgtggttttggtttgcatttccctgatgattagtgatgttgagcatcttttcatatacctattaaccattaaaaatagaatacttatacacacatccttgaatatacatagaacattccaggaaagatattcacaaagccaattaataatgattgcccttggagagaagaactgggagatgggaaggaaaaggagactttctcttcattatttgcccttttcattgcttttggggatagtgtctattgcatgtattacctattcaaataaatgagttaattaaaaactcccctggttattccactgtgtttaagaactgttgcacacacacgcatgcacacacacacatctgtgtttgtgctattcttgatgttatgagctcaccgtgctggtgtccccctggtttttacagaggcattcgacttacagcagtgtgcggccagccagcagaggggtgactcaacgcttggaccttcctgaccttcccctctcaggtaaattatgtcaacataaagaacttttgacttatctttccgtgcagttaacttttcttcatttctctgcatgaaactgagcttagaaaaataatcagtggcatttcttgcaagtgatttcaaccccgaataatgtacatatcatgaatgttagatgcagcagtgcagctgacaaaaggaaaaagtgtctcctgccagctgcacttctcagtgcccttgtgctggggagacaggcccaattttttttttcttttccttttttcagagacatggtcttgctttgtttcccaggctggtctcaaactcctggtctcaagtgatcctcctgcctcggcctcccacagtgctgggattataggtgtgagccactgtgcctggcatattgttttttaactgaacctcaagagcatattttctaatctttaaaaagtaactaagggaaaaaatcttacctgattttgaatttgtctgctacttctgcaattcttaaaatttgcccctttaaaggtatttgtcttttggtgcagtcctcttcctgttgttacaccgtgtgtgtgtgtgtgtgtgtgtgtgtgtgtgtgtgtgtgtgtatttgttttttgttttaactccaatcctggttgtaaagtggaggttgcattcagcagtcccagcagtccccatccatcacatttgcgtggcgtcatatttcctgtgtcacaggctgatgtgaagcagccctcaagaagggacacgtgggcttgagtctcagtactgctgctcagcctggctttggccccatcaccccacttctctgtgctttagtctcctcatctctaaaacggaaataatccggtccacttcctaggattgtatcaaggattgagttagcacattaaagcgccttgaacatgctgggtgtgtggcaagcactgtggaagtgtttactgtgcacatctcacctgctgttctctgctgacccagttcgcctgcccagaactaaagggacaacagtgctcaagcctagtgggaagttaaggttgtccagaatacggggcttagaacctatgtatgtgtctatgtggtgactgttaggaaataaaaaaggcaaaaagaacactgaatggactgtttactggtccctgtagaagggatagaaagccaaaagtctgggtcacatggacagaaatccttttgtttctaagcataaaataaaatttctacagctgtacttcctttagatcttggtcaaacacaatcaggcttgttcttaaaatagttgtttctatgagggaactttcccctctgaatcttctttgctttttcatggaattaaataaggattttagagttgggtaaacactgacaattgagaatttgaagatgatctgagcccattcctcgagttttacatgggagagattcaagccctacagaaattgagtgacttataaaggctacagcgattttggatggctgtggggccaggaagtctcctgattctttctaccatgtgcctcttggtgctgaggctggtgattgctcgagtaatagctttctaaagtggtgaaagtttacgtgggactccaagtcatgatagtgacttcccagcagaaggaaatgaagaccaaaggccagtgtaaagtcaagagtgtaagaacaaacagagttcagtggaggtagagaaatgagagagtacgtgctccaggagaccaggcctgagtgtcccatactaggaggggagtggaggagaccagagcacagcaggaagcccacttggctcaccatctccgtgcttgctgtgtagcacaaaagagggaataatttgatgacacgcatagtgctaggtgtggggtttttgaaaaattgtggtaaaagacacataatataaaatttaccttatcaaccatttttaagtgaactaggtaagcctttggtagataatatttgttcttctctctgttccactagccttaaagttttctattgtgtagagacaccattctttctggttttctttgagagagagtcttgctgtcacacaggcaggagtgcagtggcattatcatagctcactacagcctcaaacatctggcctcaaatgatcctcctgcttcagccttcaagtggctgggactagaggtgcatgtcaccatgcctggctaattacaaaaattttgtggggggatagagacagggtctcactaagttgcccaggctggtcttgaactcctggcctcaagcaatcctcttgccttggcctcccaaagcgctgggattacagttatgagccatcatgcctggccaagaaaccattcttttttttttttgagatgcagtcttgctctgtcacccaggctggagtgcagtggcgtgagctcggctcactgcaatctctgcctcccaggttcacaccattctcctgcctcagcctcccgagtagctgggactacaggcgcctgccaccatgcccggctaattttttgtatttttagtagagatggggtttcaccgtgttagccaggatggtctcgatctcctgacctcgtaatccacccacctcggcctcccaaagtgctgggattacaggcatgagccactgcacccggccaaaaccattcttttagttgacacggtacatactgaacttgagaccacaatagcttattgctctgcagttaatatctcattgacagccctccctacttagcccccaccaggcacctgtctgcttggatgattatatttactgttattacagcaaaggattacagtgacaattacttgcttctagcaatccccaggaattgcttgtcaacactgaggtcattggaagctgcagaaaccaaagattaatgtgctgttcttgttgttcccttggatgtaaatactgtttttctctgctatttagagctgactagcctcactcccaactttactgcccctaattggtggcagtgagctgtggaaggattactttcttctgtgactattcacaggtcatgggcggcaactgtgggctcatcctggtccctggtctgctctgtagcttagaacaaggcacttagttctctgagctccagtttcctctataaatataaactagacagtctcgaaagatgtctcctgttccgcacttttatggtcctttgagaaatatagtctggctagacatggtggtgcactttcctgtagtcccagctacttgggaggctgagacagaggatcattaggaggtcaagtccaaatccagcctgggcaacacggcaagaccctgtctctagaagagaaaaagaaaaacaagtatcatctggaggattcagttcatttcattacctgttttttgactcagactaatatgacagcagaaaggagccttgaaagagtgattcctacttcttgtttagcaagccaggccctatggctagaatggccttttctcttgtcaagtagttcttcttggttcccagcttcttgtttattgctgcctgtggtctgatcatcacttgaggcattttcctgccactctctctcagatgtctgtcagttaaaacaaaagatactacctggggacagggctggcttcgttggcacttgcacaaggcccttagaaggacacatgcttggtgtaatgctctgatgacatcatcttgaaattcacagtgatttttgagcaggaggttgatttggtgctagatgctgtaaatgatgtagtggtcctgcctgtagaatccacatccctattgcatttttattacttcagaaactatatatatgtttgcacttgaggataaaatgagaactgtattgtatttgagaatgaagtatgatggcagtcaagagctgcttctttgggaatgagtgattatgtggttgttcccacagatattctaaagggaaggactgagaccctgaagccagacccccacctccgcaagagtccctcactagagtcactgagcagacccccgtctctgggctttggggacacaagactgctgagtgcttccacccgggcatggaaaccacaaagcaaactcaggtatcgtgtttcaaacaataagaaatcagaaaaacatcgggctaatcaccttttattcttccttccgttttgtccccgtggccaatttacttctacaaatatttcctgcatgaaaatgactaagacactgtgcctgcccttggtgagtctaaaaggatgacagtggatagtagtagtgcgcaaaatggaattaagggctgtaaaaaacaatactgcataagcaaagtcttgagaggttgttagttggatcaagaagtctagagagaagtggtgtttctgccaagggctctaaaggtaccattacaagcacgctgtggaatagtgatcagggaatgtgggtggtgtcatgtgtctgaactagtctgtgggcttcctgagagccgggactctgctgtacatatgcataacaagctctctgtcagtatttgttgggtggatggataagtgactaggacattccatctggagggcatattgtaagtagtcttcattgctaaggaagaggtttgtgcattattttggtaaagcactggagtaccaccaagtttgtgggattttgtttcggattttgaggttgtacagtgagattggacctgcattttaaggaggattcatcagaaaacagtggtatataaggattgaagaggcattttgaaatcagtgtttaagaaggactgtcacagggatgtaaaggaatggttggcagagggagaggatggcaagaccagcagggtggtcactaagagcttgtctttgttcccacacctctgtcacctcctccctttccagtgcccctggtcgcccaggccacagcaaacctctttcagctgcttcctctccccttgtgacttccctgcttctctgtgttggttaattttctgatgcactgagcacatcctgctgcagaccttgcagaaatctcacatgactctgtcatctgcactcctcatcctggtcttctagatgccccacaacttagcaccaccccacccacctgccagaatggccctgttcctccctccacctgagcctgttttagtttctgcctttgtaatagaacatgaccatgtctgattgcaagtctttatgtataaggttctagcctgaatcgtttttcttttctcctttcatactccaaatactgcttctccttcaaggtcaaacctttcatgaagttgtacctaacacctggcacattgacatatcccttctctgactttggcgtcttacacttttttgggtgtttagtttttgtactgctttgtagtgtggaacactgttgcacagtacatgccattgtctccatttatgctataatttagttgacagtaaaagttcaacttacattttggtatctcttccagccccttgcattgtgcaacacacatagcatttcacttagtaaaacttacgagtgagtagatggattaatatacaaaattggctagtttaggagtaatagctttttaataaatcttataatcacaaatatgggtattatagaaggatttataaaagtctgaataaattcaggtcttgttacacctttgggtacagcatatatttggacccaaatagatgaagtcatgtgtttcagaagtttaatgtaaagccccagatactacatattgtcctgtttatgtgcaagagatttaaataatcaaaagaggttttaaggaccagaattagtgctgttctgaagttgccgttttctttatgccagaaatgcatacaaaaaggctatatgtatatgaatatgctattgatattttaccttttttaatgaaaagttaaattagtaaaattcttatttcaattttacacttacgttattgacataaacaatggcaagatatttggtgtttttaatatgcccttccaatgcacctttaaaatttattttattttattttttggagatggggtcttgctctgttgcccgggctgtagtgaagtggcacagtcatagtgcactacaaccctgaactcctggcctcaagcagtcctcccttctcagcctcctgagtagctgggattagagatgcacaccaccatgcccagctaatttttttattttttatttttttaaagatggggtctcgctatgttgcccaggctggtcttgaactcttgggctcaagagatcttcttcccttggctcgtaaagttctgggattatagatgtgggccactgcacccagccaatctaccttttacatgttatttaggtactggtttagtcttgaaacatgtagggtgtgttttgtttacgtatctttaattcaaatgatactgtacttaagtaaacaaatgaaagactagatggatgagcaacaaatggatttgaaaacaaaatgtaacaaaactctccccaaatttatgatagtcaggaagcacaatttaatttttattttatactgtgagatatcacaaaatagtaatgtgactaattcggctgtttctttagaatcttgctggataaactagacttttgcttttctaaagtaggtatttatttcttgtgtatttgagaattctaagtattagcatcttctccttaccatgtgctcttctttctaaccagtgtggaaagaaaagaccctctggcagccttggcccgggaatacggtggttccaagcgcaatgctctactgaaatggtgccagaagaagacacaaggttatgcggtaagggacaacatcagccaacttccagctgcccctgggcagtagtagtcctgtgccaatacatgttccttgtgtgcctgtgcttgatgggccaatatgcatgtaattgtcatctttctattctcctaggcagggctgccagggaatgtttgatatttgtgcactgcccaaaggcaccgtgacagaggcaaatgcaactgaaaaacggtctgcactccacccaccaaatgtatggctgcacgcagagctgcacctcccgagggaaggggacctttttctttggtcagagtgttactggccacaggttcttgggctgtcaatgcgatagaaattgtcatgaggccaaaagagttttctcaacaaggctttattggagcttatgcccttatccctcaggcatgagggaggaagcacgggagagggaggattctctggctgactccttgaaatgagctggtagggatttttttattaagcaaagtgcaggaattgatatcaacatagagaatgtgggctgggctgggtagatcatatgaggggtaggggatgtgggtcagtttatctgctggcgacggttgtcttgagtcatgggccacctagtgttctggttggtggcagcaaggctgtaaatcagttgtttagcattcttccctgagatgaggacatttgcaactttggttggatatgttggatttcctagggccagtttctggaattatttaagtaaaagaattaaacattcttttattcttttaaacattatgagagtgcggaaaaacagtatggctattttctttgcatgactgttaagcaggtatgtcagtgaagtagtggtgtgggttttgtgatcagtgggaatgcatgaaagaatgctatagtggggatgagctgaagccaagtcctgtccctgctgtctcagaagaagacacaagctccagtggctcacgcctgtaatcctagcactttgggaggccgaggtgggcagatcacgaggtcaggagatcgagaccatcctggctaacacagtgaaaccccatctctactaaaaatacaaaaaattagccgggcgtggtggcgggcgcctgtagtcacagctactcgggaggctgaggcaggagaatggtgtgaacccgggaggcgaagcttgcagtgagccaagattgcgccactgcactccaggctgggcgacagagcaagactccgtctcaaaaaaaaaaaaaaaaaaaaagcagacacaagctccccgagcagtgatgcctccacccaagaagacagcttttgctgaattaccctcctgaagaagagtgctttgcctaattcgcataaaggtcctatgtagttgggcctccaaaacttctccaaacattttgtttctattgttttgagaattgtttgcgtttagtttaagagtttttgttttctaggacagtatctgttttctgtgaatatcagaaaagggaagtaatacctgatgtaagtttaagtttttttcttgtgaaatacacaaagataaaatgcacaaaatataaatcataatttcttgaactgtgaggaagtgaaaagtcatgcagtcaccactcccatccagaagaggagcatcaccagctcccacagacccttcctatgactttcccatcatagccctcagtactccctaagataaccattgtcctcaattctccttccagatttttacaaaagtatgcatccgtaagtactatgttagtattgcttgcatttgaattttattacaaatggaataaaaaactatgtaatatttgcagctagctttttttacacggtattgagtcagtgagatttatcctcattgttgcatatagctgtaatttgttcattttcttcaccatttagtaacccattgtaggattataccattatttatccattcgattattgatggagagttgagtcatttctagtttggagctattatgaataacgctgttatgttcttgtgcgtatttcctgaaaaacatatgtgctcattcctgctggatacatgcttaagaatggaattcctgggccatagggtatgcatacaatctagtggatagtgccaaacagatgactgaagtaattgtataatttatgtctctccagcaatttatgagagatttatttctctgcattcacatcaacacttggtattgtcagtctttttactcaaggtcatgtgggtaatgtgtagtactgtctcactgtggttttggtttgcattttcctgttggctggggaggctgaacaccttttcatatgcaaatagataccctctttaaaattggcaattcctactgcattcttaacaatattttgctaaaatttcggaagattccagcaccgtaatactcccttcccaggctgaagcttttgagggaggtggggatggaaaatgaaagaagctagcaagaaaaacccagcctcagccaagatccatcccagatagtaaattagcagggctgggagtctctgtcatgtcagcagtcagatgtcttaaaaccagaatctacccagagtatgtgtatcctgtatctttgccattaccttcttttcactttatgttaaaaaagaaaaagaatcgcagcactttgagaggccgagggggcaggattgtttgcgcccaggagtttgaggctgcagtgagctgagatagcaccactgtagtgcagtgtgggtcagaaaaaagaaaagaaaaacctgtcatgctactgaccaataatagaggctcccaaagtataaactcgcctcagacccttgtttattcttcctgctaccctgtccactctgcctctgccctgtttcaaggatggaccatgccatgaaggaaggcctcttggttacagcctcccccagcccatcagccacgctgccgaggacacgggaaagaataagaagccataagaaccaatagctatgacttcttattctttcctgtgtccttggcagcgtgactgatgggctggggaggctgtaaccaaggggccttccttcatggcagttgaacaatgtgaacacttggacacaggaaggggaacatcacacacgggggcctgttgtggggtggggggaggggggaaggatagcattaggagatatacctaatgtaaatgatgagttaatgggtgcagcacaccaacatggcacatatatacatatgtaacaaacctgcacattgtgcagatgtaccatagaacttaaagtataataaaaatatattaaaagaaaataaataaatatcaagaaggagaaagaaaaaaaaagaataagaagtcagagggaggcagctgcctgcaggaggtttagcgtaaagaaaataggaatggtgatgggaaattgaagaaaacatttaaaaagagctgtcattcaagaatgactccactgatgccgcctgtgctgttccccacctgacagtaatggaccaaggcagctgccagagtgcatatgaaaagacaattcacgttttcagaaggagtggccttctatgatgtaaccttgttgtaatgcagggaagagacagacaataagatgtttccagtcaggatcacaagaacactatttcctgctggagtgatttgtgtgtgtgtgtgtgtgtgtgaacattttggattcgttttcaaaacattttacgtttgatgaaacccaaaactcattttgcctgtagtacttttcattcatcatgaaatctctgtaaaattagaaatatgaccatgtgtctgctttatttacccttcacaaaatatgtctagacctgtttgtctgagacacctcatagtcttgttctctcagaattaggaagccaaaaataactggtgaaaactttttgaaaaccgggaaccatgtgtacttgacttaaaataactttccttttatttcatcaaaatacagcgtgaaaggttatgttacatccctccatatatatatatttttatttcagctttagttatagattcagggggtgagtgggcaggtttgttacaagggtatattgcttgatgctgaggcttgagttatgggtcccgtcacccaggtagtaagcatagtactctgtaggtaggttttcaactcaggccttcttcccttcctcccttgtctagtagtccccagtatctattgttgccatccatgtggctttttttggagacggattttttttttttttttttttttttttttttttgagacagagtctcactctgtcacccagtctggggtgcagtggcacaatctcaggtcactgcaacttccacctcccaggttctagcaattctcctgccttagcctcccaagtagctgggactacaggtgcaccccaccacacctggctaatttttgtatttttagtagagacagggtttcgccatgttggctaggctggtctcgaactcctgacctcaggtgatccgcccaccttgacctcccaaagtgctgggattacaggttcacacctgtaatatacataaagggctactggatacatatacataaaaagggccactgcacctggccctttatatccatatgtactcaacgtttagctcccacttataagtgagatgtggtatttggttttctgttcctgcgttagtttgcttagaatagtggcctccagctgcatccatgtttttgttcttttatatggacatgatttttgttcttttttatggctgtgtatttccatggtgtatatttaccacattttctttatccaacccactgttggtgggtacttaggttgattttatgttttttctactgtgaacagtgctgcaatgaacatacgagtggtagaacgacttatttttctttgggtatatacctagtcatgggattgctgggtcaaatgttctatttttagtaccttgagaaatctccaaactgctttccacaggggctgaactaattttattcccaccagcagtgtataagcatttctttttctccatggcctcgctagcgtctgctattttttggctttttaataatagcctcctggctagtgttagatggtatctcattgtggttttgattcgtatttctttgaagattagggatgttgagcgtgttttcatgtttattgaatgtatatatgtcttcttttgagaggtgactgttcatttcctttgcctattttttaatggggttatttggtttttgcttgtggatttaagttcttatagattctggatattagatgcatagtttgtgaatatttcttcccattctatgggttgtctgttaactctgttgatagcttcttttgctgtgaaggaactctttagtttagttagattccacttgtcaattttttattttgctgcacttgcttttggggacttagccaaaaattctttgctaaggccaatgttgaaaaagttatttcctaggttttcttctaggatttttatagttcgaagtcttatatttaaatctgtaatccattttaagttaatttttatatgtagtgacaggtagaggtctagtttctatcttctgcgtatggtcagccagtcatcccagcagcatttgctgaatagggaattctcttcccattgcttgtttttgtcaaagatcagatgattataggtttgcagctctatttctggatactctaacttgtgtatgtgtctgtttttataccagtgccatgctgttttggttactgtagccttagaatataacatgaactcaggcaatgcgagtctccagctttgatcttcttacttaagattgctttggctattcagactctgttttggttccatatgaattttagaatagttttttctaattctttgaaaaatgacatttgtagtttgataggaataccattgaatctgtaaagtgctttgggcagtatagccatttgaatgatactgatttttccaatccatgagcatggaatgtttctccatttatttgtgtcatagctggtttctttcagcctccttccatatattgttcagctccaggtaatattgtaggtgctgggggccgggcgcggtgactcacgcctgtaatcccagcactttgggaggctgaggcgggtggatcacaaggtcgggagatcgacaccatcctggctaacatggtgaaaccccgtctctactaaaaaatacaaaaaattagccgggcgtggtggcacgcacctgtggtcccagctgctcgggaggctgaggtaggggaatggcgtgaacccgggaggcggagcttgcggtgagccgagatagcgccactgcactccagcctgggcgacagagcaagactccgtctcaaaaaatatatatatatattgtaggtcctggggattccacagtgaatgaaacaggcaacagtccctgctctcatggaacttaaatcctcatggggtctggcagttaactgaaataaaaggtaacatatgtacggtatttgaaggttgtattgccgtggagagaaataaagcagggaaggagggttgggaatgttgggtgaatggtacaatttatacatagtggtcagggagatgacatttgagcacttgctcccctctcttgaagggctttggtgtctgcatgaagctttatttcccaccaaggcctaggtgtggagggtcagagtaaggaggtcattactgtcgttactgtgccaatagaagctgaagtgacacacggtggtcgacccaggtcagcagcactgggaagtgagcatcgcagccagacccacctgccgagctccgggccaactgcctgacatctcgagtggcccaggattgagacccagtgaaaggatgtgagtttgccctcactacgaagtgaggcccagttcactaagctcaaaatggcgctcctaggaggcccttcctcacattctgctcaactcatacacactggtgtctttttggaataagtcactcctggaaaggccctctaaattactctcagtcctcaaatttcatactcctgatgtgtgttggctgttttccaagccaagggcaggcctgactcagataactcctacccctccctttctttcatctgaaagtctagtttaagctcctagttttctgttacgatggagagatttccatttgtaatttccagtaagaattctgaagggacagaaagtcgggagggtaggtgtgacaggaagaattctgaagataacccccatgactctccatggtagaatgtcctcctctttatatgacacagggagatggtctggatatgcccactaatcacaaacccctgtagaagccaagtgatgtctctggcttgtggcagaagttggggaaattcaaagcatgagaaggactctgattgttcttggtggtttgaagagggagggggcacgtgagaaggagccaagaagggccccctggctggcagccagcaggaaacagggactttctagcactaaagcattagtgctgaggtcctggccgtgcccagaaattgccatgtgggtgctctggagttttgaggttgacaactgcaagttgtgtgtagtgccaccgggtcctttgtctcctcctctgtcctgatgccctcagacctcagccaggccagggacgctcagtttgctttgccttctgctttccctcagctgggggatcttgggctggaagtcactctgatgaacatgtggaattcagctctaagtctctcctgagtcctctgttacctcccaggaggcatgatgaggcacagctacccttcacctccatgggtggcatgaagatacttgcaagtatcttttagacgaaaatatataccggtatttactgttacttgaattcctgtttggttcttgcatttcagatcaaaagaaagaagagtttagatagggatttacttgaaaatgtatctgtatctgttccacttttgaaattgtatggcaagaattcagatagcaggcgacacctacactatcattaagggacagatgacgtctttgaaccaggttttaacctgttagctcagacctatatcttcttctcttttggagaaaaaaaaatcagtctttgtgtgtccacactgaattttgctttgaatctggaaagaacacccatgttgcaggcaacttctgttgttctgtctctgagttcccacaaacaagcactaaaatctgcttagccaatagcaagcagcctctaaaatatcaggtcacttggggctctgtttcttatattcttttttgagacagatctcttgaaggctacacgcacaattcaaagaacataaagcctttgatttatttactgccatcagagtggtcctttccctgacttagatgatagagtctcaatagcagatgcgcggcactgtgggcttccactctattgaggccttttctacccactttctctgcttctgtaccgtttctgacacagtggtctgtgaagacattttcagtggcacaggtgttgtcctacaacctgtgacaacagtggagtttgtttgcaaaataaagatgcaaggctttcccatgttgtgggagacacagtcctctcctggtggccgtgtttctggttggttttctctcacgagccagtgtgctgtggggcacccgctcccactcccactctcagtggtgtgtgcatgcccagaggtatgaaacttcaaggaataaaagtggctttctgaacaaaaatatcaaagtgtgtagagacctgtcagactgttcgcacagcagatggggagggacacgttctcccaccttagtctgcacaaacaccgaagaagcagccctgacaagtctaagctgggcacatccccaattccttgggaattttggaaataaaactgagaaagattactctaaaatataaagcccagatgctattggcagccatgtttttgcctctgtgcaaaaaagacttaacccagtaggcctgggacggctctctttagcaaggctgcttgcaaggctggcccttggctggcgtctgggaactgggattacaggagggttcccattgtttccagaactgatgagaggggctcacggtgctgaaactgtttgtgcaaacacatggtatgtgctgaacagcagctttcctttggggagtctggaatgtagtatgtgctgggcagaaggggctggatgctgagtccctagtgagcttccctggttggcagcattttttcttgagatggggtttcagtcttgttgcccaggctggagtgcaatggcaccatctcggctcaccacaacctccgctcccgggttcaagattctcctgcctcagtctcccgagtagctgggattacaggcatgtgccaccacacccagctggtctcaaactcccgacctcaggtgatctgcctgcttcggcctcccaaagtgctgggattacaggtgtgagcccctgcacccggccggttggcagcatttcacacgtgttgtcatggcttgttgccaggggaattaaacatgtccgtgactgctggagagaattcttggaagcacgtgcctggtttcctcgggacttcctgccctgtgccttttccctttgctgatctggctttgtgtcctttcgcagtaataaatctgtgaatagccgtggccatgactccatgctgcgtcctgtgggtccttcccctgatcattgaacacgggctttttattgagccttaaaaaggagtaaggcactgacacaggctgcagtatgaatgttccctgaagacgtgttgccaggtgaaagagctgggtgcaaaatctacatcttgtatgagtccatttataagaaatatccagaataggcaaattcacagaaacagaaagcagatgagcggttgccagaggctgaggagagagggcaatagggactggagtggctgcttagtgggtacagggttttctgttgggtgatgaaaatgttctggaactaggtagtggtgatggttgcacaacattgggaatgtgctaaaagccactgaactatacactttaaactggtttaaaatggtgaaagtgatacattaattttaccttaattttttttaaaaaaaacagtgttatgaacagacacgatagctcatgcctgtaatccagacactttgaggggccaaggcaggaggactgctgagaccaggagttcaacaccagcctgggcaacatagcaaggccctgtctttaccaaaaaaaaaaaaaaaaaaaaaaaaaaaaaaaaaacattagccggctacgatggtgtacacctgtgattccagctattcaggaggctgaagacagagacttacttgagcccagaagttcaaggcctccgtgagctatgatcacaccactgcactccagcctgggcaacagagagagaccctgtctctggggaaaaaaaaaaaaagtgtgccatgatgatgaatatcacttaccatgcatttttatgcttatgctaaatagttgtgaaatagtgccaaatttttgtaaagtaagttcctagaagtgaatttgtttttgcaaaagggtgtgttacactttccattttaatatatattctcaaattgccttcattaaggttatttagtttacacttctctatacagtgtacaagattatacattcccaatactggatacacctactcttttgatctttttcagcctaagaggagaaaatggcatttcttttaatttttcattgcagatgaaggagaagcactttttatcaacttgttagttatttatatctttcttctgtgaattactactacagttgctttgcttgcttttctatttgtatgttcatcttttttcctcaaaatttgtgatagctctttttggttttcttttggtttttatttttatcaaagctctgcatgcccacaatcaggtatgcagagatcctgatgagcaaagcagtcagccggcctgagagctctgcttcctgctccccagagtcaagcattttcaagtcaccttgctgattttttttttgtcatttacctctacgttgctgactagcacgtttatcaactgctatttctagtttttcattttagatgttgtattttgatctcctactgtgaaagatgagggtttatttctttttcactcccaccccccccatgcttcctgtctttgcattctttcatggttgtacatatctggagttcacattaagatgctgtgagtgtcattcatagattagccatgtagtagtatacactgctgcagctttttcttttacacaacctgttacttgccttacacttaaaatcgtcttgtttttgtctgtttacttagttttgtatgtaaatgatactcattcaaccgcaactcttcatgagatatccccacacatcacaagggtcaggggttgcagctgtgttatcctgaggagatctctctggagcctctgacctcttccatcatggctgccctctatgcctggtgcacagagtccctgttagttctttgcctctctcttttttgatcttctgtatcctacatcctattcttttttttcccctttgtttttttttccctttgtttttttttcccttcagtatctccctgagaatgagttcatagatggtaaaattttatgacctcgcatctttgttttaccctgatgcttgatggtttctttaggtataagattttaggtcagaaattattttcattcataattttgtgggcatcgctccattgtcttctatttgccagtgttgcagcaagaaaagaatgattacagtcgtttgtgatttttttttcctctgcaaaagctcataggaggttctggttgtctccaggattctaaaatttcagggtgatgtgccttgctctatagcttaagttttgtgttttctatcatgctaggcactcactgcaccctttcaatatgtaattcatgactttattttctggaattatttcattggtaatttcttctactctgttttctttttctggaaatccccctggcctggccctctaattatcatattctttttttcccctatttctatctctttgcattacagttttgttttctgggaggcttccctaactttaatcttccaaattctattaaatgcttaattttgcatttttttttttgcttttgcatcatttcaattgttttttaattgtgaaatgtacataggataaaatttaccatcttaactatttttaaatgtacagttcagtatcgttgagtatgttctcattattgtgtaaccaatctctagaatgttttcattttgcaaaacttaaattctatacccattaaacactaatctgacattcccctcttcccccagcctctggcagcagccattctactttgtatcactatgaatttaaccactttaggtaccccatataaacggaatcatacagtatttgtccttttgtgtctggcatatttcacttagcatgatgtcctcaaggttcatccatgttatagcatgtgtcaaaatttccttcctttttaagactgaataaaattccgttgattatatttgctatcatatttttaacttctaggatttcttttttattccctgaaattttttatagcatcctgttcttgtttcacagatacaatgttacatatgaatttcactgaggattgtaggttgattttatcaccaaatctctctatgcagattgtttcctacagtccctttattccattggtatctttaggtctctatctttatgctggaggtttgactgctcatgtttaggtggaggctctgcaaagctgaccccctccctggcctgcgtatgaggcctgcgactatgttcctgtggcatatccatgacgaacttctggtgtcagtgtctttaggtggtccttcctcttgggcacatccattctccagagaaaggccttctagtctcctgctggaggacatcaacctggcaaccagaattgtgggacctaatcagaaaagaggcctgtgggccaggcacagtggctcacccctgtagtcccagcactttgggaggccgaggtgggtggattgcttgaggccaggagttcaagaccaggctggccaacatggtgaaacctcatctctactaaaaacattagtggggcatggtggtgcacgcctgtagtcccaactgcttgggaggctgaggcatgagagtctcttgaacctgggaggcggaggcgagatcgtgccactgcattccagcctgggtgacacagcgagactctgtcaaaaaaaaaaaaagaagaggcctgggggtggagagtgactacctcagccctcaccatgtaaattcacttaattcccttgttttcactgcatcactcatgcctccactgctcactgtcctctgggtgtgcacagaagagagaacgtttggagctttggctgctctataaacagatctccaacccattcttcctgtttttaaccaccttcattcccccacctgaagcacctcttgccaccaatttcctgtgtctttgagggattttgcaccataaatcaggttgggtctttgcccttcgccactgctggcctgggatttagtttgcttcggtctgttatgttagttatctcttgtccattgacttttcagctgccaatgttttgtctttttgctttctttcatgttccctttttccttgtctgttaatgcctttggaggaaaaattcctttctgtggttttctggggcttcacgagggggtgagattgtgaatgcatgcgtttcattgccatcagcctggaggcctcagagagctttattcctttctccttaaggatattaaccattatctgtcatagaggttccaagtaccctttacatatatactatattatatacaaatacacacacccttttgttccttctggagtgcatttgtgtttgttaggtcaagttttatttttcccccagatggatggctatttatttcagcatcacttatttcatcatctctcttgaactaactgataggcctaggtatgaatgggaactgagtggtgtctggacttgctgttcccttctgtgcctctgtgggtctggcctctgccacaggttgctgccgagcagagaaatgagagcaggacctgagtgcggcacagcgccctgggcctcagccagggtcctgtgagtgtcagtcagtgctgtggcatgcgttgttttgatgaatttaatgccctggcatttttcattatttgattatacttgttggttttctaggtaaactattacacataacaatagttttgtttcctttttttcttttttcttttttttttttttttttgagaggtagtctcaaaaaagtctcggctcactgcaatctccgcctcccaggttcaagtgattctcctgcctcagcctccctagtagctgggattacaagcacgtgccaccacacctggctaattttttgtgtttttagtagagacgaggtttcaccacattagccaggatggtcttgatctcctgaccttgtgatccacctgccttggcttcccaaagtgctaggattacacacatgagccactgtgcccagccttgtttcttctaatatttatacctcttgtactttttttggtttattgcattcatgaaagtccaggtcactgttgaataatgctattgatggtggatattcttgttttattttctgttcgtaataacagaaataagatttaataatattattaaataatttaataataatttaataatcacctaaatgagattcttgtattgttttgtgataaatactctatcaactaaaggaagcttgcatctgttttgagcttaccgggggatgttttaagtccagaaataggtaagaattatatcaaattcctttttagcttttaatgagctatccatatggtttcttctcttttgacccatttatgtaattaataacataaatacatttactagtaggggaacatttgtacatatctgggggcaaaattccaacttggtcatggtatactattcctgaaggaaactctacttgattgtggttattctttaatgtgaaatatacgattttttatactcagttattgatgagacatttggcttcttgttggttgctttggtataaatgaagttttgtctcaataaggcctgtttttgtttttgttatgatgttagtgagctctaaaaccctgtatcatctgtatatagtaaaaagtgcaataggtatttattttaccaccttctgtagtaggattaatgacagaattaattcttagccaaagagaatgttttatactctagttgcaaagttctgtccagtctgacaaatgaaaacctgaaaaccccaaaaatgttgttgggtagaagttgggaaacctttcatttaagcttcagacaatttttgtgaaaagtataagagtgaagacttaacatttttcctggaactgatgctcttttgttttgatgaaagtcctctgaaaggacttgttagttgcatagaggtaaggctaggcccctgcctattctcagggctcaaggcctgagcagccgaaggcccatcagtggtcccagttacctcagtgggagctcaagtgtcccctgtccccatgtggccacttgatctgctggattctgagtcaggtgtgttgaaatctcttactctgactgtggtttgtgtcaaaagctttgattgctgagagattatgttccagatattttgaaccatacgtaaaggtttcttgttctatcttcttggtggtttttaccttttacttcagttaatccttttgatctagaagcttacattttatataccaatattgctatttccatttatgttttctgtgcattttatgttttgcatttatgttatttgcatgatatatctttgtactttctttcctttcttctctttttttcccccagagttggagtcttgctctgttgcccaggctagagtgtagtggcacaatcatagctcactgcagcctccacctcctgggctcaagcaatcctcttttcttagcctcctaagtagctgggtctacaggtacatgacaccacacctggctaattctttaaaaaatttttttagagacagggtgttgctatgttgcccaggctgattttgaactcctgggctgaagagatcctcccacattagtctccccacttagctgggattacaagtgtggagccactttgcccagctcctttattttcagcctttcttagttggttgtttcagggttatgtcttataaatagtttggctttacatgtaatctgaaaattcctctaacagggcagcttagcctgttcacattttcttgtggctgtatgtgttttatcttcttcctctgtctcactttctatttttagtagacttctcttgctggcttccttcttactgattcccaggcacctagcagcgtggtaaggtgtgtgagttgaagaggtggaaaaacccaggcctgagactctgaggggtaaccacagtggaataatcataaagtttaaagctagagtctgtttttgttaaactggagcagaatcataaatcaaacacattttaaaaaatgcagagctacagagccggctgcattagtgagaaacagccccgtcggcccctttggggtcagaagtcagaattggaggcagggcctgggcccagttgctcttgccagggctgctttctggggtagaatggaggaagagccatgggcaagggccaagtccactggccactgtcaccaggggagcagcccgaagtcagggccgtacctgggaacaagaaggactccaaagacctggagcagatctggagcactgtgagttggaggagtcgggctcggatagcagcctgcaagggtgagggtgctgagaaagcaagatggacagagagggacagatgtggcccattcagggatccagaccagtgtctcatggcatctgatgtctagtcaccagcatgcatggggacatgcctggacacttgggctgatgcttctgcatgactgagcctcacggtagcagggtgcccctggacagaaacaaccacatgaccaagcagaactccttagcagccatttaaaaggataactggaaactctccaacctaattgggtaagatggcttaccaatttgctaagtagggcatatgcttaaagtactttttaaactttttttttaaaatgatgctgctaaatgaaagtatgtttaatttcacagggaggatctgtttttgccaaatgaagttcacttagctccttttattggtgctttggggaagagggggtgtggtctgtccctttagccttatagttcttgatctggtttttctttttttcttttttattgtaaaatacacataacatgaaatttatcattttaactattttaagtgtacagttcaggggcatgaagcacgttcacatggttgtgcaaccatcactgctttctatttccgaaatgttttcatcatcccaaactgagctctgtatgctttaaacacggggtaggggactccatattccccgccctcagcgcctaaccaccgttccgcttcgtctctgaatttacccattctagccaccttgtagacgtggacttacacagaatgtgccctttgatgaggggctgatttcactcagcacagcgtcctcaggcccacttatgttgtggcgtgtgtcagccacgctgcttctgcatccatctgtccaccttctcctctccatagtccccaccccatcctgggtcaggagttgtgatttttccttgtgtcttccagaaccaaagctgggagatcgcctgctaccatggcttgaaaacccttaacgactctgcagccagcagagttggacccatattcctggcctgtgtgaaagaccggctttttttaatgggactatttagctgtattatttgtcctcccttttctcagaggtatggaacatagctcccctccccaccctcaccacacctacctgaaaaacgggaagattagatccaccatgtccttaaggaaaagaagagagtgttttgattgccaacaatttgggctccaggcttctgtaagtcatcaaggtccatattggagaattagaagcaagagggtaacagaggcagaggataagagcagaggcttaggttgagggagagcagaggccagcgcccttggatgtggtggccgggggctgagaggtggaactgggaagactggaaactcagccaccctacaggctaagggcccacatcctccctcttctgacctgccaaattcctacaacatgcaggagaaagtgagggaactaataaggtgagcttattaatctggttaaaggttcttggctgggcacagtagctcacacctgtaatgtcaacactttggaaggttgatgcaggaagatcacttgagtatagaagtttgaggctgcagtgagctatgattgtgtcactgcattccagcctgggtgacagagtgagaccctgtctctctctctctctctctctttttttttttaaaggttcttaccatgagttagcctcgtcttctgacttcccagggtcatttgaaggaagcatctgcatcaaaactgccaatttacactttaaaattttttatataaatgttagatgttttgccagcttcaggaaggaaaaacaggattttcaaaataaaatgttataagaatgtgtcatcctcctggggactgagggtgatttaagtcccttggtcttctttcctcccatgggctgtttgtccccagctgagggcctccatgggtcaagtatgccagcagctgctgctgcagcataacactgcccaacaccaaagccatcatcttgtcaccattcagaaaaaggaggccttgatttttgctgctgttccttctccatcccccaggacagcatgtgagtctatttagataatcacagtcccaggtgaatctgcactgagcattttttccattctcttactcgtgaaatgttcatttgggaaaaagaagtaatttcatggcaagacacttatgatttcacaggctgaattcagtctttctgagggtagaaggttaacggagttgaaggttacttttctttctttttttttttttcttttttttttttttctgagatggagtttctcccttgttgcccaggctggagtgcaatggtgcgatctcagctcactgcaacctctgccccctgggttcaagcgattctcctgcctcagcctcccgagtagctgggattgcaggcatgcgccaccatgcccggctaattttgtatttttagtagagaaagggtttctccatgttggtcaggctgatcttgaactcccgacctcaggtgatccgcctgccttggcctcccaaagtgttgggattacaggtatgagccaccgcgcccagccttgaaggttacttttctagtataaactaaacttgatcttggaacaaaattccttataatcaatttttcagttattgcatattattttcttagtacaattctaattctgctgactacagagtcagaaagggtttaaaaaccatggtgacaggtggtctcccagccagagctgtggttttggaagacatgaggaagaccacaactcctgaactaggatgggggttgggatatggagaggagaaggtggacagatggatgcagaagcagagtggctgacacacgctgcaacacagatgggtctgaggatgcttcagtgagtgaaatcagcccatcaccaaagggcacgtgctgtgtggtggaggaacatagtcgcatgtgtgttgttgggaggtggagtttaaggtggaagaacctctttgagggcaatttggcagaatccatcaaaatggattccacctgtgtgcagagaggtgcatgggaggacaattatcgcagtactgtttgtgataacagaaaactggaaacaacctaaacgggctgctgtctccatccatgtgatggacctgcatgtgtcgtcagagaacaaagtagcgaatggtgatggaagtaaagctagcagtgacaaaatatttaccacgtgaccgacattgtctaagtgcatctaatcttgaccacaatctcatgagttaggcattttgtatccattttacaaatacaaaactaaggcagcaagaggctccatgactgctcagagtcacaccctagtaagggatagagctgggactgaactcctgctgttgggcccagcatccagtcccttggtctctacactgaaactgttcatccagatgtcgtgaaggacctagctctatatatcttggtaagggtgcagaacatgccaccatctgcataaaagggggaaatacacatgcatgtttgcataagtgcaagacagcactgtcctgtagaaccctctgtgatgatgggaatgttctatatctgtgctggccaatcctgtagccacaggtggctgctgagcacttaaaagattcctaatgtgactgagaaatggaattttgatattatttaattttaactaatttaaacagccacatggggctggtggctgtcgtatggggcaatgcaaggtagaatatagacagatggatgttaaagaaaagatcaccggattttgtggtttgcaatccctacttttaaaaaaccttctgcagaagcatcattggaagaacgggtttcataactgtttatttcagaaccactaatttaatctagccacttcatttgagagatgaggaaacttaaggcagaaaagttgagtcactttcctaaagtcatattcagctgcgttagtgtgaggaggaaggagcgggtcacagtttggtttggtttgttcctctttagagcatcggacattctcgtttgccaggggcttcattcaatctgatgtcagctcagttcttagcatggccggtcggttcctggaaatggcggctttgggtgaaaccatgtgctgtaagccatgggaactcaactctggcccatgtcaattagcctgcggtgaaactggttttgttatacagcgtgtcaccatttcacttaatgttacagtgtccaagaacctcccaacattaagtgaggacttactataaaagaaagaaagaaccagacttttgtctcctgggctcccagaactccatgaggaatcttgcagtggctcgccctttcctgaagccccagagttcatcctgcctcctgcacaccccaggctcaggctgtcctgcctgcctgcaccacagcatgggtgaaccatggtaggaccatgcttccctgcggtgtactcctcagcgcctcacacatggagggctttggaaatgtttgtgtggactctactcccagcctcgagggctgaaccgctagtgagttgtgcagatggctcatgaggagatttctccaacatttccttgagggagctgctggacacaggtaaacactcagcaaggagcagaatggggcttcagggggctgctagtccactgagcctgggtgactccaggaggagaggagccagcagagctatgcatgaccatgaccttttttagaagcagcaagcaaggaggaagagtggaattaatgaaaatgaggtagccaacttaacagaaaggcagaagaggaaagaaaattccagggaagtgtttccccagaggcctgagcatggtcctaggggtcagaagatggcagggaatcatctgggatccgaggtgagggcacagagaagacctgttctcaggacgccaaggaagaactgggaggcccctgctgagccgcggggcttcgcctgcgttcgggtgctgtgtgaggctagcactgccagtggaactgctgttgggctggaggaagtggacccagccagggggcaggaggtgttggccgcaggcccatgcttgcaaggcaaccagaccctgtgtcacaatgccaaagccagttaacctcggggaagaaacgccgtgggtggggacttctgagtgtttgtcaagtgaaaatggaggaagcaagaaagacagggccccagctgctcctgagatgtgtatcttctgtgattctgtctccagggagggactgtgcagcatctgcctgaacatctctgggacacagccgtcctctcgccataggaaggctcttgtccacagaggagtaaagggaagggcgctgcttcctgcaccagctcaccgtggccgctgtctccattttcgcagtctcaaaccctcggtgctttcagtgtggataaaagagtgggaggaacatttaaaaagtgaattattccaaattagtctctaaatttaatgcaattccgattaaaatcccaacagactttctttattcttgaacttaacaaagtaattaaaaattcacctggaagaataagcaactaagaagagccaaaaaagtttagagaaagagtgctgatgaaagtgggttgccctgcctgactggaaaggtgcaatgaagccacggcagaggagacccccttcacacgtcattctgcccaccgtagcgttgcagaagcaaagacacagtggaaacagccatgagcatggcccctgcagctcatgtttcagaatagtaatgacactgacttgaacgggttgaggaggtctgcatttttttaaatcttaaaagataagtagaagttgtcagatttgatttgggagataatgagccatataaaatctaaagtagaaaaataaataattggctgggtgcgtgcagtggctcacgcctgtaatcccagcactttcagaggctgaggcaggaggattgcttgacctcgggagttcaagaccagcctgggcaacatagtgagaccccatctctaagaaaagatgaaaaaaaaaattagccaggcatggtggcttccacctgtagtcccagctactctggaggctgaggtgggaggatcacttgagcacaggagattgaggctacagtgagccctgatcacactattgcactccaacctgggcagcagagccagaccctatcttagaaaaacaaacaaacaaaaaagattaaagcaataatatgaacaggagcagaaatggaaaggcattccaaggaatcccagagttattccatgagggacaaaaggtagctttccgctgccagagatgtgacttgccctttgcagcaaatataaaagaagtcacttcaggcattctgattgtctgtagctgtagagcaaaccaccccgaaacagtggattacaataacatcttcattaaccttatgaattaaatgtctttaatttttgccagtttgatgagtgaaaatgatattttaccgtttttattttctggtgagactgaacatcttttcatacatttcagactatttgtatttcctcttcagtacattacaggttcatttctctgccaatttttacttgagttgtttgtctttttctttgagacagagtcttgctctgtcaccctggctggagtgtagtggcacgatcttggctcacctcaacctctgcctcctgagctcaagcagtcctcccacctcagcctcccaagtagctgggactacagctgcatgccaccacatttggctaatttttgtatttttttggtagagatgaggtttcgccatgtttcccagactgttctcaaacccctggcctcgagcgatccacttgcctcaacctctcaaagtgctaggattataggcatgagctaccatgtctgtcctctttcttattgattacaggaatatattttgagtattagtcgtttgctatacatatattggttttaattttgtcatatagaaactttctttaagtcagatttcttaatcctttcctttatactttttgcattttgtgccttagatggctttctttccccaggattataagcctattcttctatatttttctttttataatgttataattttggtttttaagcttagccatctggaactcatctctaggaaacaagcgatgcgagactaatccctgggagaagggaaactcctgcagtgatggccagctcaccagctctctgcctgggaacaatatccacttcccagtgcagggagctggcctctgagcagagcacagcagccccactggctgaggaggcggtgatcagagaggggcagccaaagctgcacattttatggaatggggcatcagaaaggaggatgctgtgaagatagggggcccaggagtctatgtgcaggtctccacaagtcatggccaagggttgtgctgtccgtgtgcaggacgaggccactcgaggtttaccagatagtctgagatcagaacagaggtactaaaactggatgtgtgtgtacacttgtcccaggcaaggaccgaacactgaatgcacggcagggaaggagcacaggctgcatttgctgagatttcacatgaaatgttatgtgtgcatttgctttgtatcctctctgaccagaccttcaaagtaagtgtgatcctccctgggcttttattgcacatgctgagctccagtgaggaatgagctgcttttatcctctgtgatctgtaaactgttaaactttccaaaaactaaaaactcaatctgattccacagctgtgataataaagaccaattgggaaaaccccagagagattcagggagtgagactgtttagatcaccatgagcctgagacagctggttcctgcaagaatgaatgtacagcattttctaatcagtctcctgcctttttcccaagaagctttgcttttttctttttgacttttgcagttagtgtacacagagtcagttcattcacagacacctcatggaggcacctggaggtccttggtgaaggtaaagaagtactgggaatgcagccacggaatccagctgtgtcctcgattgaatttagcacagtacacaattcagtgtgtaccctgcagcttgtccccccagtgattgatgttttttaccaaatgttaataaccaaggcaaggcaagtaaccaggcaaccaaggcaagcgaaagcatcttctagaagcaaatgcgcaggctgtgtggttttgctttgccctgtcctgctgcgttattcatgagtgctgtctctacattcccccgtctgcaactttagtacaacctcaacactctgggaagatattcttggatatgcactaaaattagatttttaccttcccatgtgtaattcaatgtcttcatttttctcaaatgacttttgcttcattgaggtggacaaaattctgtatcttactttttttttttcctaaaccctcctagagacctataaccagttttggagatggttggactgttacccttttattaaacatctaagactttcatcaaaaagttccatattccactcagaaatattgctaaagtatttatatcctgggaaaagttaatttgtaattagtaactagcatttccctgggtaaaaataatcagcaagtttctttctgtttttgctccactttttcctccccaaaaatcttgtacataaattccaaatgttagtgttcagagtggacaccacactctagccccttaagacaatcagggtccttccctccttgtttccttcttccctccccctccctgtcctccctccttctctctccccttccctccctccctttctttcttccttccttcctttttttttttttgatagggtctcgctctaccacccaggttggagtgaagtgatttgatcatggctcactgcagccccagtctccccaggctcaagtgattctcctgcctcagccttcccagtagctgggattataggcatgcactatcatgcctggctaatttttacattttttgtagagacagggtcccgccatgttgcccaggctagtcttgagctcttgggcttaagcacctcctgcctcggcctcccaaagtgctgggatttgtgagccatcgcacatgacctcctttttaattgaggtataacatacacatgtgcatgggggatgctcacgaggtgacccaggtctagaaagcacagcattcagccccccagaatcctcttcatgttcccctggttaccagcttccactcaaggataacaatgatcctagtccgttttattcagggatgaatatcaaggaaaataccagaaggtaacagcctacagaatgcctgctgggctgcttttcattttcttctcatggttcttttgatgaacctctgagtctcagatgagtggtccttgggaaaagaccttaccatactaacatccctggggtggtctgtgtttcttcttagttttggctgcttctgtgagcattgaggactgtcgcgcagcagctcagccagatttcacccctctctactttaaggcctgtgccagctctagtcatcccctcgccaaaaatgagacttttcacctccatccaggggtaggtcctggagtgagttctcagcttgctccctggggtgcctaggacttgcccggccacccatgtcccacaaactgctgtttttctgcctggtgcccagtatattggccctgcccacacgagtaccttgctgccatggcttccttgacctctctggtcactgcagtgggactggatcttaacccacctacctgggacccacagaccttgcctagctcctggctgcccagggctggatgcttttccagtccaggaaaccagcccccaagagactggtgaatgatggcatgatcccatcgctgctgcctgcctcttccctccaacccccacgaactggcccccagggcccaggctgcaggagctcctggaaactgtgctagccccaagaaagtcctggctcctggaggactgatccccttgcactccttaggccatcggctgccgtcagcagcctcccctgcctcccctgggctctgctgatgagggtgcaacacactgcatagctcatagcctctgtacgtggtctgcaagggaacagtaatttaaatgacatggctttggccgggcgcgggtgctcacgcctgtaatcccagcactttgggaggccgaggcgggtggatcatgaggtcaggatatcgagaccatcctggctaacaaggtgaaaccccgtctctacgaaaaatacaaaaaattagccgggcgcggtggcgggcgcctgtagtcccagctactcgggaggctgaggcaggagaatggcgtgaacccgggaagcggagcttgcagtgagccgagattgcgccactgcagtccgcagtccggcctgggcgacagagcgagactccgtctcaaaaaaaaaaaaaaaaaaaaaaaaaaaaaaaatgacatggctttgaatgaactgagagctctgataaagcataactcaattcatctcttttctgcaagtcatcttccatccatgtggaaagtgtgaatgataccagttgtgccacattgatactgaccccctcgttcctgaaaatacaccttagagctcatgaaagcacaccccagttactggaaaggaagccacttttgttgtaagcacagcagcagagcagcctctgaggtgcacagggctctgcaggttgctgcttggccttatgtctgagtaaggcctaagtacacatagctttttttttttgttttatttctgagaaatttaattattttagttctttttttaaatcaacttttattttaaaatttcagggtacatgtgcaggatgtgcaggtttgttacataggtgtgccatggtggtttgctgcatagatcaacccatcacctaggtattaagctcaacatacattagtgattcttcctgatgctctccctcccccacccccaataggccttagtgtatgttgtttctctccatgtgtccatgtgttctcatttgttcaccttccacttataaatgagaacatactttgtttggttttctgtttctgtactagtttgctgaggaaaggggcttccagctccatccatgtccctgcaaaggacatgatcttgtttttttatggctgcatagtatggtgtatatgtaccacattttctttattcagtctatcactgatgggcatttgggttgattccttgactgtgctattgtgaatggtgctgcagtggacataacgtgtgcatgtatctttataatagaaggatttatattcatttgggtatataaccactaataggattgctgggtcaaatggtttttcttctagatctttgaggactacaaggaacttaaacaaatttagaagaaaaaaaaacaacatccccattaaaaagtgggcaaaggacatgaacagacacttctcaaaagaagacatttatgtagccaacaaatatatgaaaaaaacctcaacatcactgatcattagagaaatgtaaagcaaaatcacagtgagataccatgtcacaccagccagaatggcgattattaaaaagtcaagaaacaacagatgctggcgaggttgcagagaaaaatgaacacttttttttcttttttgagacggtatattagtccattatcatgctgttgataaagacatacctgagactgggaagaaaaagaggattaattggacttacagtttcacattgctggggaggcctcagaatcatggcaggaggtgaagggcacttctttttttttttttttttttttttttgtcccaagacggagtctcactctgttgcccaggctggagtgcagtggtgcgatctcggctaactgcaacctccgcccccccgggttcaagtgattctcctgcctcagcctcctgagtagctgggattacaggcgcctgccaccgtgcccggctaatttttgtatttttagtagagatgggatttcaccatcttggccaggctagtcttgaactcctgacctcgtgatccacccatctcagcctcccaaagtgctgggattataggcatgagccgccgtgcctggctgaaaggcacttcttacatggtggtggtggcaagagaaaaagaggacagaagcaaaagtggaaacccctgataaactcatgagatgttgtgagacttattcactatcacgagaatagcatgggaaagactggcccccatgattcagttacctccccctgggtccctcccacaacacttgagaattctgggaaatacaattcaagttgagatttgggtggggacacagccagaccatatcagatggagtcttgctctgatgtccaggctagagggcaggggcgccatctaggctcagtgcaacctctgcctcctgggttcaagtgattctcctgcctcagcctcccaagtagctggtactataggtgcacaccaccatgcctggctaattttttgtatttttagtagagatggggtttcaccatgttggccaggctggtctcaaactcctggcctcaagtgatccatccgcctaggcctcccaaaaagtgctgggattaacaagcgtgagctactgtgcctggccaaaaagggaacacttttatactgttggtgggaatgtaaattagttcagccgttgtggatgacagtgcacacggctttgaattgtcccccagctgcactggactgggagttgctggtgctcctgatgctcagctagaattagagataattttagatggcaactaggggactcggttggggttgttccactctgagatgaaagggaacgtctttatttaggagtataatgttcttggagcgagtgttatgtcacaaaccatagttgggtggcctctacctctgccaacgtcagcaataaaaagtctgaggcagggaaactttttagagagaagaagagtgtttcctgatcatgggcttgggcttgtctacctgactagatttggacttttataataattcttttttaagatggtacacattctcctttttcctgtgttgtttctctgtggtctcactgctgcagtgccaggatctgcattcaaatacggccgagcccccagagcaccaccagtgcagtctgtcctgaggcactggactctcagagctctcctgcgggtttcagtcattttgtttggtttttcaaccatggctttgatcttgccagactttagtctcaacctgtgacccatttatagttacagatcaagaactagtggtcactttggcaacatacataccaacatggaaatgatacagagaagactggcagggaccctacacaaggaaaacaaaaaaataacttttttttttttttttaaagagagtctcactctgtcacccaggctggtgtgatcatggctcactgccaccttgaatgccagggctccagtgagtctcccacctcagcttcccaagtagctgcaactacagacatgcaccaccacacttgtctgatttttatttttatgtattttatatttatttttttgagacagggtttcactctgttgccctggctggagtgtagtggcatgatctctgctcactgaaacctctgcctcctgagttcaagcaattctccctcttcagcctcctgaatagctgggattacaggcacacaccaccatgcctggctaatttttaaatttttttggtagacgtgaggtttcaccatgttgcccaggctggtctcgaactcctaacctcaagtgatctgcccaccttggcctcccaaagttctgggccaccactctgagcccaaaaactattcttgacagtgttcaatgaactagcatatgggcgccttcttggttgtgggagatggtggcattgttgagcttccggatccatctgacctctcaaatgcttctgaagattttgcagatgaagaaaaatgctgttttgtatcagaaatgatagaagatgtaagtgtgtatataatgttctcatgtttttggaaaagaaggatttagcaagtgttaaagtgaatttgggaagggagcgaggaagggtgagaaggagaacctggcccgtttggatgcacaagttccttggggcggtagcattcaccagtgcagagagcagtgccatccaccccagagtctgttcctggtgggcctggcctggcctcagaaaatggggttctagtttctttaactgacaagaaggaatcaaagtttcaccactcactcctctagaatctgccctctcccaccctcagcctttcctttcactcttgtcgaagacatgaattgagcaagctgcagggcctctttcagcagggtctgctggcagtgtccactgcaaatgggacatgtgcttcagaggcaaatggagctggcgttctggccctgactctggcgctagaaatatttctttttgttctggctttcttatctgtaaaatgggtataacactagtcaccgtgcatggctgtaaatgagaaaatgcacagtgacaggcttatcacaggcactcagcaaatgccactgcccttcccagcccaccattttttttttaaaagacggttttgctctgtcatgcaggcgggagtgcagtggcatgatcttggctcactgcaagctccgcatcctgggctcaaacgatcttcctgcttcagcctcccaagtagctggaactacaggcatgtgccaccacacccagctaatttttgtatttttagtagagatgggatttcaccatgttggcctgtccggtctcaaacccctgagctcaagtgatctgcctgcattggcctcccaaagttctggggttacagcgtgagctaccgcacccagccaagggactcatacttaaaggactttggtcttgctcattgagcatttggttttctatttaaaatgtggtctttctgttggaaacgatctagtatccgtcagcattgctcttgggaaagaacacttccaggcagggcaagcacttgccttgtgtacacagatgccttgagatcagcataatgtaaacgtcaaaacgggtttctggatctaaagcctggcttgctttcttccaggtcagcagtgcaagagatgggtttggagatagggtcgcagccagcctgtgcgtggcagaggaaggaagggggagctgagtactggcaggggccacagtgctctctgcccttcccaagaggaaagcagaaaccagaccctctgttagaggccctccttgttttcaccttcccagggtttgatgtccataacatctggtttgaatgattccagcgaactggatggggcaccccactgccccaccaccgcctgttttttcatctttttttttgggggggggacggagttaatctctgcaccccagctggagtgcagtggcgctatctcagctgactgcaacctccacctcccaggttcaagcaattctcctgcctcagcctcctgagtagcggggattacaggtaccagccaccacgcccagctaattttgtatttttagtagagttgaggtttcactacattggccaggctggtctcgaactcctgacgtcaggtgatccgctcacctcagcctctgtaacctacaaacctcttcagaaagtgtaaaatgaaagcatttccccatttctaaagcagtgtccaggtttcatcaggtagctgtcgaacccaaagagactttgaagccaagagtccacaggatcagcttcccagtggccccagaagttacaagatggggccctcccaacaaaaggcatcctcaggcttttacgtaatgctggtgtgcttagcgactgctgaaagttgactgtgcttgtgtcgtgaaagccaagatgaagagacgttattatggttgtgtgttgctttcagctagatactcctcgctggggaaatgtaactgcaaagcagactccaggacactgtcttcctgaaagccggtgcttttgggggacattctggggcccaccagggtcatcctggatgctgactggaactgagaagaggtttgctgggaagatagggacagattctttgtatctatgtcattcaggtaaaccctacatgtgacatgtgacaccatctcttttgacctcagtttcaaatgagatatttgaccaaccttattgctaagggtcaggctagcttgaaataaccctcaagaaatctagataaaaacctaaatgagattataggctttttttttttgcctaagattatttgcttccagaaccctaaggaaacttcacaggaaacatggtaccatattttagtacacatctccatcctatgcatgttctccagaacctcttcacacacactttgaggagagttccatcaaacctccttctcttattccatcttaatgtcatgcattatttctcttcatcctgcctctccttttcagttacaaattgattctgatagaaacaccctaaatgaccttcccagggcagtcagagagttaacttgttgtagggttgcatttggccatctgggcagagggaggaaacagtggtcagtgtccaccctgtgggagggaggcagcacccaccacagctttccaactttgctggcttcacatttcccaggacagggcaagaagaggaagagctcctcagtggctgtggggagagtgcaggaaggagccctagacttgcccatttcttcttgtcccaaaacccaacacagacctaaaactcagccaagcccaagctatgccccgcttctgcaatctcttgcaaggcccctgcttaaacaacctgagctcccagctttagtaggcttgggaacttgatgcttcatttgggacaaactttgtggatccagggaagaaaaccttgttggggtgagcaggtggccgacaggactgaggatctaagaggtggggatgcactggagtccccagctggcctaggggaccggtacaggagtcttcagaagccaccatctcgatgggcagggacttagaattgaattttttttgtttttgttttttttgagacagaatgtcacctaggctggagtgcagtggtgcaatctcagctcactgcaacctctgccttccaggttcaaggcatttgcctgcctcagcctcccaagtagctgggattacaggtgcccaccaccacacctggctcatttttgtatttttagtagagacggggtttaaccatgttggctaagctggtctcaaactcttgacctcaggtgatccacttgcctcggccttccaaagtgttgggaatagaggcgtgagccaccatgcccagctagagttggattttagtttccttatcactgtgtaccaagcagctgctgggggctgcacccatcccgatggaggagcttctttctccccatgcagcctcatgctccctgcttgtttggtgtgctgacggggctgctgaacaggacgggttttcttttccccctgagaagcctcctacattgtggggagaagagtgtggtaggaagagcaatccagagacagtcttgtaggtctttaagaccttctcatcttggtctgcttgttgcgaattggggttatacagagatggtgatggtggtagtgatgacggtggtggggatgatggtcatggttatgaaggtaatgacgacggtggtggggatgatggtcatggttatgaaggtactgatgatggtggtggggatgatggtcatggttatgaaggtactgatgatggtggtggtggtagtgattcctccttgaccaaataagtctgggaaatgctggcatgtacaaaactaatcaggtgggttaatttgagaataagatatctttgagcctttaatgactctcctgagggatggacagaaatcctctactgttttgagcactgaaggcttttcctcaatactattctgtgaatggatttgggcaacaccaggccattcctggtaccaaaacaaaatgtactctgagcaaatttgggaagtttattcttatgttgccttactgaaaaatccaaaggtagattcccatctattattattattattattattatactttaagttctggggtacatgtgcacaatgtgcaggtttgttacataagtatacatgtgccatgttggtgtcctgcacccattaactcatcatttacattaggtatatctcctaatgctatccctcccccctccccccaccccatgacaggccccggtgtgtgttgttccctaccctgtggccaagtgttctcattgtttagttcccacctatgagtgagaacatgcagtgtttggttttctgtccttgtgatagtttactcagtatgatggtttccagcttcatccatgtccctacaaaggacatgaactcatcctttttatggctgtatagtattcgatggtgtacatgtgccacattttcttaatccagtctatcattgatggacatttgggttggttccaggtctttgctatagtgattagtgccgcaataaacatatgtgtgcatgtgtctttatagcagcgtgatttataatcttttggatatatgcccagtaatgggatggctgggtcaaatggtatttctagttctagatccttgaggaatcaccacactgtcttccacaatggttgaactagtttacagtcccaccaacagtgtaaaagtgttcctatttctcaacatcttctccagcacctgttatttcctgactttttaatgatcaccattctaactggtgtgagatggtatctcattgaggttttgatttgcatttctctgatggccagtgatgatgagcattgtttcatgtgtctgttggcagcataaatgtcttcttttgagcagtttctgttcatatcctttgcccactttttgatggggttgtttgattttttcttgtaaatttgtttaagttctttgtaggttctggatattagccctttgccagatgggtagattataaaaattttctcccattctgtaggttgcctgttcactctgatggcagtttcttttgctgtgcagaaactctttagtttaattagatctcatttgtctattttggcttttgttgccattgcttttggtgttttagacatgaagtccttgcccatgcctatgtcctgaatggtattgcctaggttttcttctagggtttttatggttttaggtctaacatttaagtctttaatccatcttgaattaatttttgtctaaggtgtaaggaagggatccagtttcagctttctacatatggctagccagttttcccagcaccatttattaaatagggaatcctttccccgttgcttgtttttgtcaggtttgtcaaagatcagatggttgtagatgtgtggtattatttccgagggctctatgctgttccattggtctacatctctgttttggtaccagtaccatgctgttttggttgctgtagccttggagtatagtttgaagtcaggtagcgtgatgcctccagctttgtgctttttgcttaggattgtcttggcaatgcaggctcatttttggttccatatgaactttaaagtagttttttccaattctgtgaagaaagtcattggtagcttgatggggatggcattgaatctataaattaccttgggtagtatggccattttcatgatattgattcttcctatccatgagcatggaatgttcttccatttgtttgtgtcctcttttatttcgttgagcagttgtttgtagttctccttgaagaggtccttcacatcccttgtaagttggattcctaggtattttactctctttgtagcatttgtgaatgagagttcactcgtgaattcggctctctgtctgttattggtgtataggaatgcttgtgatttttgcacattgattttgtgtagattcccatcttatcacaatcttcctcatctgtgatactgcacagtttgcaatagttcttgtttattactacttttctctcctgcagaacattgacatcaccaatttcagcagcagctggagcgatggcctggccttctgtgctctgctccacacctacctgcctgcccacatcccctaccaggagctgaatagtcaggagaaagtaagtcatggccctgtcaccttggttatcctctaagaaatgcaggagtcctaattgataaaccccactgtgggagggggcttacaggcctgaagtagaagttgggatattgataccaggtacagataactcctgaatgtttgactgcaccgtggaatcccatcctcagcaaatcttcctcagtttcccttctcaggaatctcagcttcatggtttcaagaccttggccagcatttttcaaagcctattccaaagaaccagcaagcaccaacaaaaagaattccctgttcaaataagtcttggacactgtatattgcatcacattttcagagagcatggtgcctgttaacacattaaagacttcaagaagtcctacattaagaaatctatgtgactgtttaacacagcatagatcagatccacttaacctctttacttatatttgtttgttttactacaatcacacaacaagggttggcaaattttccctgttaagggccacgtaatagactcagtgggtcaggtggtccagtcacaactgttcaactctaccatcgggctaaagaggccattgatcactttgtaaatgaatgtgcatggctgtgtcccaacaaacctttatttacaaaaacaggctatgagccagatttgggacagcagtttgccaacccctgacctagaacctcctacaaaatgtcccacagagcatactttggaaaatactgtgctgggtcccgctgttggtcactcaagaatttcttgtcaagcatcgggcactatcataagaaaacaggcaacaatagagacgttctatgccctcatgagctagacagataataagcaagcgagtagacttataacaagtaaaattataaattagcaaggataagtggtctaagagcccagagagaaactcagtgctgtgagacagagtgacggggatcacatttagaccagggagactgcagcggtgatgtcagaactggtgttggggctgggcatagtggctcccgcctgtaatcccagtactttgggaggccgaagcgggtggatcacttgagttcaggagttcaagaccagcctgcccaacatggtgaaactccatctctactaaaaatacaaaaattagctgggcatggtggtgcacacctgtaatcccagctacttgggaggctgaggcaggagaattgcttgaacctgggaggcagatcgcaccactgcacttcagcctgggcaacagagcaagactcctcaaaaaaaaaaagaaaaacaaactggcattggaaggtagaggaggcagcagtgcagagccagggctatggagcagcagcagctggggaacaccttggtgttgtccaggccgtggaagaaggctggttggctggatgcagttagtggggccagagaggctgtgctgatccagggaagtggagggggcagacccccatagctgggctgatctggggagtctggggcgggagaggcgacagagcttccccacagctctggtttggcctcacccactaaccatgagggtggtagcaacgcagacggaaagacatagaaggatttgaaatatgtctcagacagaatcaactggatttagtgacagattggttgtaggggaggaggagaggaaggagtcaaagatgacgccctggtgtctagtttgaaagggccattttctgagatggggagggcatagatatgtttaaaagctctgtttcgattatcccacatcaggatttaaataaagtacaaagaaggatcatagcaatgacaaaaactgagcaaagtaatttaatttttaaggtgttagaattctccaaaaaagcagaaccaaaagagagagagagagagagagagagagagtgtgtgtgtgtgtgtgtgtgtgtatgtagagagagagagagagagaggtgggggctggggagagagatttattctaaggaactagctcgagattatagaagctagcaagtccagcatctgcagggtaagccagcaggctggagactcagggaagagctgatactacagtcccaatgtgaaggccatttgctggtggaattccctcttcttcagtgaggttagccttttcttttaaggccttcacctgattagatgaggcccacccacactaactggggtcatttgctttgccgaaagtctcctgctttaaatgttaaacttgggccatgtgtgggggctcatacttgtaatcccagcactttgggcggctgagacaggaggatcacttgagcccaggagtttaagaccagcctaggcaacataggcagacctccatttctacaaaaaaaattttttttcaattagctgagcttggtggcgcacatctgagatcccagctactcaggaggctgaggtgggagaatcacttgactctgggagtttgaggctgtagcaagccatgattgtaccactgctctccagcctgggtgacagagaccctgtctcaaaaaaaaaaaaaaaaaaaaaaaagaaaagaaaaaaaaccttcacagaaacatctagaataatatttggccaagtatctgggtgccatgcctatccaagttaacacatgcaattaaccatcacagaatgtattaaaatatttaaattacttttctgtggggtgctttgtttgtgaagcaggctgtacaggattattaaacattctgggggaaagattgtatttaaatcatgtgaagtctgaggggctgtgaaatatgcaggtggtgatggcaggcaggcgattgcacagcaaatccggagctggatgggagagcagagcttgaaacacagatctgggggtcgtccatgaagagatccatgctgtctaatgcaggttcctgggatgatgggaatgttgtgtatctgcactgcccacagggcaaccaccaaccacacctgcttttgagcacttgaaatgtggcagatgtgactgaagactgaatttttaatttcaattttcatgttaaataaccacatcatgtgtggctgccatgttggacagcatgggcacaaatggaatttaaagccattaagagtggaggagagcacccagtcccttggtcttagggaagcatacagagggaggaccgaggaacacacctgggaaccccagtgtttgttgtggaggtagaggaggaggacacagcaaaggggaccaggaaggagcagccagagaggtggcctgagctggggccacaggcttcagcggcctcacgggtcacaggtgtcatctatgcatttattccctccctgccctcttgatgtcttagtgtctgcttttctgatacgatgttggagagataactgaggaaatagtgggcataaaagcactgaaaatagtcagaaggcctttctaacactgtgctgggtgaagcccacacatgcacacacctacgtcctcctgacagtgtgtgtgcgtcactccctgcagtcatccagacagactggctgctttgtccttgaatcagcatggctgtattggaaaattatggacctaaaagtgtttgttctcaggctccaaattgtgagccttgcctcctgggccagagcccctgtgtctggccctagtctctgcgattctgagcgcagaggctccgccagctgcccaggcctcccgcagccgtggcagcatgcagtgggggcaggctgaggccatggtataggcccctgctccctacatgcagggttgaatttcttccccagaccaatcacccgaccaccagggagtgtgtaaggcagcgtgtggaagactgtgggtctgtgatgagagtctgagtcagccctggatgtctggaatttttcattttaggatctgtttggcctcacagtaatcttgaattgggttgtgtcccagagcctaggattttatttgctaattacagcccgtttgccactctctgaaggaacaaccagcctcctgtttcctaaatgccccatcctggccacactctggaggagccacagtggctgcagtgacatttcgccacttcttggtgtgtggcttgccctgggggatgctggcgttctttttggtgagagaggccatatctatcacagttacgggtgtgggttttcaaagtaacgtatcccaacaggcagactcgtaccatataaaactgagcacacggggggaatcttactagagcagagaggggaaagagcaggaaagatttcctaaaagtgtgttagaagctgggattcacagggagcaagtggatgtgaatacagcacataccttgggtcatcaggatgagaggcacatgtgtccagccccagcctggagccgtgttcccctatgtgctcagtgccagggcatttttttttttttttaatttacacttacatcagaaagggcaccaagagaagcctttaatgtttgtaaaactattaaaatcaaaatctaaaaagtatgtgatagagttgttgatagcccagaatgtatagaaattatgaggtgtccccacctggatggaagcaattaaactatgtctgacattggtattaagtagagaatttctgataaaaactaacaagcatgtcttctatgatagtaaagagatatatgatcacagggtgcgatttacagtccatgaaagattttgtcattttgttgttgttgttgctgttttgagacagagtctcactctgtcacccaggctggagcgcagtggtaccatctcagctcactgcaacctccgcctcccaagtccaagcgattctcctgcctcaacctctcgagtagctgtgactacaggcacacggcactacacctggctagtttttatatttttagtagagatggggtttcatcatgttggtcaggctggtctcaaactcctgactttaggtgatccacccgcttgggcctcccaatagttctgggattacagtggtgaatcactgtgcccagccatttttgtttttattgttttcagtaaaaagatagggcattcacttgtccgcctttgcaactctctgcttagtccagacggactcaggtagtggactggaccttgcttatgtcagtatctgaaatgaatgaagtgtgaccctgagagggggaactctaggattggcatctttctcccgtcggttttgagtgtgaggcccaacgggcccaacccctcaatccctgctggtgactaagagttttgccacaggttgggcacttaggctgtcctggaactggaaggtcccaggcctgcaccatcatcccccgaccagggcagactgaagcagtgatggcgtcaccctgcccggctcctgtgggctgagctgcatctgaagcttacagcccgtgggggaagtgaggcccttcggagctgctgcttgtctgtggcttctgcctcccaggtggcctctgcacagtggtggtgacagtgatcaaatgaaagagcattgggataataacacttggtcacagatgttctgctgctgcaaaaatgaataaaagttactgttgtgaataaaaaaccaccccctctctgtattctatgtcaccctgtatactatttcagggtattttgagacagtttttcatcaagggatcctcccacctcaggcttcagagtagctgggattacaggcatgttgccaccacgtcttgctccgcttgtgttttcacaacagatactgaacatagaagaaacagcatgcagcacactgtgaaaacacagcggtgccaggcgttgtggcaacatgcctgtaatcccagctactccagagcctgaggctgggggatcccttgagcccaggattttgaggctgcagtagtgagcccatctaaaaaaaaaaaaaaaaaaaaaaaaagaggaaagaaaacaagtggtttcattagaatcaaactagaaggtttttgcataaaacgttgagtttaaaaatgctttctcgttagaccttactagtaatcaatacaaattaaaacaataaaatatttttagcctgatacatttggcagagacagtacaggaaaatagccacttatacactattgctggagccaaaaattggggtaacgctctagaaagcaatgtttggcattacatattaaaagccataaaatatttgacttctggaataatggtggcctaaaaactggctaaaaaccaaaaggactgaagtaaacacaaagacctcaatagcaccaaaataggagattgctgccattaatttgggctaaatggaaggaagccaggagttcacagctcccctctcagcagaacagagtagtgttagggtaacaagtgtgcagtttccagcccatgcccgctcctttcctttaatttcaaggaaggggcatggcagcttgggcaggatcaccacagatcaacagctttccaaggcatgggccacagactggaagaaaatgtggtggctacatctttctgtttttttggtgacctggtgcctagagtttgcttcagtgtcagggaaaacccgtcgcttcaggctctagatgttcaagcaagggtagagagtgagagccgtgggggaaatggaaaagggtataaaatgatgtatgaaatctaaaatacataattatgtataaaatctaaacatacaaaattaagaaatttggacaggtgctgtggctcacgtctgtaatcccagcagttcggaagactttgacaggcggatcacctgaggtcaggagttcaagaccagcctggccaatgtggtgaaaacctgtctctactaaaaatacaaaaattagccaggcgtggtagtgggcgcgtgtagtcccagctactagggaggctgaggcaagggaactggttgaacccaagaggcagaggtggcagtgagccgagatcgtgccactgcactccagcctgggtgacacagcgagactccatctcaaaaaaaaaattaagaaattctactgaggaacataatggccaggtgccatagctcacacctgtaatcccagcactttgggaggctgaggtaggcagatcgcttgagcccaggagttcgaaactagcctggtcaacatgacgaaaccccttctctactaaaaatacaaaaaaaaaaaaaaaaaaaaaaaaaagccaggtgtggtggtgcatgtctataatctcagctactgaggtaactgagaaacgagaatcacttggacctgggaggcagaggttgcagtgagctgagctcaagccactacactccagcctgggtgacagggcgagattccatctcaaaaaaaggaaatttcactgaggaacttaaaactgaatatgtagagaaacatttatatctcaattatacttaatataacaatttaattttaatataatcctaataattttgaaatgaattttggaatgggagaagcatgaacaaatgattcttaggttcatctagatgaacaaacatcagagaatagccaggaagagtccccaaaagaagccacacactagggctgaatgattgtggagcactaccattaacattctaaggggaaattattttcagcctcagattccctgtccagccagcctgttaactgaacgtgatggtagaaaggagaaattttcatacatccagaaaatgtgtctccccatattctttcttaagaaggaacctaggcaatagaatgggggtaaaatccaaaaatcagtgaggttctggagggcttggggctgtagggtttcatagaatgatgagatgattaagagctcgaggctgtgataaaggagaagatgagaaactgtgcgaggaagccagggtccaactatgaggcaggccctctgtgtcagaatagaatggcggcagccacaaggagaatgttaggacttaaaagcaacagtcagaatgggcaagaggccagatgagaaggaggcacaaagcccccctcccagtaaggaaaaccccaaacaagcagaaactgtaggaaaaaaacaaacttttgaagaaaggcagggtccaaatctggggcacactaaaatgtggggtgattttgggcgactggtagagtaacagaggaactcctttaaatgatgctttgagtggctcaggtcatgatggtggagctgtagaggacacgtgcccacagctggcttctgtgatgccgcttgtggttttcagcttccagaatcattctagtcagagagcgccgaggacttaaatgtgcttccagggaaggaagcaaaggttctcagctgtgacaatgtacaacttgaccaggtggagggaagaaagggtaatttactcctgacatacaaagtagagtcaggaagtgttgtccatacccagtgggacaaaaaatagaagttcaaggatattatttaaggtcacaaacatagctaatattaatacgggcactaaaattagctatgtgtctatagtgtaaggaggaggcagatgcatggtgcctgagtcctcatatgtcctggaggaagtcagtagaaaatgccttcattttagaaatcaagtagtagtcgtattagcatattacagagatacggaaataatccataactaaacagaaattgaaaggtagttctctgaaggaccaggattgaaggaaggaacaggttttcatttgatttaaatacaatctatatatactataatatatgcatttattactttgataatttttttgatatagcatcatgattaagcaactttgttatgcaacagaatgtttatgccataaatcttgcaaagtatgaattacctaaatcttgacaaaggtaaacaaaaatttatctttgataggtgtcaatcagtaatgttagttttggtgcagttgcaacctgttgatttttttttttcttaaactgagatcaaatattgtacacttgacttactattcttcgctttataatagtgaataatctatatgggaatatcagttgatattctttcctggcaaaagctatatattttaaattactgattccagtctctttgtctttttaacttagaagaggaatctcttgttggcatttgaagcggctgaaagtgtaggcatcaaacccagcctggtacgtatcctattttgtatccttgtgatactttaattgtatgagaaatgactttatgccatctgataaacagtttctcgtagaacattgacatctgtttgccgaaagtctgttgctctcaatacctaatatagagttatccagttgatataatcacatatcaacatatgatttagagattttcaatcgcataagatttcatatggacaaatttcagttctggaaacacagtggactgaattattattagagccctcttgttcagaacacctagaaatctgaataaaatgctatgttaaaaaatatcaacacatagctaagctcttaataaagaatgggaaatacccagatgccagaaatgtaaaacaaagcagaaaccaggcacaactgagcctgcaaaactcggcaggggtgggtgggggatggtgggccaagcaagcagcaagcctgcataaagccaaggctcacaacatgctgatcttcttagtgaaagcagaaatctctaaaactccaccagccagcccagggaggtgataaggaagctggtttccacctgggattgtgtgcgcacgtgcgcgcagagagaggaaaaggagagagagaaaagagagagagtctcttgcaaggaaaggaaacagggccagatgaggtttagagtccaaatttataatatctgtgctgcatgaagcccttagtatactcttagatgcaggaagcccctgggctgatactacaatggctgctaaaaagtaacagaacacttgagaaaatgatctacttgagctagtcagcagatatagcaaacaaaaggattatctaccagaacttgagatgataaataagagactaccaaaagactatttaaacatgaaagagataaaaggaggaatagaaaccacaaggaaagaatgattctatttaaaaaagagatttgtaaaaagaatctaacacttctagaaatgaaaaattggaattaagaccacaatatgtgttgccaaactcattagatacagcagaagagagaaatactaaattggaaaataaatacagggagatcacccaaaatataaaagagacattaaaaaatataaaatataatggtaaggttgaattagtatgtgttcagcttcaagaaatggaaaacccaaccagcagttgcttaaaccataaaaatgttaattttcttaacaatagtagttttagaactggttcaccactcagtattgtaatcaaagccccagagtgtctcctctccattctcaccatctttaatctgttccttttgtccccatgcttgttctttgtggttgaaggtggctgccaaacttcagacatcacttccacctacagggcaggaagaaggggaagagagagagcaagtgcctcctatctttccctttaaagaatgaaagtgaaaggctccctgggtttctccagctcattggcagtactctgttacatggtccccagctgcaagggcatttgaggaagtgagcatatgaacagttttcagtttctttagtgggaagcctgcgagggagagagcttgggaatgactgttgggctatctaaataatagtgtctgtctcagagtttaagagacagggacaaaaaaaatcagacaatggccatgtcccatgcccagagggaattccagatgaaaaggatagaaagaatggaatggagacagtatttgaagatatgatgcctgaaaattttccagaatgatgaaaggataatgaaagagtccacagattctttatttatctcaagcaggatgaataaaacaaaatatccatctagacatattgtaatgaaactacagaaaaagcaaagacagataatctattaaaaatttctgctcaccagtaataaaaatacaacctagtaggaaattatcaaagactagaagagaaaattcacagatgatgatgatgaatggtcaatgaggatttttaaagatgttcaatctcattagggattgggaaaatctaagttgaaataaaaatgagataacaattccagctgggtgcagtggcccacacctgtaatcccagcactttgggaggctgaggtgggtggatcacctgaggtcaggagtttgagaccagcctggccaacattgtgaaagcccgtacctactaaagatacacaaaattggccaggtgtggtggcgggcacctgtaatcccagctactcgggaggctgaggcaggagaattgcttgaacccaggaggcagaggttgcagtgagccaagattgcaccattgcactccagcctgggtgacaagagcgaaactccatctcaaaaaaaaaaaaaaaaaaaaaattccataaccctcaaagcatgtggggaatctgagaaatgaaaaagtgaatgtacatctattgtgaaatcttaccaccatgaacagtgctatgccagtgtaattttgaaacagaatggacagttttctagaaaaatacaagtatgtttcttcaaatattaaatgtaaatattcctatgaaacttaagaagacataaaactttaaccattgaagaggttgaatttatgctttaaaatgtagtcacacacacaaagaaaaaatatccccatcagcccagattttgctaaatctttaagacgcagatatccctattgtgtatttacaagtctgggaaatttaaaaaggtgtgaggaaacttacacatctgaccagggtggagtagcagggatctcccttcagaaacaacaaaactaaggagtaccaacagagagatcaggtaaggataaagatacaatgagaccttgttggaagattatattttacacagaatacatttttctttgtagtgttgtaattaatatttacttctgtttaaatataatatctttttcttaattttcatctaatgtgctatagaagttagtgagctgggaagtgaatgaggtcattttgttgtcctaattgtcagagccaggggtttcattggtgtggatggtctgtgaggagctgctgacacacatgataattaatctcaaaggcacttaggagtgtttgtgagcactttcccggctttttccaccaacaaaatagaaatttcctacattcttaaatttgcttttcagtaccttgatgtggattggaaaatccagtatgttgaattacacatgacactttaaaactacacccagtcagaagtgacagcagtaatccccaaatcttcagtcaagttctgttgttagattatgccaggaaaattgtcttatatgtttatattcaagtaaatataagtttctggggtataacatattaggatgagatctttatttttataatttcaacttttattttagattcaaggagtacatgtacaggtttgttacatgggtacactggatgatgctgaggtttgggatatgagtgatcctgtcacccagataggcacatagtagccgatagtttttcagcccttgcctccctccctcctttctccctcttgtagtccccagtgtctactgtccccatctttatgtccatgactacccaatgttgagctccatttataagtgagaacatgtcttatttggttttctgtttgtgcattagtttgctgaggataatggcccctagctgaatccacgctgctgcaaaggacatgattttgttctttttatggctgcatagtattccatggtatatatgtaccacattttctttatccagtctactggttttctttctccttttcttttttttttttttttttttgagatggaatttcgccttgttgcccaagatagagtgcaatggtgcaatcttggctcactgcaacctccgacttccgggttcaagcaattcttctgcctcagcctcctgagtagctgggattataggcacgcaccaccatgcccagctaattttttgtattttttttagtagaaatggggtttcatcatgttagccaggctggtctcaaactcctgacctcaggtgatccacccacctcagcctcccaaagggctgggattacaggcatgagccactgtgcccggccctttatccagtctactgttgatggacacctaggttgatttcatgtctttgctattgtgactagcactgtgatgaacataagtgtgcatgtgtttttgatagaacgatttcttttcttctggatatatacccagtaatgatattgctgagtcaaatggtagttctgttttaagttctttgagaaatctccaaagtgccttccacagtaactgaactaatttacatttccaccaagagtgtattcccttttctccacagccttgtcagcatctgttactttttgacgttctatcaatagccattctgactggtgtgagatgatgagatctttaaaaatgaagctctatagtgttccccagatattagaaagtgttctttctcagccaccgtgtaaggagagcatcttagccagcccaattacagatgcaagcaactccccagaaaaggaattaggcgagggacgatatgtgatgtcactgtcataaaaacggccaaaacatgtgtccccagggctgctgtgtctttaccaggccatgtagtccatgagggctgttgctcactgagtgccagcatgcccaccaggacagctgctgcaggactgggtgctggcatgcccccgtggagggaggtcaccatgcagcaattcctgaggcatggctgggcctactctgcaagtgtaaacttaatgagctgtgcttaaatagctaatttgtgcttgattgtgtgacaagcattttgtttttcatatttactgtatgtatttaccattttgggcatttttcatgcaaggacttgttggaccctcatggaggtcctgcaaggtggatgcactctataagaggaaactgaggcacatggcttatgagcgggaaaggcaagaggcaaggccaggcaggcagctccagagcgcatgccgtcaaccaccctgacagctgtgtctgccttctgcacataccttgttagatttagaccttagtggggtttttttttttttttttttggtgctattgtaaatgttattgtttttcttattacaaaatccagttgttcaattggtacataggacagcaatggacttttgtatactgaccttgtatcctgagacttagctaaacctgcatgtaaatgctttgggatttttctaaacaatcatatcatctgcaaataaaggcagttttatgtctccctttccaatctgcgtgccatttgtttctttttcatgccgtttagcactagctagaacttccagtacattttttttttgtttttgtttttgtttttgtttttgagatggagtcttgctctgtcacccaggcctggggtgcaatggcatgatctcggctcactgcaacctctgcctcctgggttcaagtgattctcctgtctcagcctcctgagtaactgggattatagacacctgtcaccatgcctggctaatttttttgtatttttagtagagacggagtttcaacatgtttgccaggcctgccttgaactcctgacctcaggtgatccacccgcctcggcctcccaaagtgctgggattacagtccagtacagttttaaataggacagatgagaaaggacatccttgccttgttcatgattttacggggggaatgttcaggtctttcaccattaagtatgatgtcagctgttggttttttatacatatcctttgctaggtaaaagaggttcccttctcttcctagtttgttgagagttaccacctataaaaactatcttgattgtggaattttgtgtaatgctttttcttcatctgttgatttgatcatatggtttttcttgttcagttagttaatgtgacgaattacatcagtttacaaatgttgaaccagccttgtgttcctgggatgaacctcacttgatcatgatgtattatacttttataggttaatagattgtgtattcatgagaaattggcatgtagatttcctgtaatgtttatgtctagttttggtatcaggataatgttgggatcctggaatgagttgggaattattctctcctcttccattttttgaagagattgtgtagaattggtattatttcttccttaagtatttgatagaattcacaagtgaaatcatctgggtctggtatcttttggagggtcttaactactaattcaaacaaatgtcatgcactataagattgttactaatgcagcatactctgtcttctgaaatgtataacatcttttcacaaattctcaaatatgttaacaatgtactaaatatttttagttcagttatgaagttcaagcatgtaagattgtctgctcaaaactgaatattgattggacttcggagtcctctctgagattaaagacacaccctttccataatacagaggaaagtgtgcagtgtgccatctctcttgtgtttgtaggtatcccttcttttcccagagctcatctatgtccaaattgcatgcccaattcttcatcagttcctttctgtaagtcatgttagcaacactccttggtacggattttaggttgccaggcctcagtctgtgtgcagtcatgactacagccagtgtaggtagaaggagacattctattcttgtattctgtgaaagtttgtttttcttttaaaattgttctaggtgtacctgcacggaatgttctaccaactcttcttccactcctttcccatgactaatgataggctgataattttttagcatcaccagggagcagaataagtgaagtctgttcagattttgaatcaggggatgaatggctcattaacagcctcagccaactctgttaacccccaggaactgatgtgctaagttcagccttacttttccatggcatctctgcttctggctttacatcagggtcctttcctactattctcttttaaccacacagaatccaaattcaatcccaaagttaattattaaatatgtccagtggcacaaatttcagaaaagtttgagtgcctgacaggatgcccaccctcttgcccctccctttctggcctggatgttatgcatgctcattacaagcttacttgcaaaatgaacaaaaataaatcagtcagtaaaaaccagcaaattagcaaaagtaaaataaaaataagccaaaaaatcaccaaactgtattaaataacaaacaaacaaaaaaacacattaagtagtaacaatgctggtaaaataaatggttgcatttgaaattggttcaaggcttttgtgataatcccactcagtaatttatcttgagggactagttcgacagaaggaaacaatactgcacaaagatgctgattgcagagtctgtggtggtcacgaggtgagcgtacactggatgccatgtcccttgtggacagcagtttccctggtgagtgcacattcactagaatggcagcccgcacagtggcacagcagcacggggacccgggtgtgaaatgctcagcccacgtaatggcacagcccacgtaatagcgcgtgcagtgtgctgggagtctggggaattagaggtggattcaaatgtaatttagaaacttggaaatcattttaatagtgaaattatgggtgatttttgctttttaaaacttgtttaaatgctgtcatatggttaaaagataaaagcagtgggaggtcatgttttccgtttttggaaagggacagtatctcctgaataagtgggaggaaaagtcctttaactcatcgctttcagcaccacctgtgctggccttcacgttctgtctgtgtaagtggagggtttccaggcagtgtaagccctaacctggactgaagtccttgaggggaaggggtctgtgatgtcctgccttgtgatctgtcccccattcccttcccctgcaggaactcagcgagatgctgtacacagaccggcccgactggcagagtgtgatgcagtacgtggcccaaatctacaagtactttgagacgtaaccctggagggcctggggcagccaccattgccacctactgcagcttttcctggaagcgcctgattactgtccactgaccctgctctgcccaccacccagctgcctagacttcaaagacaggctcaatccaagtggaccaacacccaaataagaaacagagtgggtcccacgatgtacctgtctgaaatgcaaatgcagctggactgtaaattggggactctttgatctcttgtgggatgcttctaaagagggcagcctccctccttccagaccaagaccccacacccaggcttgttttgctgattatattgggtggctgaacgaacacattatctgcagaaattcagacaaagaacatctccaaatcagtcttttggttgctgttgttaaaaatatcccggctttgcctttatgaaacctttgcccttggctgggtgtggtagctcgtggctgtaatcccagcactttaggaagccaaggcagtaggatcgtttgagcccaggagttcgaggctgcagtgagctatgagcataccactgcactccagcctgtgtgaaagagccagaccctgtctcaaaaaaatgataaaacccaaaactttgcccttgtgaaccctcccttcccccctccccccccaaaaaaaaacaacaaaacacaaaaaataaacatttgttccagggcaacctggaaacgtg

SEQ ID NO: 1692 - DNA, 78866 bp, Homo sapiens
cgcccctggctagagaagccgcagcccgcagtgtccgacccagtcgtcccgcgccggagccggccccgtagcgtgccatggcctgctacatctaccagctgccctcctgggtgctggacgacctgtgccgcaacatggacgcgctcagcgagtgggactggatggagttcggtgagtgcggcccggggaggggaggggaccagggcgaccggagcccccagcgatcccgcctggagcggccgccaagctccctcgggcacccgggttcagcgggtcccgatccgagggcgtgcgagctgagcctcctggaccgggtccgccgcggacctcggcctgtcacctgaaggtgccgcgtggtctctgaggacgtctgtcgacgagcaggggccgccgccactgcgctctgagtccagagaacggtgggtacgggggccctcctgtcagcgctgctggctcggtgacgtccccaggtggcctctcatccagcccacaacagcctgcaaagtgcgagcctcgaccctgtagggacccacggtgctgtcacttcttgggggggtgtgtgtgtgtgtgtgtgtggtgtgtttagttttagtgtatattagaaggatctatgatttaacatatatatatatattgaaacggagtttcgctgttgttgcccaggctggagtgcaatggcacggtctcggctcactgcaacctccacctctgggattcaagcgattttcctgcctcggcctcccgagtagctgggattacaggcgcccgctaccaccctggctaattttttgtattttcagtagagaccgggtttcaccatgttggccagactggtcttgaactatttttttttttttttttttttttttttaagacggagtctcactctgtcgcccaggctggagtgcagtggcgcgatctaggctcgttgcaagctccgcctcccgggttcacgccattctcctgcctcagccttctgagtagctgggactacaggcgcccgccaccacgcccggctaactttgtattcttagtagagacggggtttcaccgtgttagccaggatggtctggatctcctgaccttgtgatccgcccaccctgggcctcccaaagtgctgggattacaggcatgagccaccgcgcccggcctccggaactcttgatctcaggcgatccacctgcttcggcctcccaaagtgctgggattacaggcgtgagccactgtgcccagcctatttatcatatttgtgattaaatgtactttaccattatagttttaaaatcagatatttacttttagtgtacattgttttgatcacagtatttatgactatcaacctgttttgagatcagatgtgtcctaatagattcagtgtgtataatggggcctaagcacaagcacttactttcactctattgcaaggtgcacagttctagataattccgtgggaaggcactcagacagcctccatatgttttgtttgttggtgcctgacggatgactggcggagagggccatggactctgcggggaggccgcttgcctgttgtctctgctttccaggtggagatctgcattccaggctcttgctgtatgactttgggccagtttgttaacctctctgagcctcagcttctgaatctgtatgtaaactggagatgataattatagcttcttcataaagttgtgaggaatgaaaatactgtataaaagcactgacacctaagtgttaaatattcttataagtcataagttgtaatattctcttttcatttttatttttttgagacagtctcattctgtggcccaggctggaatgcagtggcgagatctcggctcactgcagcttccgcctcttggattcaagtgattctcttgcctcagcctcccgagtagctgggattacaggcatgtgccaccacgcccactaatttttatgtttttagtagagatggggtttcgccatgttggccaggctggtctcgaactcctgacctcatgtgatttggccgctttggcctcccaaagtgctgggattacaggcgtgagccactgctcctggacctggcttcactactttgaatgtttcctgggcagtgaacaaactttgtgtgagactccctctcattttttccacattggcccagccctcagttacaaatgccagaacaacttctgtttctaggaaattcaattagaaggcatacctatgacttaaaaaaaaaataaagctttactgagatattcacataccatacaatccacctgtttcaggagtacaatttagtggtatttagtatattcacagggctgtgtatccatcttcacaatcaatcttagaacattttaatcacccgaagaagaaactctgtacccgttaacttccaatcccctccttccattttcctgagttttagacattgcctattttggacatttcatataaatggaatcatataatatatagtgctctgtgactgacttgtttcaactaacatgaggttcatccatgttgtagcatgcgtcaatacttagtttcttttttttttttttgagacggagtctcgctttgtcacccaggctggagtgcagtggcgcaatctcggctcactgcaagctccacctcctgggttcatgccattctcctgcttcagcctccctagcagcttggactacaggtgcctgccaccatgcccggctaatttttttgtatttttagtagagatggggtttcactgtgttagccaggatggtcttgatctcctgaccgtgtaatccacctacctcggcttcccaaagtgctgggattacaggcgtgagccaccgcgcccagccagtttctttttattgtaggataatgttccatggtatggatatactacatttcattcatttatcagttgttgggcattgggttcttttcacttttgggccattgtgaatagtgctgctgtgaacactcacatacaagattttgtgcagtggtgcaaatgtagctcaccgcagccccaacttcctgggctcaagcgatcttcctgtctcctgagtagctggactacaggtgtgcactgctgcacccagctaacttttgtattttttgtagagacaggtttcaccatgttactcaggctgatcttgaactctggagctcaagcgatctgcccatctcaccttcccaaattgctgggattacaggtgtgagccactgcatctggctttatgtttaactatttgaggagctaccagatgttttctaaagtggctgaaccaccagtgtatgaggatgaccatttctccacatccttgtcaacatgtgttatttttttctttttttaatttttttttttttgagacagagtctcgctctgtcgctgaggctggagtgcagtggcatgatctcggctcgctgcaaccttagcctcctgggttcaagcgattcttgtgcctcagcctcccaagtagctgggattacaggcatgcaccaccgtgcctgactaatttttgtatcttcagtagagacagggtttcaccgtgttggccaggctggtctcaaactcctaacctcaggtgatctgcccgcctcggcctcccaaagtgctgggattacaggtgtgagcaccatgtccggccttattgttgcttttttgatggtagccacctgagccagtgtgaagtggcatcttactgtggtttgatttgcatttccctaatgactaatgctgtggagcatcttttcctgtgcttgttggccatttgcacatcttctttggagaatacctctgcgaggctccccactgggatggatatgatctgaacaccttgccaggcatgttgactctgacacatctgcccagtgctggcctctctgacctcctcttcttccacacccactgtcactcccctgctccagccacactgacctccctgggccagacacagggtctttgcaggtgctgttccctctgcctgggacgttcttccccctgtgttacctggggctagctttctagtctattagtttcctcctgttgcagttatagattactacaatatcaggggaaccagcccgcagtatttcaatgtaggttcttttctattttccctaagtgtcggccggtctgagaaataaagagtacaaagagagaaattttacatctaggcctctgggggtgctgttacacattggtaggaccgtgatggtgaccccgagccacaaaaccagcgagtttttattagggatttcaaaaggggaggggtgtacgaatagggagtaggtcccagagatcacattcttcaaagggcaataaaagatcacaaggcaaaggtgaaattagaattactggtgaaggtccatgtcccactgggcacgcattgtcttgataaacatcttaacaggaaacagggttggagagcagacaacccgtctgactagaattcaccaggctggaatttcccaatcctagtaagcctgagggcactgcaggagaccagggcatatttcatcccttatctcaactgcatcagacagacacccccagagtggccatttatagacctaccccgggaatgcgttccttccccagggttatcaattattaatattccttgctgggaaaagaattcagcgatatttctcctactcacacgtccatctataggctctctgtgagaagaaaaatatggctctattctgcccgaccccacaggcagtcagaccttatggttatcttcccttgttccctgaacatcactgttattctgttctttttcagggtgccctgatttcatattgtttaaacacccacgttttacaatcagatttcatatttttcaaacacacgttttacaaacaatttatacagttaatgcaatcatcacagggtcctgaggtgacatacatcctcagcttatgaaaatgatgggattaagagattaaagacaggcataggaaattataagagtataaatgtccataaaatcttcacaatttatgttcagagattgcagtaaagacagacgtaagaaattataaaagtattaattttgggaactgataaatgtccatgaaatcttcacaagttgtattcttctgccgtggcttcagccggtcctgttcggggcccctgacttcccacaacactacaaagttggtggcctgtaacacctcaagtttattatctcagcattctggaggtcagaagtcctaactcagggtggctctagggaggagtcggtctcctggccttgactggcttcctgaggcctgcagcatcctgtggcttatggccccttcctccatcatcaaggccatgggtgtgtatcatcacatctgtctctgtgacttctgcttctaccatcacctcatctctgaatctgatgttctggcctcccccttacagggaccctggtaattaccttggccagacccagagaatccaggataatctcatctcagaatccttgatttaatctaacctgcaaagtcccttttgctatgtaaggtaccatattcacaggtctcggggcttaggatgtggatgttttccaagggtattattctgtctgtcacagtccttcaggtaagctcctgtggcacctctttgaaatcaagaggactttcctgcccctgttcctctctagcccatcaccgtgtttcatttccctcattccgcttcacagcctttgatgtcccctcgttcctgaattttttccacctgtctctccctatggaatggaagccccgtgcgggcaggggccttacctgtctagtttttcactgctgtattcccagagcctgggacagtgcctggctagagggcaggtgccagaatgaatgatgagctgccaggccttggtgtggtgaggatgcgggctgcccactcttacccattggagctggcctggagcctttggtcagcccacttcctacactggatcagagccagcggtgcctccggcccactgctcctcgcccagtcccagtgctccagttccctcttcagctgaatgaacgagtgactgtgattgacccttcagtcctaaaaattcttggcttcctgtgggtcattttagaaagaagacagtccctcagagctgatggtgatactgggagagtgtagtgagaacgctaaagtgattcagaagatcccgcagccacagacagccacgctctttcagatccgacacttgttggcagataatctggccacgcctagttcttgtctccgtgatggcagctgcctctgttgggctttgcctgagcctgtgtaaaaagggtttcctacagcttcagccccaggtgtgtgcagaggggctcggcgcaggggctcttctgtgtgtggccgttccccgtctcgttcactcatgcgtgtgccagcctttgtgcacagccctgctttgccctgcccagctgtgtgacatcaggcaggtgactatctctctctgagcctttagtttcctcatccatgaagcaccctcacagtgttgctgagaggcttaggagactcagcttattgtaaagggtcaagttagggctttcctcatcccccacccagggaggggtgtgggcattcgattctaagatgggtcatttcaggaggctgtgccatccctgctgtggaggactttgaagacaggcaaggttttctactgcctcgggtgaactcctgcaggattcaggaactcaagagtgatagtccctgtactgttaatcatcagggataaaaacattttcaggccaggtgcagtggctcacgcctctaatttcaacactttgggaggcctaggtgggaaaatttcttgaagccaagagtttgagaccagcctcgtgatccgcccgcctcagcctcccaaagtgtttggattacaggcgtgagccactgcacccagccttttttttttttttgagacggagtctcactctgttgcccaggctggagtccaatgatgcaatctcagctcactgcaacctcggcctcctgggttcaagtgattctcctgcctcagcctccagagtagctgggactacaggcgcccgccaccacactctgctagtttttgcattttcagtagagatgggctgggcgtagtggctcacggctgtaatctcagcactttgggaggccaaggtgggaggaccacgaggtcaggagttcgaaaccagcctggccaacatggtgaaactctgtccctactaaaaatatgaaaattggccaggtgcggtggctcatgcctgtaatcctagctctttgggaggctgaggtgggtggatcatgaggtcaggagattgagaccatcctggctaacacagtgaaaccccgtttctactaaaaaaaaaaattagccgggcatggtggcaggcgcctgtagtcctagctactcaggaggctgaggcaggagaatggtgtgaacctgggaggtggagcttgcagtgagcagagatcgcaccactgcactccagcctgggcgacagagcgagactccgtctcaaaaaaacaaacaaacaaaaaattagccaggtgtgatggcactcgcctgtaatcccagctattcgggaggctgaggcaggagaattgcttgaacctgggaggtggaggttgcagtgagctgacatgtgccattgcactccagcctgggcaacaagagtaaaactccgactcaaaaaaaaaaaaaaaaaaaaggccgggcgcggtggctcatgcctgtaatcccagcactttgggaggccgaggtgggtggatcacgaggtcaggagtttgagcccagcctggccaacatagtgaaaccccgtctctaccaaaaatacaaaaattagctgggcatggtggcacatgcctgtagtcccagctactcgggaggctgaggtaggagaattgtgtgaacccaggaggtggaggttgtggtgagccaagatcgcgccactgcactccagcctgggcaacagagcgagactctgtctcaaaaaaaaaaaaaaaaaaaaaaaagtagagacggggtttcatcatgtcggccaggctggtctcaaactcctgacctcgttatccgcttgccttggcctcccaaagtgctgggattacaggcgtgagccaccgcacctggccaaactctatgaaaaacaggttttcatagaatgtagatagtttaacacttacagctaatacttatatcatgtttattgtgtgttaagcactgttctgagtgcttctgtacatagaactcatctaatccttgcaacaatctcggaggcaggtgctgctgttatccttgtttgacagatgaggaaactgaggctcagggggagatgaacaccttccccaaaaacacagcaagtaagcagcagagacaggatttgaacccaggccccgaatcccaatatctggcctctgaaccaccactactgtcctgctgactttcgcacatgttttcatatctgtagaaaaagtctggaagattagacaccaaaatgtaactggtggtgtccttggagtcctccaagtgggataatcatggggactttcattttcttgtttcccaaatattctacgatgaccagctattacctgtccatgctgagaaaaaagctgcagcttagcagaaggccttggtagtgactcatcccctcaagatctctatcatgtcccgactctaaagggtctggttgagactgggtacggtggctgatgcctgtgatcccagctctttgggaggccaaggagggtggatcacttgagctcaggagtttgataccagcctggccaagatagtgaaactccatctctactaaaaataccaaaaaattagccgagagtggtggcacatgccctgtagccccagctacttgggaggctgaggcaggagaattgcttgaacctgggaggcataggctgcagtgaactgagatcacgccactgcactccagcctgggcagcagagcaagactccgtctgaaaaaaactaaataaaataaataaagggtctggttaaatgctgattggtcaacaccttaagatatggcaccgtcatggaacaaaaatgtctaagctggaaggcaccttagagtttaattcctgtttctcttgtattaccatcacgagtaaggaaagttcagcccacagagagtcaggctgtggctgagttcctgctgccacccacgaggggtggccctgggcttctgttttcccattacgtcatgctgcctcccaagatgggagtgtgtgtggatgaccaatgcttcgtggggggagatggtccttccttttccatccgttctcttctctgtattgctagaagcagccgctgacccagctgacatcacttcccactgaccagcaatctggcctggggtttccagtgactaacatagcaatttaggaactttccatcttaattgggcacttctcctggaggctttctgtgtgcaggagactgtcaccagcccattttgtccaaagggtaggggattgtgcaatctggtcacagcactcactggctctgaaattttctgtggtcccttgtaactcttaggatcaagtccaaactccaaagctgggcattcacttgagggtctttgttatgtggtcctgggcttcatctcttgccttcccttcttctactcggcccacctatgtttatatatttttttgttttgttttgttttatttttttgagatggagtctcactctgttgcccacgctggagtgcagtggcgtgatctcggctcactgcaacctctgcctcccgggttcaagtgattctcctgcctcagccttccacgtagctgggactacaagtgggcaccaccacgcttggctaatttttgtatttttagtggagatgggagttcaccatgttggccaggctggtctcgaactcctgaacttaggtgatccgcccacctcagcctcccaaagtgctgggattacaggcatgaaccactgcacccggctgattactcctagttttaataaaaatgcctttctcacttcagtaaaccagtggaatactggtcataaaaatccatttatgggccaggcacagtggttcatgcctgtaccaaaaaaaaaaattagccaggaatggtggtgtgtctgtcatcccagctgctggggaggctgaggtgggaggattgcttgagcctgggaggccaaggctgtggtgatccatgtttgcaccactgtactcatgccacctgggcaacagagtgacaccctgtctcaaaaaaaaaaaagatttttaaatttttatttatttttaatttttatatttttgagactcagtctctgtcgctcaggctggagtgcagtggcacgatctcagctcactgcaacctccacctcctaggttcaagtgatttctcctacctcagcctcccgagtagctgggagattacaggcgtgtgttaccacacctggctaatttttgtatttttagtagagacggggtttcaccatgttggccaggctagtatcgaactcctgacctcaggtgatccacctgcctcagcctcccaaagtgctaggattataggcatgagccactgtgcccagtccctgtggtataatgttaataaataagaccaggatgcagaatctcaggtgaggcatggtggctcacacctgcaatcccagcactttaagaggttgaggtgggaagattgcttgaggcgaggagtgcgagagcagcctgggcaacatagtgagaccccatctcttaagaaaaggtacaaaatcagctgggcacggtggctcacgcctgtaatcccagtactttgggaggccgaggcaggcgcatcacaaggtcaggagattgagaccatcctggctaatgtggtgaaacctggtctctactaaaaatacaaaaaaattagccaggcgtggtggtgggcgcctgtagtcccagctactcgggaggctgaggccggagaatggcctgaacccgggaggcggagcttgcagtgagctcaggagtgcaccactgcactccagcctgggtgacagagcgagactccgtctcaaaaaaaaaaaaaaaaaaaaaaagaaaagatacaaaatcttacctgcagcgtggcaacaactacatccaaagacacatctatgtagagggggtgatttttggaaaggggaagtaccctaatggccttaggagggtggtgagatgctgtgtaacttttccccctgtattgtccatgttttttttttttttttttttttttggtgaacaaccatcaattttatggtaaaacaccaaaagaaagaatgcattatttttattgttactagtggtagctccctgcaagttttgtcccatacttcagaattggcaaagtatttttgtatccatggctctctgatccttataacagttctgtgaagacgatgtggtatgtgtgtgtgttttcattcagtcattcacttagcatatcttttttgttgttgtttttggagacaaggtcttgctgtgttgcccaggctggagtgcagtgacatcatcgtggcttgctgcagcctccaactcctgggctcaagtgatcctcccatctcagcctcctgagtagctaggactacagatgcatgccaccatgcctggctactttgtttatttatttatttatttattttgagacagagtctctctctgtctcccaggctggagtgcagtggcgcgatcttggctcattgcaagctctgcctctcgggttcatgacattctcctgcctcagcctcccgagtagctgggactacaggtgcacgccaccacgcccggctaattttttgtatttttagtagagacgaggtttcaccatgttagccagcatggtctcaatctcctgaccttgcgatctgcccgccttggccttccaaagtgctgggattacaggcgtaagccactgcgcctggcctacttcgtttattttttgtagagacagggtcttttttttgttttgagatggagtctcgctctgtcgcccaggctggagtgcaatggcgtgatcttggctcactgcaagctccgcctcccaggttcacgccattctcttgcctcagcctcccgagtagctgggactacaggtgcccgccaccacgcccggctaatttttctatttttagtagagacagggtttcaccgtgttagccaggatggtcttgatctcctgaccttgtggtccacctgcctcggcctcccaaagtgctgggattacaggtgtgagccaccatgcccggcctactttgtttattttttgtagagacagggtctcactatgttgcccaggctggtcttgaactcctgagctccagcaatccctccttggtctcctaaagtattggaattacagctgtgagccgctgcacctggcctcatacacttgttgagttcccctgaccaggactgggacttagctgagaggaatgagatgcccagggcaaaatgtaaggaggcgctgatgctcagggtcctgcggtgccacctgaagatgagcgcctcctgcattttccttccctaggtgcctcacctgactcaccctcatcctggccccacctccactctgaaccaggcactattctcaattctggggaagtaacagtgaaccaaacaggtagagctccctgcctacacggaccttccattatagaaggggaggcaggcagagctagtacccactgaggctcccacgggcgcagtgactgccccaggcatagcagcagccaatgctcaaggctttgaccctcctgtcccgtggtctttctcctaagtcatatgtactggaccccatgggtgcccagcagagtcagcgttgtaacttgggccacctgtggacctcagctaatggtggtgtttccagtgtggaggcggtggttggggaggatgtcctggaaaagcccagctaggggctagtgtggggacctgtcctagagggactgcctctctgactctaagcagagttctctccgtcccttccagcctcctacgtgatcacagacctgacccagctgcggaagatcaagtccatggagcgggtgcagggtgtgagcatcacgcgggagctgctgtggtggtggggcatgcggcaggccaccgtccagcaacttgtggacctcctgtgccgcctggagctctaccgggctgcccagatcatcctgaactgtgagtaactcagggccctccttgagtggggcccatcacgctcctgagcagtttccatccgtgtgagttgcactctctggccttaatacttttttcctcttttaattaaaaaatttaatgagtgagtttaccatgcacataagaaactggtaacaggccaggtgcggtggctcacgcctgtaatcccagcacttccggaggctgaggtaggtgaatcacctgaagtcaggagtttgagactggcctggctaacatggtgaaaacccgtctctactaaaaatacaaaattagctgggcttggtggcctgcgcctgtaatcccagctactcaggaggctgaggcaggagaatcgcttgaacctgggaggcggaggttgcagtgagccaggattgcaccactgcactccagcctgggtgacagtgagactctgtctccaaaagaaaaaaaaaaaagaaacaaaaaaaagaaactggtaacagtggttacctgtggggagaggaactgggctgccagagaacacagtattggagggagactttactgtaaattatttcataccttttaaatttgggctatctgttccaaaaataaatacattaattaatttaaaaaaccccaatagctataacaaaaattcaaaaaagcatgcagcaaaaatgattcatattgcttcttttccccactttacatcccaagaagtaatgattggtaaaaatttctggcttgtcttactagaaattttctctgcatgggcaagggtattatatatctgcaattccttttttaaaaactttttttttgagacagggtcgtgctctgctgcccaggctggagagcaatagtgtgatcaaagctcactgcagccttgatgtcctgggctcaagtgtcctcctgcctcaacttcctgagtaattgggactataggcacatgccaccatgcctgactaatttttcatttttttgtagagatccaggctggtcttgaactcctggtctcaagtgatcctcctgccttggcctcccaaagtgctgggattgcaggcatgagtcacatcaccctgcctgcaacccccttttgatacagctagtagcacatcatgtattgtgaattttttttcacctagcaaagaccttggggacttttcatattgacacattctttctaatagctacattgtattcctttgacagatgctctatgatttgtttgcccctattgagatgtgtttatgttccttctagcatttttcagttgttttttttttttttgagatgaagtttcactctgtctcccaggctggagagcagtggcacgatcttggctcaccacaacctccacctcccatgttcaagagattctcctgcctcagcctcccaagtagctgtgattacaggtgcccactaccacatccagctaattttttttttttttatatgaagtctctctctgttgcccaggctggagtgcagtggtgagatctcggctcattgcagcctctgcctcctgggttcaagtgattctcctgcctcagcttcctgagtagctgggaccacagatacccaccaccatgcccggctaatttttgtatttttagtatagacggggtttcactgtgttggccaagctggtctcaaactcctgacctcaaatgatccacctgccttggccttccaaagtgctgggattataggtgtgagccaccgtgcccagtcaactttttgtagttttagtagagacagggtttcactatgttgaccaggctgatctccaacttccaacctcaggtgatctgcccaccttggcctcccaaagtgctgggattacaggtgtgagccaccatgcccagccatttttctattctgtatagtgtcatgatacacttagatgtatagagcctgttttgcacacatgtaagtgtagccatgggatggctttctattatagtattggaatgtctgggttgaaggtttttgcattttaagtgttgattgatatttagtattaacaaattaccctcctctgagagaacaggatcatgtgtgatggggacatatttagctggtaatacctccctaccctgaagggtggctgtgaagtcgaagagaataagtgcctgatgttcagctggtgctcagcagaaggcagtggggatggggggtctggttacccccacccctcctcacatccccaaagagaccccctcagcgtagggcagggagccagtcttctgcatgtacttaactgagcacctgcctggttctgccctaggttctggaatacagcacaggcaatgtgacaggtcctccgccctcatgaggacacagtcttgtgaggagacagttaatgcataggaaaactagtacagaaatgggcaggcaggatacagtgaccagataggggagcctcctaggacagggggtcaaggaaggccagtgtgaggatgtgaacctagaggaataggaagaagacagccacatgacgcattgggtaagagctcaggagagaggggccagcatgtgcaagggccctgaggagccagtggtgggagccccagacacctggggaggagctgtcctgtctggggttcctgagctgggaaccacctggctggaccatcagaccagattcagcacctgcctatccctcaggtcttctggagtcattgagggcttccaggaggggggactgggagcaaaggcctgagggtgggggcctagagagtaccaccctctgagataaaccaggagagcaggggatgctgtggtggacgtgcaggtggagagatctagagctacagcccaggctgggcttttgggggcattgtggggcagaccacaccagtcacggggaggccagtggggcagcgagaacatctcctcccttcagctggcaagcaactttccaggccctcctgtctggggtcgggaatggggcgatctggctaccaatgggagtgatgttccagcacaggacggtggctgggcctgcttctgcacaggctggaccctgactcctctgtgtgcccccagcagcatagtggtggctcctcttgagtcatggtcctccccatcccctggacttctgtctccacccctgctggctgcctccctaagcacaccttcctcctcagagtggagagggtcagctagctgcccaggccacagcctccccattcctggaacccacctgaaacccctccctgcccggtgctcctgagccgctgccgttcctctccttacattccccctgcgaaagttgtcagaatcaatatggagtgactttgtgttaaaaaaaaaaataacccttggctgggcatggtggctcacgcgtgtaatcccatcactttgggaggccgaggcgggtagatcacctgaggtcaggagtttgaaaccagtcagaccaacatggtgaaaccctgtttctactaaaaatacaaaaaaattagctgggctcctgtagtcccagctactcatgaggctgaggcaggagaattgcttgaacctgggaggcggaggttgcagtgaggggagattgcacactgcactccagcctgggtgacagagcgagactccatttcaaaaataaataaccctgacaaatagaactagggaaggccatgaagggaggactgtcatgcataaatgcccaacaacaataactgtcacggaagactctacaaaaaccacaaccttgcataaagaccattgtaaccacacacaaaaaatacttctgcgaggacatctgcccagcaaatgcctatccgaccctggagactggaatcactcttgttattcaaggatagttatctcaaaacagttatgtaatcctcttcacttttcctttgaaaaacctccctggatacacacttagtttactatggcacgtgtactctcattccaatgccctattcctgagtaagcatcattttcttttttttctttttcttttctttttttttttttttgagatggagtcttgctctgtcacccaggctggagtgcagtggcgcaatcttggctcaccgcaacctctgcctcccaggttcaagcgattctcttccctcagcctcccaagtagctgggactacaggcacctgccaccacacctggctaatttttgtattttcagtagagacgggggtttcaccatattggccaggctggtctcgaactcctgacccgaggtgatccaccggccttggcctcccaaagtgctgggattacaggtgtgagccactgtgcccagctacatcattttctttttttctttttttttttttgggacagagtctcactctgtcgcccagcctggagtgcggtggcacgatctcggctcactgcaagctccgcctcccaggttcatgccattctcctgcctcagcctcccgagtaggtgggactacaggtgcccgccaccacgcccggctaattttttgtattttagttagagacggggtttcacctgttagccaggatggtctcgatctcctgaccacgtgatccgcccgcctcggcctcccaaagtgctgggattacaggcgtgagccactgcgcccggccttgtatttttagtagagatggggtttcgccatgttggctaggctagtctcaaactcctgacctcaggtgatctgcccgcctcagcctcccaaagtgctgggattacaggctgagccactgcgccaggccctttatttttttaattttaattttttgttatctctatagtagttcaaacagatgcccactaatttgtttttttttttttgagacggagtctctttctgtcactgaggctggagtgcagtagtgcgatctcagcttactgcaacctctgcttctggagttcaagtggttctcctgcctcagcctcccaagtagctaggattataggtgtgccccgctgcatctggttaagtttttgaatttttaatagagatggggtttcaccatgttggccaggctattcttgaactcctggcctcaagtgatctgcccacctcggccttccaaagtgccaggattacagccgtgagccaccgcgcctggctggatgcccaccacctcttaaagggtgttaatgataaatttgaagaaaacagtacttgaaagccccacacaccagaagtcctggacatgaagtggcttcctgagggacttacctctccaggggatgtgcctggatgtgactgtggccttttgaaggccatgcttgaactcagtggtacgacaggggcccactgggggccatatccctgcacagtctcttgaaatgtgaactgcagtggctgcctggtctgaatgggtagagggctggctctgtgggtctctgttccttgatatttcctcagccttagttgccaaggccgtagttatttaatttgtcaaacactgaatactctaagaattagaatgggccgggcgcagtggctcaagcctgtaatcccaacactttgggaggccgaggcgggcagatcacaaggtcaggagatcgagaccatcctggctaacacagtgaaaccctgcctctactaaaacaaacaaacaaaaattagcctggcgtggttgcgggtgcctgtagtcccagctactcaggaggctgaggcaggagagtggtgggaacccgggaggcggagcttgcagtgagccaagatggcaccactgcactccagcctggcggcagagcgagactccgtctcaaaataaataaataaataaataaataagagaattagaataaatcagtacagaaggcttagaacagaaagcagctacccattccttgccctagcaaatctgctggccagagtcagcccctttttcctcttttagccatccatgtcttgggctcctctattagccttccaggttcactactgtaaaacaagcgcagaccacagtggctgagaaaagacaggcgttcgtttccctctcctgtgactgccaggctgccccgggctcaagtggcagctccgtggttttgtggcccaggctctttcttctttactgttctgccagtgtggacacaagacttctcacatctgagatggcccctctgtgcccctacatgcacatcgcagacagcaagaagggaaaaagaggaaaaaggtgggtacactccacttcttttaaggacatgaccaggaagttgctcacctactttccctcataagctattggccaaacctggtcacagaaccacacctgcttgcaagggaggctgggaaatgtaatctttggttgcaaggttttatgtgcaactaaagcttctagtactctagaaaaggaggcaatcagtattggagggaccattagcagtttctgccacggtccattttggccacccagatatctgtatacacctgtcttgacctgcataaaacatctgctttccacaagggagataggcctgggggcctaatcagtcacttcctttagggcaaatctggtatgtgtgggtgatgtgtagccttctctaatggccccagtgacccagggcctctcaaccaaagagaagctgtctgcatccccttcccccagcacacccaaattccatggtggaatttgaacaggaagccacaataaaaaactcctacttgagatgagaaacacgaggtagttacttgtctatagcagtcaacaaatctggcagaggagcaattgtaaaactcccttccctgtttttttgtggagtttttgtgtgttttttttttttttttttttttttgagacggagccttgctctgtcgcccaggctggagtgcagtggcgcgatctcggctcactgcaagctccgcctcccaggttcacgccattctcttgcctcagcctcccgagtagctgggactacaggcgcccgccaccatgcccggctatttttttatttttttttatttttagtagagacggggtttcaccgtgttagccagggtgatctcctgacctcgtgatccgcccgccttggcctcccaaagtgctgggattacaggcgtgagcccctgcgccgggccaaaactccattcccaggtaaaggagtaagttctttgcttggcccatctggcagcccttggttctcagtgatctgtgattcgcgaagcatcctaagcatcagtatcacctgggaacttgttagaaacgcaaattattgggccccacctcatctgctgattcggaaactctagtggtgaggcccagcagtctggcttaagttccccagatgattctgatgcaccttgaagtttaagaaccactgctcggcccggcgcggtggctcatgcatgtaatcccagcactttgggaggcccaggcaggcggatcacctgaggtcgggagttcgggaccagcctgaccaacatggagaaaccctgtctctactaaaaacacaaaattagccgggcgtggtggtgcatgcctgtaatcccagctactcaggaaggctgaggcaggcgaatcgcttgaacctgggaagcagagattgtggtgagccaagatcgcaccattgtactccagcctgggcaacaagagtgaaactccgtctcaaaaaaaaaaaaaaaaaaaaagaaccactgctctggctgggcgcggtggctcacacctgtaatcccaacactttgtgaggctgaggtgggtggatcacttgaggtcaggagttcaagaccagcctggccaacatggtgaaacatcgtctctactaaaaatacaaaaattaggccaggcgtggtggctcaggcctgtgatctcagctacttgggaggctgacgcaggagaattgcttgaacctgggaggtggaggtttgcagtgagctgagattgtgccactgcactccatcctgggcgacagactacactccgtctcaaaaataaataaaaatggaaatacaaaaattagccagaggtggcggtgggcacgtgtaatcccagctactcgggaggctgaggcaagagaatctcttgaaccaggaggcagagattgttgggaggcagagattgcaatgagccaagattgtgccactgcacttcagcctgggtgacagagcaagactccgtctcaacaacaacaacaacaacaacaaaacactgctctgatacctggtcctccgtgatttctgggaagtggagcttccacgttcattattctctgtggccttatctgaaacggaactggaaagaatgtgcttttatttagggctccttggctttcacaaaccacctcctgctggtgtgggtttggggacttgagtggagctgtaggagtcaaataatctccagcttttatcagattcagctgtggtttctttggcaacacagttctgtcaaaaaactagaagcttctgctctcttggcttctaatcagttctgctgtggtaatcacagccgaagatccagcctagacacatcttaattctcagccctgaagtgtttggtctgttatttcctggcttctgcgcttagcctcgcctcctcaccccccaatttaatgtgcttacctggagcttcccttgaagccacctgaaacagtaagttggatgggaaggcaggactcttaatttgacttttgcctttgagctctctgtatttggcagagaacctcttctgagggtcagtagtagaactcagaaaggtggagcagagattagattattagaaaggttagtaccacagtcttccctgctgctgaggcagactcttgagatcccccaagatggggattcttgttgacttggattgttagctacaggctgggtctttgttttctttctttcctttttttttttttttttttttaaatagagacagaatctcgctttgttgcccaggctggaatgcagtggggcagtggtacaatcttagcttactgctgttttgaactcttgtgctcaaacagtcctcttgcttcagcctcccaagtagctaggactataagtgcaaaccaccatgcccagctaactttttttttttttttcagattttggaatttttgcattatatccttagtggctgagcatccctaattcgaaaatccagtatctgaagtgcatttcttttgagtgtcatgttgttgctcaagaagttttggatgttggagcattttggatttcaggttttcagattagggtgactccaactgttatcactattttcagtccctctataggttggctttgcagtgttaacaaatgtacttacatttcttccataagctataggcaatgtctcccgatgccccattttgtaaaatgaagccctttttatcctctcctctccactttcacttcccatcttctggcaaagactagttgaaaaatagtcctctgtgaatgttgtgacctctgagcctccaggaaagaactgggtcttggatgaagattcaccctctgggtcagacaggaaggcggaatactgcctttgtgtcctaattgaaagctgcctcattgtcatgtggagagtactacatgcacagggcatctgcagtagcagatcatggtctagagtagcatttcccacaccatgtgcctcagaagactggtccagcaagataccctgctgcaaacaaaagggttcatgaataactaaactcgggaaaccccgcatactttatcactgcctctgcctttggagatttacaatgcataccaactgtgaaggctctgatacgtcctgcagcaaagaaacttatttaggctattgtttcccattcatatttgaccatggtactccttttcatttgatactgatatgcccatgagatcaatatactttgtgagtcactgctctggggaaatggtgaccatggtgagggtgctgggcatctcagggaagccccatgatggagaacctagggggtcagaggcagtacttgtatgttcagaccagcatccagtgtgagaagagtctgtttctggggctagggtccgccatcaccctggggcttaacgatgagaggcctactccagagagggatttttccagatgaccaggcttaggaggggactgtgggccgggctccagaccttatatactggcatcttaggggcttaagagcaggaattgaggcagaagtgagtatcccagctgtggctcccaggcaaaggagaatccactataatcaatgctgagctctagagctgattaagtgccaccaaaggctgggttaggtgctgagcctgtagatggtggggagcagatggctctggctctgagggtggagtctggaaactgggtgcactggcctgtgaggtgaaattctccctctgccctgccacagggatttagatatgcaggagctggacaagagagttaataaggaactaaaaatacattttttgtctttttgagatggagtctcacgctgtcacctgggctggagtgccatggctcgatctcggctcactgcaacctccgcctcccgggttcaagcgatccttgtgcctcaacctctgagtagctgggattacaggcatgcactaccacgcctggctaatttttgtaattttatttatttatttatgtatttatttatttttgaaatggagtttcgctcttgttgcccaggctggagtgcaatagcgcaatctcggctcaccacaacctctgcctcccgggttcaagcgattctcctgcctgagcctcccgagtagctgggattacaggcatgcgccaccacgcccggcttattttgtatttttagtagagacagggtttctccatgttggtcaggctggtctcaaactcccgacctcaggtgatccccctgccttggcctcccaaagtgctgggattacgggtgtgaaccactgtgcctggcctaatttttgtatttttagtagagacagggttttgccgtgttggccaggctggtcttgaatccctgacctcagtgatccacccgccttggcctcccaaaatattgggattataggcatgagccactgcgcctggcctaaaaatacatttgctgagtgcctactgtgcgctagatgctggggatgcaaccatgaaaacacagccaaggtctcaggcctcatggagcttacagtccagtgggagatgaattataagaagctaacacacagatgcatgtcacccactgcagtatgagtgctcaaaggataaatgtaggtcaggtggggagggcaggtaggagagtgcaagatgagaggatttgatctcatcaggggaagtttctctgaggcagtgaaacttgagcctcctccgtaaggaatagtggaccaagaagtgaaggacgacacacacatatctagccggggggagcagcatgtacaaaggcctgggggtgggctgaggctggggacagggcagggtcaggccacccagtgccatgcaggctaccgccaagagtttgctttcaccggagagtgaagggaagacgttggagggcttccacctgggagtatcccctgttttggccactatatggactggggggctgggcctgtgaggttccagatgtcaactgagtaggacaggaagacacttcaggaatccgaagggatttgggaagtgaccaaggttttctcttcccatctgttgctactatctacctgaagtcttgagtttcacaattttcatgcagtttcttcttggttgtgcaactcttgacagtttctaactttgggtttggcatctcggccagagtcatttccttcctggagctgggctctcattgagtggaaaatttggggctgctatgtaaaatgaaacagaagagaatgaacccttcctctccggaaggggccgggctgtgccaggtccagacagggcttgtgtgtctgctctcttggaaggctgccctgcctccgcccctttccagctgctagggcacaacagaacatgcctacatccagaccctgcccactgcagacttgccactggaggcgacactgttttgggccaaaaccacaggccaggggtcagagcacctgggttctagtaatagcttgtgtttagcacctgatatgtgccaggtaagcatcttttctcacaactcttattatccctattttatagaagaggaaactgaggctcagagattaagtaatttcccaaggccacatagcccatagtgatgaggccaacatgggaattcaggtctgcctgaccttacccgcttcttggtaggttactagattgcatcatcacttgccccatctggaaaatgggtaaagacattgccctatctacttttcttgtagactgggaaggttcaaagcatacgagatggtgaggttttctttgtttctttttttttttttttttgtgagacagagtctcactctgttgtccaggctgaagtgcagtggcatgagcttggctcactgcaacctctgcctcgtggactcaagcaattatcctgcctcagcctcccgagtagctgggactactggcgcccaccaccacgcccagctagaggttttcttaaagttaattgctgagtggctaaggacaggtcacttgaccttttccttccatgcattcattattccattggaaaaaagcaaggctttaatcactgttggtctcttgagagtggtgttagaatgaacagagtgtggaatgcctctaagccagtccccagtgtttcagagaggaagggtaagagctagggtgaagtgaaccatcctttattgaactcctgctagatgcttagctcttacaactagtctcctccagttgcaagttttggacacatactcagatgatgcattagccaggataggcttggttatgctgcggtatcagataaaccttgaaatctagttcctcaacgcaacaaatattgatttcccactcacctgaagtccagtaagggtcatgcagcctcctgcattcttgtagccagctaagtcatctagaacatgtggcttccaaagtcactgtggctggggaagagagggttggaagaggctcactagctgttaagtgcttcgtccaggaagtgatagatagcatcttcacttaaaatccactggctaggccgggcgcggtggctcaagcctgtaatcccagcactttgggaggccgaggccggcggatcacaaggtcaggagatcgagaccatcctggctaacatggtgataccccgtctctactaaaaataaaaaaaaattagctgggcgtggtggcgggtgcctgtagtcccagctactcaagaggctgaggcaggagaattgcttgaacccgggaggcggagcttgcagtgagccgagatcgcgccactgcactccagcctgggcaacagagcgagaatctgtctcaaaaaaaaaaaaatccactggctagaaccagtcgtgacgcccagcctaattgctaaggaggcaggagtatgagacagagcagatggttatttggtaagtactctctcagctacaggttacctcagttccagggcgcttacagtaaggttctgcctaactgtggcctacaaggccctgcatggtctacctttgcccggctcttcaacctcacctctaccactttccccctcagtcattcccctcagccactacggtcatccttcacttgcggggatatgccaagtgtttgctgcctaaggacctttgcacacgtgttccctctccttggaatgctgtctctccccagcttccctacattcttccatgctagtccttttcatcctctgggtgtctgcatatgtggccccttctcatggcagcttttcctggccagcctatggaagtaggtccatcaggcacccctccctcgagtttgttttcagcatagagcacctcccagtttataattagatgtcttttatttaactagcttaatgtcagtattacggcagttttgataaaggattccccattccctaacacaaaatgaatgaatgaatgaatgagaaagaatgagtcatttcagcagcaggtggagtacaagttcagtggagaaccagggatcgcacaattaggaaggcaggctgtgctctcaggtttgcctcatttcaggtctagcttgagttgggagtgtgtgtgtgtgtgtgtgtgtgtgtgtgtgtgtgtgttgtgtgttgtgtgtgactgtgtatggcctggagggccaaacccagggattaggagggaaaggaaaagagagggcgcggaaagctgtgtttgtccctgatagagccagctggcacgagggtgctttagttatagctgaatcacttttgtttgttctggaagggatctattctggccacatgagtcagcctaagaacaaattactgtgtagtttgacgggcgtgaagggttggggggaatttccagagtgtgctcacccaggaaagaccttgttgccagctctgagtcccctctgctccaacagctcctggatttgccaccgtgtgaaatgttctcaggcagctagtgtgacggcccaggccccgtcagccaaaggcccagcacccataaacatcctttagtcctttctcctgaaggaactgggccataaacaagcacataataaataaatctgcattctaggcttcgctttcttcagatataagacaactaccttatacttggtagcaattatcccccagagctgttacctgaattaaataggccacagatatgggcaagaacttaggaaaaaaagcctgacctagagttagagtggtcattataataacagtagtaggaggccaaggcggacggatcacctgaggtcaggagttcgagaccagcctggccaatatggcaaaaccccgtctctactaaaaatacaaaaattagccgggcgtgatggtgtctgcctgtaatcccagctactcgggagggtgaggtaggacaatcgcttgaacccaggaggcagaagttgtaatgagcagagatcgtgccactgtactccagcctgggcaacagagcgagactatagcaaatgatggtagcttagatctgctgggtgttaatttttttatcctcatggctggtctcgggtcgggggtccacttccacatctcatttgtcggatgaggaagccaaggcttaggaggatccccctgctggtgagcctgactgcaggacacactccagactgcgggagttcatttgccttccgtggcatcagtgattcatgctcattaggaagagcacaggcattccgaaaacaaatcagagagaaaaagaaatcatgcctggcaaccagctctggtgaaccatgacaggggcacagagaagcgcttctgcccctcccccatttcctccttgtatctgggactcagccctcatcactgtgggttctcagcctcagcaaggcagctttcacggatatccagattccaggctgggtgcagtggctcacacctgtaatcccagaactttgggaggccaaggcaggtagattgcttgagcccaggagtttgagatcagcttgcgcaatatggcaaaaccctgtctctaccaaaaaaaaacaaaaacaaaaacaaaaacaaaattagcctggcgtggtggcgtgctcctgtggtctcagctacttgggaggctgaggtgggaggattgcttgaacttgggaggtagaggctgcagtgagctatggttgcaccagtgcactctagcctgggtcacagagcaagactctgcctcaaaaacaaaaacaaaaaatccagactctgtctgagaactgccgtgtcaaccttctggtgcctgtggccacctaagctatagattagctgttccttccgtcacctgcgtccccttcctatccctgggggtcccagcagggagaaccctgggctgcccacctccagtgtgtgactgaggctggctgccaatggcgtgggcacaggcccccacctcccctgctgctgggctcctatgttactttgctctcatggccactgtacctctcgggactgtgcaccaagttgctgcccacctagaatcggtttccattagagtgtttaaaatgttaaaaatagccttccaccctaaatgcttccttcggaggcccgagttgggaatcagaggttcttttctatctgcacctttctggcagaactgaaggagggtggctgtttgcacagtgttgtgggcccctgccctgggccagccacttcacatttgtcatcatggagccctgggacggccctgggaggtgtggggttattattctgattccacaggagaggcgcatgaagctcagagggttaggaggtctgtgcctgggcgtgaagctggaatcgcagagcttgggtctggctcaagccagagccgacgcttccccacgcttactcttgtgatcctagttctactctttgatcacagtctgtgtttttggatctcatgatcctgcagaatcaactttatgtgtggaattctcttgagaatttaatcctgggaggaaagagtgctgtcttggaagcctgaggctgcccctgtctatctgtgataagaagtccgtgagcagctcactcctgagccttggccttggcagataggaagctcagtgcgagagttaaagcttgtcacagccctttcttgtaggcatttggcctcctttgcctcatcctgcctttggtgttctatttttatttcactagctctctggtgtgccagcctgaatgagtgggcgttgcgtctttctagctagcagggagcaggtttggagggatgaggacagaggccattttctccatcttcatgtttggacagtgggacaggcatgcatgggcctgcctgtccacccagctcagaccatgccggcagctccagggtggagatgagggcggttcatgtttatacgcaccatttattgcttgcattttaaagacatctaaaaactcaaagcttgagaagatgggggtttcacaggaaaccagaacttcttgttggggctgacatggggctctgttggcttacatccgtggctggtgtgacctggtgcctcttgtgtgggagggtggatgttagccccaagtgtgctgacaggtctggtcacaggtagccctgccgacaccgcccctccccatctgttcctcactcctgctcacttccaaatgccctgtggtgccaggtggggccaccgcatgtcactgcagaaggaacaagaaaaagaaagagaaaagctggactctctttaggatgaaaacataatgacattttttatcttccccacgggtggagcccacagaggtcggccacaaatgggttggtggccttgatgttcctgccaaatgtgttttgacagagaggcaaagatttgtgctgaacaaaacattaccctgaataggacactggactgggagcagtggctcaggcctgtaatcccagcactttgggaggacaaggtgggaggatcactggggcctaggagtttgagcccaggctgggcaacatagtgagatgctgtctctacacaaaattaaaaattagctgggcgtggtgttgcctgtaatcccagcggcatgggaggctaagagaggaggatagcttgagctcaggagtttgaggctgcagtgagctgtgatcacaccactgcatagcctgggtgacagagcaacaccctgtctcaaaaaaaaaaaaaaggaacaggacactgaagttaagtaaggctgtaagtatcaccctcatccccgttttactgtgatgagaacaatgaggctcagccaggcaggcctccgacaaggagaaggtgcctcatttgctgggatcatgggcggttctgggtgtaggtgagacctttagggagcattttatactgttgcgggcctggcctctgcaggaggtcactgttgggaagtgacttcagcgagcccagccggccctgagccaggggagccactgctgcccttttgacacagatgtcacaaggatgacaagcctttccaggagcataagccccacttgaggcagtttgaggagggagggtggagggagagaggcagtctctccctgccagagaggggaggctgggaaagatgaggactgggagtggcggggggtagccttccaagggagcacaggcagagctttcacttctgtgcaccctgggagcgacagctctgttccagacccgtgcttgaatcagcactcaccccgacattgttcattgtcattctgtacaagggactggttttctgttgttgttgttttttgagacagagtcttgctctattgcccaggctggagtgcagtggcacaatcttagcacactgcagcctccgcctcccaggttcaagcgattctcctgcttcagcctcctgagtagctgggactacaggtgtgcaccaccacgcctggctaatttttgtatttttagtagagacggggtttcgccatgttggccaggctggtccagaactcctgaccacaggtgatctgccctccttggcctcccaaagtgctgggattataggtgtgaaccactgtgcccggcctagggactgtttattctcctcctgggcctgtggaaggcagtgggatgccatgaggcagacagtgatcctgtgattcctgcaggcaaggcccttgttggagagaaactggcttctagactccgagtttcagccacaaaggccttggcctgatggcaatcaggatgggggggtgtggcctatagaaccactgaagtgcccgtggagcccaggttgggagagaagtgcatgttctctgggtgcccttacgtcagtggttctgggaggagaccccgccttcctgcctcagtgctgcctgcctccctgtttcccttgggcaggtcttgttccccgctgagcctcagcttcctgacttgagatctccagggttgtggggagggtgcttgaattgaacgtatcaatacacaacgtggacattcgttggtgaaaaacagaagtgaggtggatctgaatctcatgaagggctgattcatcgtctgctcactggagccagaggggtccccagggcaaacgctactcacactagcttggaagactcagttctcgtcattactttagctagcttgctaactgattttttttaaaagaagtatactttactgtgtaaataatgcataatgattttgttgaaaaattctatgatatgaataaatcacaaagaaaaaaaccccacaatataaaacaggccaggcgcggtggctcatgtctgtaatcccagcactttgggaggccgaggcaggttgatcacttgaggtcaggagttcaagaccagcctggccaacatggtgaaaccccatctctactaaaaatacagaaaaaaaaaattagctggatgtggtgttgcaaacctgtaatcccagctactcaggaggctgaggcaggagaatcgcttgaatccaggaggcagaggttgcagtgagccgagattcctccactgtactctagcctgggcaacagagtaagactctgtctcaaaaaaaaaaaaaagaaaaagaaaaagaaaactaaaagactctcatcctactcttcttatcctcaatatgtggactatttaagagataaccaatattttaagactataaccaccacagaaataaaggtcccatattttgagctaagcagtgtctccattagtcttcataaaagttgtccaaaggagggccgggcatggtggctcacacctgtaatcccagcactttgggaggctgaagagggcggatcatgaggtcaggagatcgagaccatcctggctaacacgctgaaaccctgtctctactaaaaatacaaaaaattagccgggtgtggtggtgggcgcctatagtcccagctactcgggaggctgaggcagaagaatggcgtgaacctgggaggcggagcttgtagtgagccgagattgtgccactgcactctagcctgggcgacagagtgagactccgtctcaaaaaaaaaaaaaaattatttaaaatatcagtgacagtaaagaaaacacaaggaagaagccactcaggccgggcgcagtggctcacgcctgtaatcccagcactttgggaggctgaggagggcggatcatgacgtcaggagatcgagaccatcctggctaacacagtgaaaccctgtctctactaaaaatagaaaaaattagccgggcgtgctggtgggcgcctgtagtcccagctacacgggaggctgaggcaggagaatggcgtgagcccgagaatcggagcttgcagtgagccaagatcacaccactgcactccagcctgggcgacagagcgagactccgtctcaaaaaacaaaacaaaacaaaacaaaacgaaaatttatttaaaatgtcagtgacagtaaagaaaacacaaggacgaagccactcatcaccccccgacattcagccttgttgttatttttgtgcattcccgatgtctccccaactcctcccaccctggggaagtcagtgatcacccctttgttcctgtttgtctggggattggggcgtctgcccctgggggaattggggctggtggtggcagtgatggcagtggtgtttcaatagttctgccctagctgggtgggagacagtgaaaccagtcccaggtttgactgttgttggctgttttacttgacacaagtcatttcacttatctgagcctcaatatactcaaaaataaaatgcagataaacctatgaactaccagagattgttgtgaaaattaaataaatatgcacggtgccataccagtgtggtgctatgcaaatttaggtcctattattttagttcaaaagcttgggtttgaaaagtgaggtcccagggtaacaattggttttgtttagagaggcacagttgaccagttcaaagaaatgttgctggagatgttttgtcccagccctacctgggacatctgttgtgacatcccctgtgtcatgctttatgtcatgctctgtgtgacatcaagcgagtcagcagcccttcctgggacttcagtgccccagtttttgtcattctcaaacatgagtctatcccaaaccaccagagaatgagggacttgaatgcagggctatagcatcaggttttatctgggaggcaatggggagacagaaagattcaggctaaggagtgtggacattatctaggcaatggggagccccataaaggcttcaagcagggaagtgacgaggccagatgtatactttggtaagaagtagcctggcaagggtgtggaggctgcctgagctggcggcagggcccagccagaagggataagatcagggcccagtggaggaggggagaggaagctgtttcacagagcagctctgagaagctggctggaagctgaggttgacacaccctcgaagcacctttggggtttcccaagttgatgtaaaaaggaaatgattaccctcgagaaggcaggggagttcttcggccagtcctgcgtgcctttggcatgtgatcttagcaagtcatttaacctgctcaggcctcagtttcctcatctctgaacagggatgagaagcagagatgttgtgaggattcatgtctgtgcagctgggcctgggcctggtacagcccgtcctcagtggccatggctgctgttttaggattctcatccatcaagtgggaaggatgcgtttgtctccactgcgtgaaagggaggttgtaggacagccagaactttgatccctaggggctggagtgggagcttagagggatggtgtctttgacccgctcacgtgttcagggaaatgtgcagtctacagcgcccattcccatctctactctcctttcccacatgacaccccagcgggaggcaaacggacgccattatcacctccgttttataggtgagggaagggagaccgagaggaggaaggtgacttgttggaggtcacacagctggttgggtggaagcaggtgtatgtgacttagcacgtcagagctccaccttcaccaggactgccatgttcagccactgctctttttttttttttttttttttgagacagagtcttgctctgtcgctcaggctggagtgtagtggtgcgatcttggctcactgcaagctccgcctccccggttcaagtgattctcctgcctcagcctcccaagtagctgagactacagccgtgtgccaccatgcccaactaatttttgtatttttagtagagatggggtttcaccatgttggccaggctggtctcgaactcctgacctcaggcagtccacccacctcggcctcccaaagtgctgggattacaggtgtgagccaccgcgcctggtctaccgcattttacagatggggaggccggggccagaaagggaaagaccctcccgccctgcaacaccatgcatttgtggcagagccagaattagaacccaggtctctgacttccagaaccagtctctcaatggctaccccacttcatggaatagtaataactttctttccaccttgttttcagggaaaccggctcctgaaatcaggtgtcccattccagccttccctgactctgtgaagccagaaaagcctttggcagcttctgtaagaaaggctgaggatgaacaggaagaggggcagcctgtgaggatggccacctttccaggcccaggtattttaaatttaacttttttacttaaagcacttttatttaaggaaatgaagatatatctataaggacattcagcttagcatataagagcaaaaaattgaggctgagcatggtggcccatgcctataatcccagctccgtgaggctgaggcgggaggatggcttgagcccaggagtttgagaccagcctaggcaacctggtgagaccttttctctacaaaaaattttaaaaaaatcatccaggcatggtggcatgcacctggtagtcccagctattcaggaggctgaggtagggggattgctcgagcccaggagtgcaaggctgtggtgagctatgatcacaccactgcactccagcctgggtgacagagcgagactcttcctaaagaaagcaaaaaatctggcaacaacaatgggggataataaaattaatgtcagacagtcacaacaaagtactatcaacagtgatgtagacgtgcatatgtacatggaaacatactgacaatatcgggaggtagaaaagtagaaaaaatcaggtaacaaaatgtatataacatctgttaccatttttgtgagcagaaaagaaatagctcggtaattggaggctttctagtgccagacactattccaagtactgtacttcaaagatattgactcatttaatcttcaactaactatgaattaggtattgtgattatgcccatttcatggatgagaaaactaaagcacagcgaggttaaccaacctggctgaggtcatgtactgccgggtccctgttttcaccagtggtctcccgtgtccccagcacaggttggccctgcgtgcaggctctggaccggatgtctgaccatttctctgtccattctccataggccccggccctcgcagccatgcagtggggaattgaggggtgcttcctgcccaccactttcctcccctccatcagtcacagtctgctgaagcccagagagggagagcagcttgcttaaggtcacacaaataggaagtaatgtctgagctgtgtgatttgaacactcacatccctaagcatcatactcactgctatcccaaatccttttggaccacttcagatttgtctccgtcgcctgtgcccaggcaagggctcagggacagtttccaaatgacagaatggctcagccagcagatgacctccctaggggagctgctgctcagcccaatctccattctcaccgcctcacccctggagccctgcctcacctcctgtctcctgcggcctcctgagtggtgagccagagaccccaaatccatgtaatctcagttcactgttgccgtttctgaagccaggggcggcatcagctgaaaggaacatgttttgtgggcttttgtattagacagactcatatttgaatcctagtgctgctgttttgtagaatgacttagcgtttgtacctcagtttactcatttgtaaaatgaggagaataatagaccctatttcatcacgttgtggtaagaaatcctgcacctgagtgttgcaccatggaggtgctcattaaatgttatctgatattatgaacattccagacactccagataggttgaatctagaaagttaattctaggccaaggagtctggattatttcctgtagctaaatatatgtatttttaagtgtagacttttgatcagcaatgaaagataaggggaaatggtcctgaccaaagggaaaattataacaaaatagggaaattgtaggggcgtgctggtcaggatggaagaggtaataggcatagcagttccttctggtattctttatctaggttactgtaaagataaacatcacagccagccgggcgtggtagctcatgcctgtaatcctagcactttgggaggctgaggcgggtggatcacgaggtcaggagatcaataccatcctggctaacacggtgaaaccctgtctctattaaaaatacaaaaaattggccgggcgtggtggcgggtacatgtagtcccagctacgcgagaggctgaggcaggagaatcactcaaacccaggaggcggaggttgcagtgagctgagatcgtgccactgcattccagcctgggtgacagagtgagactctgtctcaacataaaaataaaagtaaaataaacatcacatgtctctgtcagcctttgctgtttactttctttcctttttttttttttttttttttgagataggccttgctctgttgcccaggctaggtgacggtggcacggtcatagctcactgcagcctcaacttccctggctgaagcaatcctcccacttcagcctctcaagtagctgggactacaggtgtacatcactacggccggctaattttttatttttgtaaagatgggatctcattatgttgcccaggctggtctcgaactcctgggatcaagcgattctcccaccttggcctcccaaagtgttgggattacaggcatgagccactgcacagagccctatttacttactttctttttttggcagtgggatggaatctctgtcacccaggctagagtgcagtggcacaatctcggctcattgcaacctttgcctcccgggttcaagcgatcctgctgcctcagcctcctgagtagctgggactataggcacgcaccaccacgtctgactgatttttgtattttttgtaaagatggggtttcgctgtgttgcacaggctggtcttgaactcctgggctcaagcaatccacctgccttggcctcccaaagtgctgggattacaggcgtgagccactgcacccagcccctatttgctttcttgatggcacttggagcaaatgtgcccaggcaggtcaagatgataactacaatttgcaggcagagacaggaagttgattgtctatctttgcctaaattgaaaataagaaatcattcatttcatcaaaccacccaaagcttgtcttctttcgggaaaaccccaaggttccactgagccccagagttcaaactcatcaattatcttaaaggattttggtaggagtgaagtatactgagcccacatcttgatccctgtgataccctggctcccccttgcagtaggtgggaaggaagtgggaagagacatggaggaggaaaatatgtttgtttgttttgttttttgagacagagtctcgctctatcactaggctggagtgcagtggcgcgatctcggctcactgcagcctctgcctcctgggttcaagtgatcctcctgcctcagcctcccgagtagctggcactacaggtgcgcgccaccacgcccagctaattttttgtatttttagtagagacggggtttcaccatgttgaccaggatggtcttgatctcttgaccacctgcctcggcctctcaaagtgctgggattacaggcatgagccaccgcgcctggctgaggaggaaaatatgtgagcagaggagccatggataggctatgagcacctcggcaaagcagtctcgaagctagaattcagatgaaagggttttgagcagctgaaataactgttacaaagccttagctgtaggagaggccactgggctatcagtcagaatctgtttacttactctacacatagtttcaccagccttggtaaaataccaagtactgcatgtgtcacagcctgacctttgtgctctataaacatcagctctttttacctggacaagaaacagaccattattgctctttttacatttgagaaagctcagataagtgaggcacagctcatctgaggtcagatcttgagtagtgctggagccagcgcttgagccaaattctgtttgatactaataaaggagatggggcagctgggggtagacccgctgccagcatcagggcaggacatagaagaccccatgtcagatacagtgccgctgcttctgcaattcttgtacctgcaatgacacagctcggcaggaccagaggtggtgcattttgcttgagaaagcaggcatattagcctcagtagaatagcaacaaaaaggccaaggcagtcggatcacctcaggtcaggagttcgagaccagcctggtcaacatggtgaaacctcatctctactaaaaatataaaaattagctaggcatggtctcaggcgcctgtaatcccagctacttgggaggctgaggcaggagaattgcttgaacctgggaggcggaggttgcagtgagccgagatcacgccactgcactccagcttgggtgacagagaaagactctgtttcaaaaacaaaaacaaacaaaacagagcaaaaaagaaaagcaagaaaaagaaagcttctggaagcatttccataggaaatggtttgttttttagctaagtcctggcacttgatctgacctctgattagctgtgcctcactcttggaaacaagattatgtagaagccccaagccccatctatcactatcacccaacaagtatcccatcttgttcatctactctcctgccccatctccctcccctcccttagccattattttaaaacatttttatatgaaaaaattacaaacatacaaaagccaagagcataatgaccctccatgtccccatcagctggcttcagtaatgatccacccatggccaacttctgattagtttgtatggaatccagggagattttcatatccttgatagctggagaattccttctcattctcctctctctgcccttggacatacagtgggggcctttaaagattatggttgtgagtttctcctaccacagataactaccctaggcacgaggagccaatccgattagaccccagaggaggggagggctgggtagggagagatggagagtaatggctggtgggtcctgtctgattttccagaccagagtccatttcttttccccaagaccacagggataaataaacccaactaatagccctcatgtgtcgcaggagcaggcctcagggattcccccaaactgagaggcctgggggagcctcctgagcaaaccccaggcattaagtcagataggaaactcatgacttgtgtgaggcaagctctgacctcagatttactgggcacagaaggaccctgtgtgcagagacagccctgccctgtggccaggcctggcagcaggatggaactcaagttagtctggagcagcggttcccagtgtggggcccacacctgcagtggtacacagaacctgggtgttagcacaaatatagatcatgtgtagaagaactagggacttcatggatattactgtttaacacaaggctgaatacataacactggaattaaagttggttgaaagaaaaccgtcaggtgactcatagtgaggtggcacagacatggccaaaaacttggagaccggatgaacataactgcagtctgagggatgcgggccaagggtactgagctgaggccaagagaaggcagggcaagggtggaagtggccatcacagagcagcctttctgcaggacgggggccctgtgctggccagcagaggcctccattagtccaggtccttggtgagaggcagataccaagacaggataggatttcatcaacaagataggatttcattaggacaaatacttgcaagaaaatgcagagggagctgggcaaggctgggagagccttgggaccatggtgcgccatttccgaggaaggctgggtgggcacttgctggcctgccttcggtctaaggcagactctccagggtgtccgttggccatcacagtcctatctgcctagtgtaccctctgcacacagtgcctggggaacagcccctgggaagcatggtccggatgcagatgcagggattgattggagccagccacagccaggcccgcagatagccaggctcccagcagctgggggtctccagctcgcattctcctggctgctagattcacacagcagcagggcaaagatcccaggaatgaggctgagggcagccccttgacaggctccagaccttgtctcaggtgatttcatgttatcagctatctgtgtgggttaattgtttagccaggctgattttactttcagtctcgtgaaataaaattttttgttttttgttttttgagactgagtctcgctctgttgcccaggttggagtgcagtggtatgatcttggctcactgcaacctctgcctcccaggtttaagcgattcttgtgcctcagcctcctgagtagctgggcctacaggcatgtgccaccatgcccggctaatttttgtatttttagtagagacagggtttcaccatgttgaccagactggtctcgaactcctgacctcaggtgatccacctgcctcagcctcccaaagcgctgggattacaggtgtgagccactgtgctggccaaaacaaattttttttttttgatacagtctcgctctgtcccccaggctggagtgcagtggcacagctcagctcacggcaacctttgcctccctggttcaagcaattctcctgccttagcctcccaagtagctgggattacaggcactcgccatcatgccaggctaatttttgtatttttgtagagatggggttttaccatgttggccaggctggtcttaaactctttttgtttgtttttttgtttgtttgttttgaagtggagtctcactctgtcacccaggctggagtgcagtggcacaatcttggctcatggtcttaaactcttaacctcaggtgatccacctgcctcggcctcccaaagtgctgggattacaagcctgagccactgtgcccaggccaaaataaattttttaatagccaaagttccagatgagtcattcctttcctgatgttgtaagccacaaatacctgaagcaggtagatttatccagtaatcttggggtcaagtccagtttcctttggaagggtcaggtccccagttactcagaagctgtccttgccatggggcttcctaggtatttccagatgatgatgtttgaagcctctggcctttggccaaggcctgcttctgtgcggaccagccaccatggctcacctcacccacggtctgtgcctgcgcccaccgaggagcccccctaccagatggcctcattagtcttcagattaatcttcacatggggcctagtgaagaaatttcaccctctttaacctcacgtttaagtgaccctaaactacttgtcaaacattccgtcttgtgaatcttgttcactcactaagggattggggcatagacatggccaagcatggtggctcacgcctataatcccagcactttgggaggccgaggcaagtggatcacttgaggtcaggagttcaaaaccagcctggccaacatggtgaaaccccatctctaataaaaatacaaaaattagccggcatcatggcgcacgcctatagtcccagctacttcgtaggctgaggcaggagaatcgcttgaacctgggagggggagtttgcagtgagctgagattgtgccactgcactccagcctgggtgacagagtgagactctgtttccaaaaaaaaaaaaaaaaaaagaacatagacactggaaccactgatgactgtgtgccccatgtgaagattaatctgaagactaatgaggccgtctggtaggggggctcctcggtgggcgcaggcacagactgtgggtgaggtgggccatggtggctggtccgcacagaagcaggccttggccaaaggccaaggcccttggaaaagtgacttaacttctccatgcctcatttcaccatctgcaaagaggcaatgaaaatggtgcagtggtaccttatttcctgattggcatgaggattagatgagttaacgcacgggaaggattttttttgagacagggtctcattctgcctcctaggctagagtgcagtggtgtgatcatggctcaatatagccttgacctcctgggcacaagtgatcctcatcctcccaagtagaggggaccacaggtgtacaccaccatacctggctattaaaaaaaaatcttttgtaggactgagcgcagtggctcatgcctgtaatcccagcactttgggaagccaaggtgggcagatcacgagttcaggagatcgagaccatcctggctaacacagtgaaaccccatctctactaaaaatacaaaaaattagctgggtgtggtggcgggcgcctgtagtcccagctactcgggaggctgaggcaggagaatggtgtgaacccgggaggcggagcttgcagtgagccgagattgtgccactgcactccagcctgggcaacagagggagactccatctcaaaaaaaaaaaagaaaaaaaatcttttgtagaaacgggatcttgtcatgttgcccaagctgatctcaaactcctgggctgaagcaatcctcctgcctcagcctcccaaagtgctggtattacagatgtgaagtatttagaacagtgcctggcatgatgtttgctaactcatgtacctagatgttaacttactccagccccgggcccttctactgccccacctctgcatgggctggttccactgccccatatctgcttgttgaaaacgtttctccatatttcaagcccaggtcaggtgccacttcctctgtgaaccctcctcatctcccagcctgttatggtctctcctgcctctgacctcgctctcccgtgggatgtatcctcggaggatagttactgcatccctgccctggtggaggtttctggaaggcaggcttggtagctagttcacctctgtgtctttttctgctctttgagtaggaggtgagatagtgcagggcctagaagtcaaacagatttccgtctgaatttcggctctaccatctactggctgggtggtcctgagcactgcgtctacctccggtgtctccgtgtctccacttgccaactgggatgataaacaggccccaggttgtaggggagtcagaggcttatcctgaggtgatgcttgaggagtgtgttggttggcacatggtgggtgtcaggaattggcagcaacaagtgtttggggagtgaacaggagactggcatagtctgaggactagaccaggatccctcctgtcttcctccccgaggctgcatcctgacccatagtccctcctttccagggtcctctccagccagagcccaccagccggcctttctccagcctcctgaagaagatgcccctcattccttgagaagcgacctccccacttcgtctgattcaaaggtaaatccacccctcggctgcagcccccaagccatgtctcccagcgtgtagttccctctcaaaaatgcaatttctctaccccttgagaccagtttaagggtggagaggagaaaggaaattgccatcaaattaccccaagcttctaagactgtaagtagaggaggtcaataatagcggggagagggagggagggcacttcagtgaatatacttcttgttttttaatttgttattattattatttttgagacagagtctcgctctgccacccaggctggagtgcagtggcacgatctcgggtcactgcaacctccgcttcccgggttcaagtgattctcctgcctcagcctcccaagtagctgggattacaggtgcatgtcaccatgctcggctaattttttgtatttttagtagagacggggtctcaccatgttggccagcttggtctcgaactcctgacgtcaggtgatccacctgcctccgcctcccaaagtgcttggattacaggcatgagccactgcacccggccattattttcttttattattttattttattttcgacctgtggtctcagctacttgggaggctgaggcgggaggatggcttcagcccaggaggcagaagttgcagtgagctgtgatcctaccaccacattccaccctgggtgacagagtgagaccctgtctccaaaaatgtatgaccatattggtacgaagataaataaaatccaagcaggattaaaaatgaggacatttctttgactctaaaagtccatttattttcttctgattttaaaataaattaaaatgttctgatggcccctaaaagtgttgtgagcctagaccctttgcatccagtgcctgggggagaagccagctttgcatgagtgtggttaatgaagctcttccatgtcccaggtgtggtgtcacatgcctgtagtcctggctatttgggaggctgaggtgggaggatcgcttgagcccaggagttggagaccagcctaggcaacacagggaggccccatctctaaattaataaatagatcaaccttccatgaaggataaacccaacactttgggaggttggtatgggaggttcacttgagcccagtactttgagaccaacctgggcaacagtgtgagatcctgtgtctacaaaaaagttttttttgtttttgtgttttttttgaggagtctcgctccattgcccaggctggagtgcagtggcacgatcttggtcactgtaacctctgcctcccaggttcaagctattctcctgcctcagcctcctgagtagctgggattacatgcacatgccagcatgtttggctaatttttttttgtatttttagtggagacagggtttcgccatgttggccaggctggtcttgaactcctggcctcatgtgatccgcccacctcagcatcccaaagtgctgggattacaggcatgagccaccgtgcctggccaaaaagtttttttgagacaaagtctccctctgttgcccaggctgtctcgactcactgaaacctctggttccccagtttaagcgattctcctgcctcagcctcctgagtatccgggattataggtgtgtgccaccacgcctggctaatttttgtatttttagtagagacacggtttcaccatattgcccaggctggtcttgaactcctggcctcagaggatccgcctgccttggcctcccacatatggtgagattacaagcagtgaatcactgtgcctggcctcgccaaaaaaaaaagtttaaaaaataagccaggcgtggtggcacacacctgtagtcccagctacttgggggcgctgagatgaaaggatcccttgagcctgggaggttgaggctgcggtgagctgacatcatgccattgcactccagccttggtgtcaaagtgagaccctgtctcaaaaagaaatcaaaactatgtgtgtggcatgataccagttttgttaaataaatcctagtatatctaattggccggaaatacactaactttaatagcagttaaatggataatggggttatggatactaattttcaaaaactgttaagagcatatgtaacttaaaaaaattgaaatttaggccgggcgcggtggctcgtgcctgtaatcccagcactttgggaggccaagtcgggcggatcacgaggtcaggagatggagaccatcctggctaacacggtgaggcctcatctctactaaaaaaattacaaaaaattagccggacagggtggtgggtgcctgtagtcccagctgctcgggagactgaggaaggagaatggcgtgaacctgggaggcggagcttgcagtgagccgagatcacaccactgcactccagcctgggtgacagtacgagactctgtctcaaaaaaaaaaaaaaaattacgtacatgtgttttaaagagagaagttattaaaaacggaaacagaacttctttttataggcttatatacacatgcagtctctggaattctgtttaaagcaagcttgtcttacttgcccatggttgtgtgcagcccaggatggctttgaatgtggcccaacacaaatttgtaaagtttcttaaaacattatgagttttttttgcaattttttttttaaagctcatcagctatcattagtattagtgtattttatgtgtggcccaagacaattcttcttccagtgtggtccagggaagtcaaaaattggacacccctggtttggttatatgaacctgtatcctacttcccaggagtctggaaccccagtatctatgctgtgaattagaccaagagtgctgagctcggccactgaccagctgtgggacctcacttcagctgttttatttcctcagtgcttacttctgtaaactgaaataaaggaaacatcaaccatgtgccaggaatactcacatcttagtcttcaaaattactcttcggggtactattgttaccttcatttttgctgatggaaaaaattgaggctcagagaggttaagtaactcacccaaggtcacagagcaagatacagatggagctgggatttgagcttgggcctatccatgtcctttttttttttttttttttgagacagagtctcgctctgtcacccaggctggagtgcagtggcgcgatctcggctcactgcaagctccgcctcctgggttcaccccattctcctgcctcagcctcccgagtagctgggactacaggcgcccgccaccacgcctggataatttttttttgtattttttagtagagacggggtttcactgtgttagccaggatggtcttgatctcctgacctcgtgatccgcccgcctcggcctcccaaagtgctgggattacaggcgtgagccaccgtgcccggcctatccatgtcctttttacagtttccattggataagttgatcccctccatccctccatctctggtgttccaaggtcccttgaggtagcagagaaaacgagattccatagtaatctccatctcttctctctgggtctccaggacttcagcacctccattcctaagcaggaaaaacttttgagcttggctggagacagccttttctggagtgaggcagacgtggtccaggcaaccgatgacttcaatcaaaaccgcaaaatcagccaggggacctttgctgacgtctacagagggcacaggcacgggaagccattcgtcttcaagaagctcagagaggtgagcacttcttggtttctagtgggggtggaggctgcaggggtggggcgggatcttcatgttctgatgtctttctctacagacagcctgttcaagtccaggatcaatcgaaagattcttccaggcagagttgcagatttgtcttaggtaagcctcccctttgtttagtaataatgatagctaacctttatatagtgcttcctgtgtgcccagtcatgttttaagcactctattatatataaactcatttagtccttacaagaaccctataaatgtagctactattatcacattattttacagatgggtaaattgaggcacagaggggttaaatgtctcatccaaggtcacacagctaatgagtggcagagccaggatttggatctacctggtttggctccagagtccattcttctcctgtgtagcaattctatgtgtagattagaattataaaggaaacttggcttactccaactccttccttccacatgggaataaatcttctctcctttttttttttcttttcttttctttttttgttttttgagacagagtcttgctctgtctcccaggctggagtgcagtggcgtgatctcggctcactgcaatctctgcctaccaggttcaggtgattctcgtgccttagcctcccgagtagctgggattacaggcgtgcgccaccaggcccggctaattttcatatttttagtagagacggggttttgacatgttggccaggatggtctcaaattcctgacctcaagtgatctttctgctttggcttcctaaagtgctgggattacaggcgtgagccaccgtgcctgacttttttttcttttttaagagctagggtcttgctctattgcccaggctggaatggccttggaatgattgtagatcactgcagctttgaactcatgggctggtgatcctcccacctcagcctctgagaagctgggactacaggtgtgcgcccagctcattttttgcttttttttttttttttttttgtagagatagggtcttgctatgttgaccaggctggtgttgagctcccgggctcaagtgatcctcctgccttgacctcccaagatgttgggattataggtgtgagccactgtgccctgccatgtgtgtgctttttttttttttaattatttttcatctgaaacacttgtgccttatattgtagggtattttaagaaataaagaaaattgagtatctgttcattctgtaaccagtgttaaaaaataaagaaaattgaccaggtatggtggtttatgcctgtaatcctagaactttgatgctgaggcaagaggattccttgagccaaggagtttgagaccagcttgggcaacatagcgagaccctgtctcaactgaaaaaaatatatatacaaaaactttttttggctgggcatggtggctcgcacctataatcccagcactttgggaggctgaggcgagtggatcacttaagtccaggagttcaagatcagctgggcaacatggcaaaaccccgtctctacaaaaaatacaaaaattagctgggtgtggtggtgtatgcctgcagtcccagctactcaggaggctgatgggaggatcacttgagcccaggaggcagaagttgcagtgagccgagatcatgacactacactccagccggggcaacaaagtgagtctctgtctcaaaaataaataaaggccaggcatggtggctcacacctgtaatgccagcactttgggaggccgaggtgggcagatcagttgaggtcaggagtttgagaccagcctggccaacatggcgaaacctcatctctactaaaaaaaattcatacaaaaatcagcctggtgtgttggcatgcacctgtagtcccagctactcaggaggctgaggcatgagaatcacttgagcccagaaagtggaggttgcagtgagcccagatcgcaccactgcactccagcctgggcaatagagtgagactctgtctcaaaaaaaaaaaaaaaaaaaaattaattaattaattaaaaagtaaaacaaatttaaaaaggaataaagaaaattataaataagaaaatagaaactttttcacagcacctataaataagcactactgttttaatattttgatatattttcatttttaattgttaaaactttttttgtagagacacgatctcactatgttgcccaggttggttttgaactccctggctcaagtgatcctcctgctttggcctccaaaagtgttgggattttagatgtgagccactgtgctgggcccatattttgatatgttttctttaatgctttctctattcatacatgtatatgaatactcacatgtgtacacacacacacacacacacacagatacacacacacacatacatctaataaaaactggaagtatgattccctttccactttggcttagtgctttcatggagtcggcagtcactccttcattcattgattcagaaaatgtgggtagttaagcccttttctaggctctagggagtgtacgccagaagcatacagagcccctgccttggggaggtttatggtccagtggggagactgacatgtaaataactctaataagtatgcaaaagcgagtaataggatggcttgcgggaagcagaggagggcggagagataaggcaggaggccatttacagcagtcttggggaggctgaatcagagcctgacccaatccaagtgacccaaggcagaggagaggggaatgaagggacattttaaaagttatttgtggcagtgaatggtgactgatttgatacgggagataagaaggtttctaggaaactgggtgggtggtgatgtgcctttctgggataataaatatgggtgaagaagcaggtttgggacttgttgaggctaggatgatgttgacctgagcatcaggatgcaaattgacattcaggtctggagcttaggatggggctggagataagagatttgggaatattccttatagcaatgggaggttcctggaggagcaacatacaaaacaagatgaggagtccagctggcagaaagaggaaggcaaaggaggagggtcttagtgaaaagggccaggaaagagtggtcagagaggtaggaggaaagtcaggagggaatggtgactgagaaccagcagaagaggatttcaggaaagaaccccagtcctagagtcaggcaggtgtgggatctggtcctggctttactgctttctagtttgtgaccttgggcaagtcccttaacctctcagtctccgtttctggagatggggcagttgagatgtcatgtgttgcagagcagtaaagcaggatgaggaccaccatactcgttgaaggcagacagttttcatctttccaccctggggccaggcccttaggggtcagagtatgtggtacctgggaggttattggtggcgttggaggaggagagggcagaagaggggtgggacatgaggaagtagatcattctttccgtctgactcctcacacctgcactgacgcccgattccagatgctgccaccccaatgtcttacctgtgctgggcttctgtgctgcaagacagtttcacagcttcatctacccctacatggcaaatggttccctacaggacagactgcagggtcaggtaagggactgggtcatggtcagagaatgggaccaggctgcacccagccatggggtcaagggttaaggacttacagaagttcagaggggagaggggccatctaggtgagaccagggagacttcaaggagagaagtggggccaggatacataagatctggttaagtgctcactttggcagcacatataccaaaattggaacgatacagagaagatcagcatggcctctgaatgaggatgacaaaatatgaaaaagaaaaagaaaagctcaaaaagatctgattaaacatcttcaggaaaaatctataaaaaattatttgacgagaagcatttcattcaaatcaagagcaggacaaaggtatctcatagaactaacttcgttcgtcatggttctggaggtgttagccaatgcagtaggacaagaaaaagaattaagaggtaaagagtatggaaaagtggaggtgaatttttattataaaatgttcttctaatatatacctatttgcttgtgtgtttatggaatgtctctggaaagatacacaagaaactggtttactggctgctgctagggagcagaactaggtgattggggcctaggataagaagcaaacttactattagagtattatatcatgtgaaggtaatccttaataaaaattacagtgttttaaaacaggtcttctgcttatcttatcctcaaatagaggggaaagagttattccataacagaattattgcttcccatggcagggacaagacaaagcagttactcacggcatactaatgatctttagcttttctgggcactcactgtatgcaggttgctgtgataagggttttacgtaggtcatcacctccaggccgtgccacaaccaaagcaatttcttccctcatttttcaaaagaggaatctctgacacatagagacaaagtgacttgcccaaaggaacatagaggacaaatgtcaggccagagcttacattgggttcgtctggctctaggtttcagagtttttgagaagaaattagcaggggctgtccaggccagttcttagaggatgtgggacctacaccagggcttcaaaaataggtgatgaggctgggcacagtggctcacgcctgtaatcccagtacattgggaagccgaggtgggtggatcacttgaggtcaggagtttgacaccagcctgaccaatatggtgaaaccctgtctctactaaaaatataagaattagccaggcgtggtggcgtgtgcctgtagtaccagctactgaggaggctgagacaggagaatcacttgaacccgggaggcagaggttgcggtgagccgagattgcaccactgcactccagcctgggcgacaaagtgagactccgtctcaaaaaaaaaaaaaaaaaaaaaaccaaaacggtgatgatttagcctgggagagtcagtcttagaacaacagtgggagcaaatgagaggctttagcccatcccacaatccccatcagccctggtgaagtttcccctaatacagataaaatcagcgtaaggcccaggtgcttggcttgcaaacacaagctccctagctcctctcccatccagcttcttttagagagaaattccagagcagcctctgtaatggacatgataaaaataactgctgattgagcacctactgtgtggcaggtgctatgctaggggtataccatatactcccttgaatccttacagcaaccctaaaatatagggattaacatttccattttatacccaaggaaactgaggctcagagatgttaagtgtctttttccaaaattatacagctaatgcatgtctgaactgggagttacacctagatctgtctgatgtcaaaacccatagtacagggtcaggcacatggctcatgcctgtaattccagcactttgggagagcgaggtggacggatcgcttgagcccaggagttcgagaccagcctggccaacatggcaaaaccctgtctccacgaaaaatacaaaaattagttgagagtggtggcacgtgcctgtgatcccagctattcgggagtctgaggcgggagagtcacttcagcctgggattttaaggctacagtgagctatgatgctgcactccagtctgggtgacagagcaagacctgtctcaaaaccagcaaacacaaaacaatgaaaaaactcacagtatcatgctgagccctgtgacagaggacatgaagggtgggaggaggatcaggagcctgggaccctgccatcaggacttcgtttttttgtttttgtttttgtttttttttgagatggagtctcgctctgtcacccaggctgcagtgcagtggtgcaatctcggcttactgcaagctctgcctcctgggttcacgccattctcctgcctcagcctcccaaatagctgggactacaggcagccgccaccaggaccggctaattttttgtatttttagtagagatggggtttcaccgtgttagccaggatggtctcgatctcctgaactagtgatctgcctgcctgggcctcccagtgtgctgggattacaggtgtgagccaccgcacctggctgccatcaggactttaaaaaggtacattgtgactatttgtcctcctgcttttctttctcttagggtggctcggaccccctcccctggccccagcgtgtcagcatctgctcagggctgctctgtgccgtcgagtacctgcatggtctggagatcatccacagcaacgtcaagaggtgagagaggtgggctggaccctgctggggcctgggctgcaagggtggaactggtgcctattcctggctcacctcccgctccgccactcacccctgtcctctttgtttttctcttcctacctcctctcctctgccctcccctggatgtctttttctctgttatgccctcaaaaatgagtgtttccgggctgtgctccaagtccaattgctctcaggatgaattgcctacctgtcacatttgtctttctgagctgctgttttcccaacaagccctccacaccttgctgcgtcgcactgtccactcagcagctggcctggacctcatcctcgaactttgggccatgtctgccaaccccctgggattttgagctcctcgttcagtgtcttttctgagacctgtccccttcttgtgtagctgttggtgttagcatcttgtctggaaggctcctgcaggttaggcctgcacccctgcatgtcagtgccatgcacatgagagggagaggtccccatctggagacggttaggatagggagggattccgaagataccagaatatctggcagaactggctccagagacacagaactcgtatttccccaaagttctctttccatttgacttgtggaagtcctttcctcttttctctcccccaattttttttttgttttttgagacggagtttcacgcttgtcacccaggctgaaatgcagtggtgcgatctcagctcactgcaacctccacctccctggttcaagcgattctcctgccttagcctcctgagtagctgggattacaggtgctcgccaccacacccagctaatttttgtatttttagtagataggctttcaccatgttggccaggctagtgtcgaactcctgacctcaggtgatccacccgccttggtctcctatagtgctgggattacaggtgagagccaccaccccggctctctcccctaatttttatttgattgcatcaataattctaatagcaggcaaggaaatgaaagggtgagagaggtcaccactaacctaccccatgactcatcagctggcctctaggttttgtttcttttttcacttcctgcctatacaaatccttagtcctgaggtagcacctgggtaccaattcacatcctgttttttaccccttcatttaaacatagtaaacatttcgctacattgtataccgtcatgttttttagtgtcttagtcttcccgtgaaggaatttgcccataatttacttaaccactcctggcacacacacccgtgcatttgcgggcgtgcacacacacacacgctaaaaaagttttttttttggccgggcgcggtggctcacgcctgtaatcccagcactttgggtggccaaggcgggcagatcacgaggtcaagagatcgagaccatcctggctaacacggtgaaacctcgtctctactaaaaataccaaaaaaaaaaatttttttttttttttttttttttgagatggagtcgcgctctgtggcccaggctggagtgcagtggcacaatctctgttcactgcaagctccgcctcccaggttcacgccattctcctgcctcagcctccagagtagctgggactacaggcgcctgccaccatgcccggctaactttttgtatttttagtagagatagggtttcactgtgttagccatgatggtctcgatctcctgacctcgtgatccacccaccttggcctcccaaagtgctgggattacaggtgtgagccaccgcgcctggccaaaaaaaatttttttttgagacagggccttgctcttttgcccaggctggagtacagtggcgcaatctcagctcaccgcagcttcccaccttagcctcccaagtagctgggaccacaggcacgcaccaccatgccgtgctgaatttgtttgttttagtagagatgaggtcttgccatgctgcccatgctggtctcaaactcctgggctcaggtgatcctcctgtctcggcctcacaaagtgttgggattacaggcatgagtcactgcacctggcctgcactatatatctgtacacatgtggcttagctttttcccattttggagtatgttctcagtgtttgctcctgggggttagatgactagatcaaatgattttttttgagacagtgtaccactctgttgcccaggctggagtgcacctctgcttccgggttcaagcaattctcctgcctcagcctcctgagtagctgggactacaggcgcacaccaccacggctggttaatttttgtatttttagtagagatggagtttcggcatgctggccaggctggtcttgaactcctgacctcaggtgatctgcccatctcggcctcccaaagtgctgggattacaggcgtgagccactgtgcccggccaagagggaatttttttttctttctttttttacatgatctgggcaggtttagtcacaaaggatgctggccacttagacctgagtcagccaggccagagctgggggttggaacagttgtggaagagactgagtctgcacagcctgtaggcgtggcaagctgaggctgatcagggttggcatctgtggggatcagggaggctgcactttggccacattcctggggcagcaagactaagtctgaactccatctccatttgctggagggagtgtgctcctgatgccctctcttccccagtcagggctggctcagaagctccatgctgagggtctttagagacctcaacttgcaggaggtgaggttgctatattgtctccccaaagggtctccatggcaacttgttgttatccagctcaaaatgagaaggttccctctcctttcatttccacagctctaatgtcttgctggaccaaaatctcacccccaaacttgctcacccaatggctcatctgtgtcctgtcaacaaaaggtcaaaatacaccatgatgaagactcacctgctccggacgtcagccgcgtatctgccagaggatttcatccgggtggggcagctgacaaagcgagtggacatcttcagctgtggaatagtaagagtgtcctgctctgcgtagagtggggcccaccttgatttgtccttcccacggctcctttgtaatcacaggatacggtagaggcacacagacaggttccatcaaagtacaacaggggctgacaaactgtggcccacaggccactttggcctgtggcgtattttgtatggtctgtgagctaagggtagttttacatttataaaggattatatttttaaacacaaagaatatgtgatagagactgaacatgctccccaaaagctcacatatttactgtgtggcgtgttacagaagaaatttgccagcccttgaaggaaaaccactcatgagtgtccaggttctagtaggctccagatatcctctcctgacttccgtaattcccatccagccatccacttgtccatccagttgtctatttgtccttatttgttcatcgctgtccgatcatccatctaccctttagctgcccatccattcagcgaccactgacccacccagcatcccaccctaccaccaccaccatccttgtctgccattatgtcgtgccaggcactaggaatatgaatgtaacaaaaacacagtccctcccctcaggagctcatggtctgcatgtagcagtctccaaagtatatttctgtagaactccagttccttcggacctctaggattgatgtgttaaaagggtttgtgccctgacaggcttggaaatattgcattaggcaaagtcaagcaggtttctttaccacaagattaattcaagctggttgaatggtagtgagcctttaatctggtacttgtgaattcaccagagaggggtatgcagtgtttcccaagctcatttgactatggaaccttgtgttctcagaatatctgtccttgtcagtgttccatggaacccagtctgggaaatgctggctgagaagagtaacagtcaggttggcttcagccaagtgcatacagctgccccttgggcctcaccctcttttcttctctagccttgaactctgtacttcctctctctgaccacagtctcctgtctgtctacctctgctaccagaaccgtggccctgagtcacctctgccctcagccagaaccccagattctgcacctccgtgtctcccagctggttcctctgcctccctcagccccactgcaagttgttcagtgaagctcagcagggctagtccaggctccttctcctttaagaaccagggggatgggcagggagtggtggcacatgcctaaaatctcagtactttgggaggccgatgtgggcagatcacctgaggtcaggagttcaagaccaacctggccaacatggtgaaaccccggctctactaaaaatacaaaaattagctgagtgtggtggcatgtgcctgtaatcgcagctacctgggaggctgagtcaggagaatcacttgaacctgggaggcagaggttgcagtaagccgagatcgcgccattgcactccagcctgggcaacagagcaagattctgtctcaaaaaaaaaaaaaaagaaaaaaaagaaccagggggatagaacccctaggcccggctcagttactttcagctgtgtgacttacacctagcacttctgtctctgggcctcagttaagccttctgtaagatggggctaacgatacacatggagatgaatgggataatgtatataagcaggtgagcatggcaccctgcaccctgcacctaccaagaatattatgatgactgtggttattgttattcccacctttacaccctccttctgatatctgtttactcttgaccttctaactggtgtgttagcgtcacagatgacttcctcatccatccattcaccctcccacctatccatctattcatccacccatgcacccaccctcccacccacatacccatccatccatccatccatccatccatccatccatccatccatccatccatctaccacccatccatccattcattcattgaatgcctcctggctcctgccacccttttgctcagccctgcctctggttgactgataacgcttttgaactttgattcctcctgtggggatcacagtgcattgctcagtgttttttggtgagtgctcagtgacctctataaaggacttggctcagagcctgctctgtgaaaggggcacaggaagtctttgtttattcatttccccttgttctgtcccttcctggcagggacctgtcaggagtcccttttcaattggctcctgtcccacttgcagcagtgatgccctctgctgcccttttctggtcactgccagtctgttattaatcctgggtggtttaaaacctttatcctttccttcctccaggcttggagggattcttggctataaatgtgaccctattctgacttgctttgagagatgctgtgggagagaggttccacactaagtgtggggtcttcacacctttaatattcacaactgctagtccccatttaacagatgaggacactgaggctcaggttttagttacttgcctaaagatcacctgagcatataaggaacagagtcagaatttgaactcaggcctgactgtagagcccttagccatcatagcattgtctctactgagaaaccctgttcaaagcagtttcctgtttatgaagacatatatcatggtttgccaattttgtggtgacttacacgtatacagggttgtgctccttctgcgagtggatgcgctaatgaataaataatgttagtaaaggcctgtgagtgaaacatgctatggatgctgcaagatttgtctagaatagatacctgcctgcatgcagagtctttccttccctgagattcacagagcaatgcctgcttgccatagctgaaggttttttggtgtttttttttttttttgagacggagtcttgctctgtcgcccaggctggagtgcagtggtgcgatctcagttcactgcaagatccacctcccaggttcacgccattctcctgcctcagcctcccaagcacctgggactacaggcacccgccaccgcgcctggctcatttttttgtatctttagtagagacggggtttcgctgtgttagccaggatggtctcgatctcctgaccacgtgatccgcccacctcagcctcccaaagtgctgggattacaggcatgatccaccgtgcccagccagctgaaggatttttaaatgaaacaatctttaaaaaatagtgtatatatacgtgtgtgtgtatctatatttatctatacctatatatatcttatggtaatacatataaacacacacacacatgaatttttgaaaaccatcttctctgcctggctatcaattaattacaaccttccactggcagcttggtggcatctttaattggaggaggtgtttagtgatattcccatgttccagattttgggcaggtgtgtctgctggcaatggcagagctgcacctggagctcagaactgagaagagaagacagaatctgctgcctggctgtgtgcacgagcgtctgaaccatgctaactcacgttctgttctctccaggtgttggccgaggtcctcacgggcatccctgcaatggataacaaccgaagcccggtttacctggtaagggaacttgtcacatctggctgggaggtatatttgggcctcacagctctgtagagagggcaacgacctcaattctagctagttttacacatgcaaatgaggcccggtacaaggttgcatttgcatccccacaaagcagctttaacctcccatccccacctgccagccaaccattgctttttcatgataatagcatctggggcttggtgcggtggctcatgcctgtgatcacagcctttgggagactgatgtgggtggatcatttgagaccaggagttcaagaccagcctggccaacatggtgaaaccctgtctctattaaaaaaaaagaaaagaaaaaacttacaaaaaacccccaacattatccaggtgtggtcgcatgtgcctgtaatcccagctactcgggaggctgaggcaggagaatcacttgaacctgggaggcagaggttgcagtgaaccaagattatgccactgcactccagcctgggtgacagagcgagactccatctcaaaaaaaaaaaaaaaaaaaagattttggaatgtttatagaaagcacttgtataaaagagaaagcacttctctatatatcaggcaattcattagggattttcctcaaattgataaaagttaatttcagcccttttaaacaagtttctataataaaaacaatttccattttgtaggccaaagatctgatatacacagtcatttaaaaaatataacaacctggctgggtgtggtggctcacacctctaatcccagcactttggaggaggccaaggcgggcggatcacttgaggctgggagttcgagaccagcctgggcaacatggcgaaaccctgtctctactaaaaatacaaaaattagccaagcgtagtggcacacacctgtaatcccagctacttgggaggctgaggcaggagaatcgcttgaacccaggagacagaggttgcggtgagccaagattgcaccactgcactccagcctgggtgacagagtgagaccctctctcaaaaaagaataaaaatataacaacctagcctgactttgtgttaaatactttccatacattatctacctaaatcatctcaatttttccatgatagagtcattatattcatctgcagatgaggaaagctggctctgagtttggcctaggatctcagttggaattaccaagtgtcagagctggaattctgagtcagatctccctgagccgacatcatgagttttttttttgtttttgtttttgagacggagtcttgctctgtcgcccaggctgcagtgcagtggtgcaatctcggctcactacaagctccacctcccgggttcatgccattcttctgcctcagcctcccgagcagctgggactacaggcgcccaccaccacacctggctaatttttttgtatttttagtagagatggggtttcactgtgttagccaggatggtctcaatctcctgacctcgtgatccgcccgcctcggcctcccaaagtgctgggattacaggatcttgagttcttaaccacagcagtctcctgcttgtttcttgtgacagtccaaccatacgaattcagtattatcattcccatttacagctgagaaaactgagggcaagctgaagtgacttgtctcacgcccctcagtgagaccagtggtggaagtggggtttaaattgaacccaaggcttttgcagagtttcaaatctcatccaaactctagtcttcctcatcagtttgagagggggcaccttttcctactgggtattgaggccattggaacagacagattattattttatttatttatttatttctggtgactgggccccagaagcatcccctgggctctggggtagggaggctgaaggcctcgctactccatgcagaaagtcacgacatgttcctttgatgaactctgtgagttccaccccttttgggcagtcaatcccatatgctgcagagaggtctgtctgggcagctcagatgtggtttggggctgtttgggggcagtttctcatctcctgactattttcttgagatggatttcccagcagtcctctggggctccccggacaagtgtcacagtggaaggaggcttttgaggcactgacaggaagttgtctagaattatttttttgctaatgatttctaaaaatgtggaaaataacaattttttaaaatgtagtttctttctcttattctagactcttgtatggtctcttatcatgttctgttgtggtaggtgcaatccaatggttaatcaagatttgagtcagggaggaaagcttgctgatttcctgtggcccagggtaggaggaagcaggcctcctccaggcttgggaaagtgttagttgccacagtgtttcctgagggcatttggtggtttccacctaaattgaaaatatgagtaccctctgacacggcagttccatttgtgcctagagaaacatgcacacatgtgaggagaggcagatgaacaaggatatttgtagtggcatttttttttttttcgagacagagtctcgctctgttgcccaggctggagtgcagtgggcgtgatcttggctcactgcaacctccaccccccgggttcaagagattctcctgcctcagcctcctgagtagctgggactacaggtgcgcatcaccacacccggctaatttttgtattttttttagtagtgacagggttttgccatgttggccaggctggtcttgaactcctgacatcactcaggtgatctgcccaccttgacctcccaaagtgttgggattacaggagtgagccactgcgcctggccaaatttaatttaatttgatttagagatagggaggggtcttgccctgtcacccaggccagagtgcagtggcatgattgtagctcactgcagcctcgaatgcctgggctcaagcgatcttcccatcttggcctcccaaattgtgaggattacaggtgtgagccatggcgcccagcctgtatgagttttgacaaatgtatacagtcatgtaaccaccaccacaatcaagatacggaatatttttgtcaccccagaaaattccctccacttacaggtcctggcaattactcatctaatttctgtccacatagctctatcttctttagagggtcatatcaatgggcccatggcagatgcacccatttgtttctgtcccccttcatgtagcatggtgcttagattcatccatgttgttgacgtgtcagtaattcattccttttcattgctgaagagtattccattgtatggatagatgactgtttatccatttaccagttgctggacatttgggttatttccaggttttggcaattctgaataaagccaacacaaacattcttattttaaaaaaatgaaaaagaggccgggcacagtggctcacggctgtaatcgcggcactttgggaggctgaggtgggtggatcacttgagttcaggagttcaagaccagcctgggcaacatggtgaaaccccgtctctactaaaaacacaaaattagccctgtgtggtggcgagtgcctgtaatcccagctactcaggaggctgaagcaggagaatcgcttgaacctgggaggcagagtacagtgagtcgagattgtgccacagcactccagcctgggcaacagagtgagactctgtctcaaaaaaataaaaaagtaaattgaaaaagacatgtatgttctgacagggacatatctccaagtgaacaaagcaaattcagaatagtatatagtatgatcacatttttgctaaaaatagatggatgaatgaatgaaaacattgtatcacatattttcttctctataaattgaggataatagtagtacccccccccaccgacaaggtatgtttgtttgttatcatttttggagatagggtctcctatctcctatcttctttgtcacgaaggctggaggagtgcagtggcatgatcatagctcactgtcacctcgaactcctgggctcaagggatcctcccaccttagcctcccgggtagctgggattataggcatgagccactgtgcctggcatctgacaggtttattgaaggttaaataatatgtgagatgcctaaaatagtaactagaacataataaacaatatatgttaactattagtattatcattattatttgagataaggtctctgccaccctggctagtatgtagtggtgcaatcatggctcactgtaaccttgtacccctggcctcaagtgatcccctgctttagcctcccaagtaattgggaccacaggcacgtgccgccactcctagctaatttttatttttattttatttatttatttttattttgagacagagtcttgctctgtcgcccaggctggagtacagtggtgcaatctccgctcactgcagcctctgcctcctggcttcaattgattctcctgcctcagtctcccaagtagctgggattacaggcatggaccaacatgcccagctaatttttgtatttttaatagagacagggtttcaccatgttggccaggctggtcttgaactcctgacctcaagtgatccacctgcctcggcggcctcccaagtacctgggaccacaggcatgtgccctcacgcccagctaatttttaatttgttatttgtagagatggggtcttgttacgttgcccaggctgatattgctattattttaacagcttttaggatactgttataattattatataagtaaatataaaaccaaaataattatagctgtatagcagaaaataatataatccaaactattagcaggagttacctttggagagtagaaatgaaaggtaaacttttgtccccaaattttaaccacttatgtttaattttaatttttttttgaaatggagtctccctctgtggcccaggctggagtacagtggtgtgcttttggcttaccacaacctctgtctcccaggttcaagcaattctcctgcctcagcttcccatgtagctgggatcacaggtgtgtgccaccatggcccagataatttttgtatttttaatagagatggggttttgccatgttgcccaggctggtctcgaactcctgagcccaagtgatcctcctgccttggcctcccaaagtgttgggattacaggtgtgagccaccgtgcccagccaaaagttgctttttaagggtggtttgtttgaaactagaccccaaaaatgtccatatattactttggttatgtttgtttttttcatttttaaaaaaaaattttatgtggagatgggatgtcactttgttgcccaggcgagtttcgagctcctgggcttaagcattcgcctgcctcaacctcccaaagtgctgacattacaggtgtgaaccaccacgcccgggcatggttatgtttcttaagactcttattcttggccgggcacggtggctcaagcctgtaatcccagcactttgggaggctgaggcaggcggatcacaaggtcaggagatcgagaccatcctggctaacatggtgaaaccccgtctctactaaaaatacaaaaaaattagccgggcatggtggcgggtgcctgtagtcccagctactcgggaggctgaggcaggagaatggcatgaacccaggaggcggagcttgcagtgagccgagatcgtgccactgcactacagcctgggcgacagagcgagactccgtctcaacaacaacaacaaaaagactcttattctctcacaacctctcccgcaatgccctttttcattttggatgtcgttggatttttgcatagactaggtcatttgccctatgtagacagactgtctcacattctgggttttgctcattacatcctgtggtctccttcccttgtttctctattcctcatatttcctatatttggcagttagcacttgtgacttgtttagagtcatggtcattgcctttgtcaagaacacttcctggaggcgctgtgagcctcccattgcttcactacacggggcgtagcctgttgtcctacttttagtgctaagaccgatcagtgtgttaaggttttagtgctaagattgatcagtggtttcaggtggagctgccgactcctccatggtgaagttccctcgacatcctttcatcgcgtgttctcagtcccccaacccctgtttaaacactaggtgtcttctgtagtttttttgattatcgtcatagtctttgcatcaagatacatagcaatgatggcaggtttccatttggggcaaattgtgagaccctgcctctagaaaagaagaaaataatacacttctactgttcttgattatcagctttaaacactagtacactttaaaaaaaaaataaacatttaggctgggtgcagtggctcacacctataatctgagcactttgagatgccaagacaggaggattagttgagcccaggagttcaagaccagcctgggcaacataatgagactccatctctacaaaaaatttaaaaattagccaagtacagtagcatgtgcctatagtcccagctacttgggaggctgaggtgggaggatcgattgaatcgaggaggttgagactgtagtgagctgtgattatatcactgtgcccggcctatttttatttttatttcttatttatattttgagacggagtctcactctgtcgcccaggctggaatgcagtggcgcaatcttggctcactgaagcctctccctccccagttcaagcaattctcctacctcagcctcccgagtacctgggactataggcacgcaccgccatgcccggctaattttttgtattttttagtagcgacgaggtttcaccgtgtcagccaggctggtctcgaactcctgacctcgagtgatctgccagtctcggcctcgcaaagtgctgggattacaggcatgaggcaccgcacctggcctacaatacatgtttttacaatatttagtatgtttgtaacattcatatatgctaatcatatataccatattactcatgaaatatacaatataatttatattaaatatgcttacatatttgtataaaattattatatagcatatgttctattgtatgcatagttcagattgctgcattttatgtggtacaaaatataaaatatatgtaaatacaaaatgtataagaagtatagacataatattttctttatagtggctctcctgttatgtatataggtcagaatcctacatttgaaatgtttgtatcataagagattgtccatgtagttaataagattaaattattaagtgcttatcatgtagtaagtgccatataaatggtagctattattactattagttattatcactaaaagactattgaatgttccgtgtcagatgtcactctctgtgctttaggtgcactgtttcattgaatggttgtgttagtcctaggtgtaggtattttattatttttttgagacagaatctcgctgtcacctaggctggagtgcagtggcgtgatctcagctcattgcagcctccgccccccacctcccccaccataggttcaagcaattcctctgcctcagccgccctagtagctgtgattacaggcgtgcactaccaagcccagctaatttttatatttctagtagagacggggtttcgccctgttggccaggctggctcgaactcctgacctcaagtgatccactcgcttctgcctcccaaagtgctaagattacaggcttgagccactgcgcccggccctggtgtaggtatttttgttgttcccattttcctgatgaaccaaccgaggcctagaaaaattaaggccccacgtttgtggcatgagttcactatggagtgccctgtgcatgtaggaaatcgaatccttctccatttcttgggggttttacttctttctggaatccttgcatttattcttacgatgtccggtcggttttctgagcattttttgcagctctggaggtgagtggggcgcgtgcgttggctctcgcagctctgcagctcacgcaagggcgtttctacccttcttcccacagaaggacttactcctcagtgatattccaagcagcaccgcctcgctctgctccaggaagacgggcgtggagaacgtgatggcaaaggagatctgccagaagtacctggagaagggcgcagggaggcttccggaggactgcgccgaggccctggccacggctgcctgcctgtgcctgcggaggcgtaacaccagcctgcaggaggtgagcctcgcccgcagcggcctcgctgcctgggccacgcgtgggtccacctcatcggggacggccccttcgcagaggcctggtgcacaaaccagggttgtgcttgcttgcaagccgcagaacctcctagagctcccatcagccaaagggcggtgtagggatggatagtgcggagcccgaggacgggtattgcagggcctcagggcgcaggaccaaacccgtggatgttaactgaactcgatgaactctctgtgaatcggctttattcccccttctctataggccccttcccctttcctctgtgttctctggagggaacggctctgcccgcagtttataacagagagatgagcctccaccctgagtcccaccacagagggagaacctgattggctgaacttgggtcagttgtttaccgcttggccaatcaggcatggtggggcggtccagcatgcaaaccgggctgcccagggctccatccctggatggtgtcggcgccaggtcccaaagaaagggagtgtgctcagcccatgcactaggcggacgtcctagaaagcagccactacacggggtaagagatttttttggacatgagaagtagccgtggcttccatggtaaaaggtaatcaagagactactgcttgatcttttttttttttctttttgagacagagtctccttctgtcgcccaggctggagtgcagtggtgctatctccaaccttcgcctcccgggttcaagtaattctcttgcctcagcctcccgagtatcttgaattacaggcatcagccgctctgtccggccttgcttggtctttctaaggacaaactctccactgcctgggaggacccttagaaatcatctagcagagtgattttcaagtggtgttgggcacagaggggctccttgagaatactcaggaattgctgttggcagcaagaggggttgggggaggtgcaggcccccacctgtgactcggaccagacacccacttttgacttctctcagttactgtattgggttctctggaaagggtttggtagctggaaaaaatcttcaataaccactgctgtagcccaagcctcccattttacagaagggcaagtgaagggccacagacgagaagatgaggccacagaacttgtttttgtcagagctctctggactcccagttcagccttatgtccatcgtcttgcgctgtcacgtggcaggagctggaggcttcagtctttgttctcagcctttgctagcacaggtgtcccccaagtgtccatgtgccccgatgttcagtcattcattccgcagttgtacactggggccaggggacacatctgttcgggaacaaggcagacccaggtccacgctcctggaactcatggacattgcatagtaattgtctttgtggtgagcgccaggacagtgtatgatgaggaccccaccctgttgaccttcctgaggaaggggggtttaagcacacgaagagcaatccaggcagaaggaacaccctgcaaatggcctgagctgagagagagctcagcacgttcaagggcctggaagaaggtccgaagggctagaacacaacacatggggcacagtggcttgtgttgggtgtgtcgaggaaggagttgtccaatgatagaaggctttgtaggcacagtaaggatttttgcagagccactaaggtttttttttttttttttttttttttaacagaatctcactctttcacccaggctacagtgtagtggtgcaatctcggctcactgcaacctccactttccaggttcaagcaattctcctgcctcagcctcccgagtagctgagattgcaggtgtgtgccaccacacccagctaatttttgtatttttagtagagatggggtttcactatgttggccaagctggtctcgaactcctgacctcaggtgatccacctgccttggcctctcaaagtgctgggattatgggcctgagccactgtgcccagcctcactaaggtttttaagcagaggtaggacataatcagttttatattctaaaaagttctgtctccttcaaccaattattctttcagtaagactttcattcttttattcattccattattttgttcagtgtgtcacttaaggtgcaggtgaaactgctataacaaggagactgcaaaatgcagtggtttaaataagatagatgtttattctctttagtgtaacagtttgaatttacgcagtccagtgttaatgtggcagtgccacagtattggggacccaggctccttctatgttgtttgtttgctatccttaccatgtggcttccatgtcagggtctaagatggctgctgttgctcaggccatcacacctgcaatccagccagtgaaagagggttaaaaggaaaaggtggacacactccctttcttttaaagatataacctggaaatgcatcactttttctcacataatagagagcagaacttagctacatggccacgcctagctccaaggaaatgcggtctttagattggcaaatatttattgggcatctactgtgaagatttatctcaagaagtaacatgtgacctgggccttgaaggatgagacgtttgccacgtaaaataaaggggatagggcactttaggtgtaagaagaggtaggagatggccttagctcttagtacatcacaaccaagctgggaagatgaaagaacagctgggtcagggactggaagataataagcaggcctgggtttgatggtcacctttgccatttactgtactggctgggtggctttaggcagggaacttaacttttctgatcttttaattttttatttataaaaattcatgcattgtgtatgaaatggatacattagtggccgggtgcggtggctcacgcctgtaatctcagcactttgggaggccgaggcgggcggatcacgaggtcaggagatcgagaccatcttggctaacatggtgaaaccctgtctctactaaaaatacaaaaaattagccaggcgcggtggcgggcacctgttgtcccagctactcagaaggctgaggcaggagaatggcgtgaacccgggaggcagagcttgcagtgaaccgagatacgcccctgcagtccggcctgggcgaaagagcgagactctgtctcaaaaaaaaaaaaaaaaaaaagaaagaaagaaatggatacattagtatactgaattttttgcaaggcactgaggagatgagatttgttattgttattacgggtataagggtatgtatgtgtgctctgtgtgtgtgtgtgtgtgtgtgtgtgtgtgtgtgtgtgaagaagaaacattccttccttgcttccgtctaattttcctaacctccctaaccacaaaaaccttccagggcaacatctatattatttgtgcttttttgattgaaagtgttaggaacttaaactcttacacacacacacgtgcacgcacacacacacagacatagggagggggaagaatatgaatgagtgaattagcgaatgaatgaacttagtgtctcatttaaccaaacaacagagaggacaggcattgctctggtttcagggaagttagacccaggatctcaaacaccaaaggtacagccattgtgtctctctgtctgtggctctctcttcgttgcttgcctctgctttactctgtgttgagctttcattttcccctactgtaaatgggttttctgggtgtagtggggcgtctggttctaccactagagaggaaaggctggaggtctttccccaataagctctaggtggaaaagtttcagggaaggattctgattggccagcttcgatcacatgcccaaatctagactaatccctatggtcagaggagtggggtactatgatctgcccatgttgggtcacgccgtctcatctatgacagggcggttggtgggcaagcacaggtcttttcaaaggaagggtgtggttttttcagacaaaacaaccagcattaggttcttcagtctgctccccgccccctctctgctgggaggccagatgttagcatttctatttcagagagaattcctgatgagctcccttctctctcttctcccaaaggtgtgtggctctgtggctgctgtggaagagcggctccgaggtcgggagacgttgctcccttggagtgggctttctgagggtacaggctcttcttccaacaccccagaggaaacagacgacgttgacaattccagccttgatgcctcctcctccatgagtgtggcaccctgggcaggggctgccaccccacttctccccacagagaatggggaaggaaggctgcgggtcatcgtgggaagggaggctgactcctcctctgaggcctgtgttggcctggagcctccccaggatggtaagccggaagtcagagtgcatttggatgctcatgtgtgtgtccccaacttcagcccatcattttttctttctgttgccttcattcactccttcatttggttattcagccattcaccaaccagccagtttttcacagagaaacctgggaggcatccttgacacctccctctccctgccctggactgtgtccggttaatcacccagtcctgtccattggcctccaaaatctctctcacctccatctacttctctgcgttccccctttgtctgagctcctgtcctcaggggactgcatagcttccctgagtcctcctccatcctggcccctccctcactaggtccttctccaggagccagccagagtagcttttaaaaacacagtgccggccaggcgaggtggctcacacctgtaatcccagcactttgggaggccgaggcgggtggatcacctgaggtcaccctggccagatcacctgagatcgagaccagcctggccaacatggcgaaaccctgtctctactaaaaatacaaaaaaattagctgggcatggtggcgcgtgcctgtaatcccagctacttgggaggctgaggcaagagaattgcttgaacccgggaggcagaggttgcagtgagccaagattgtgccactgcactgcagcctgggcgacagaacaagagtccgtctcaaaaaaacaaaaaacaaaaaactcaatgcatgtcatccctcgttcaaagtcctcaaggccccatgtggtctgttcctgtctgcctctcctctcaacacaaacaccatcctcaccagtcacttctaaagatatcttccaggctgggtgcggtggctcatgcctgtaatcccagcacttccagaggctggggtgggcagatcacctgaggtcaggagttcaagaccagcttggccaagatggtgaaaccctgtctctactaaaaatacaaaaattagctaggcatggtggcgtgtgcctgtagtcccagctacttgggaggctgaggcatgagaatcacttgaacccaagaggcggaggttgcagtgagccgaggtcgtgccatttcactccagccctgagtgacagagtgagactccgtctcaaaaaaaaaaaaaagaagatactttctggctgggcgcagtggctcacgcctgtaatcccagcactttgggaggctgaggcgggcagatcacgagttcaggagtccgagaccagtctggccaatatggtgaaaccccatctctctactaaaaatacaaaaattagctgggtgtggtggcaggcacctgtagtcccagctacttgggaggctaaggcaggagaattgcttgaacccgggaggtggaggctgcagtgagccgagattgcaccactgcactccagcctgggtgacagaggaaaactgtctcagggaaaaaaaaaaggtaccttccattcctgccactcaggtccaaggataccaagtttctttctgaaataaaaaattaggaagccccccccccccccccccgcctttttttttttttgttttgagacagtgtttcactcttgttgcccaggctggagtataatggtgtgatcttggcttatggcagcctccgcctcccgggttcaagtgattctcctgtctcagcctcccgagtagctgggattacaggcatgtgccaccatgcctggctaattttgtatttttagtagagacagggtttctccatgttggtcaggctggtcttgaactcccaacctcaggtgatccgcccacctcggcctcccaaagtgctaggattataggtatgagccaccgcacccgaccaggaaggccctttcaatgcagtgtccctgtcccttagtaaacatggttcaatgaatgtcccaggctctgaccactcctgtttctcttttactcctcctgccatggggaggggagaggaagaagaaagacaggatgtgagcatttttttcactccaccctcccacccctcaacatcataaataggaacagggaaaccctctcctttctggaaggccagggtaggttgcagggcttcctgcaaagacagaggagatgaaaatgctcattacagctgggtgcagtggctcatacctgtaatcctagtacttcgggaggacgaggtgggctgattgcttgagcccaggagtataaagatcagcctgggcaacatggtgaaaacctgtctctacgaaagatgcaaaaattagccaggtgtggccagccaggcatggtgactcacgcctgtaatcctaacactttgggaggctgaggcgggcggatcacgaggtcaggagatcgagaccatcctggctaagatggtgaaaccccgtctctactaaaaatacaaaaaattagttgggcgtggtggtgggcgcctataatcccagctactcaggaggctaagtcaggagaattgcttgaacccaggaggcagaggttgcagtgagccgagattgagccactgcactccagcctgggcaacagagtgagactccatctcaacaaatgataaataaataaataaataaataaatgggctgggtgctgtggctcacaggccgggcgtggtggctcacgcctgtctgtaatcctaggacttcgggaggccgaggcgggtgggttgcctgagctcaggagttcaagcctagtctgggcaacacggtgaaaccccttctctactaaaacacaaaaaaattaactgtgtgtgtcgtccagcctgagcaacagagtgagactccatctcaaaaaaaaaaaaaaaaaaaaaaaaagccaggtgtggttgtgcacgcctgtagtccctgctactccggagactgaggtgggaggatcacctgaacctgtgaggtcaaggttgccttgagctgaaattgtgccactgcactccagcctgggcaacaaagtgagaccctgtctcgataaaaaaaaaagaaaaaaaaaaaaagaaatgctcattacactcagggcctgattcagaaacctgatttaagtgactttaagaattataataatagtaactttcattcaagtcgctcttgtttgctttctgttgaacatcagttacagaaacttcgtggcaaattgagatcaatgaggccaaaaggaaactgatggagaatattctgctctacaaagaggaaaaagtggacagcattgagctctttggcccctgatgaccggaacacagctgaggacccttgtcctcagttggaaagatgagcatcagatcaagaaaaaggtctgaggcagaatccaagatctgccaggaaacacacaacaaaacatctgctgtcctgggtgggagggaaacttcatttcactggaatgagttgggagagaaaggccctcagcttttagagacacaaaaatccatgaagtctcttcctttctgggctttgttagtcagagcaggggatcagaggagactgaagcagaaaccctgcacacgggcccaggatgtggctgattttgtggttccggggagtatgtgatgataatcacccccagcagattccattacctcagcagctcttgttcccccgccactggcagttctgcaatgccatagcattttccagagctaagatctctgggttgtatttgctgacagcctgcaagcttgcatgctctgaaagattttttttagtttttaatttttttgtagagatggggtctcgctttgttggcgcaatcctcccacctcagactcccaaagtgctggaattacagttgggagccactgtgcctggcctggaagactttcaacttgtgtctcagtgcagttcttgactcacctctctgggcctcaggttctacaaatgccagacacctagcgaagagctctgcaggctttccactgcctgtattggaaatcttgcaattcacataattattcagtcactgcctggtacctttatcttcccatcccactaatgttagtgttttttaatggagcttttattctgagaatatgtgtttgtctgtttgtttgttttttgagacagagtctcactttgtcacccaggctggagtgcagtggcacgatctcagctcactgcaagctctgcctctcaggttcaagtgattctcctgcctcagcctcctgagtagatgggactgtaggcacctgccactatgcctggctaatttttgtgtttttagtagagacagggtttcaccatattggccaggctggtctcgaactactgacctcgtgatctgcccgccttggcctatcaaagtgttgggattacaggcttgagccaccgcacccggccgagaatatgtgttgttatttatgactggattatgaagaatcaggagaatgcatttcatgtctgattctgctgctaattaagtcaatcatttaatttttgggacctcagtttctttgtaagtaaaataacacctgcttgttcttcatccctgggctgttgggaggaacagatgagacagtggctatagaagcacttggaaaatgcacttgtcctgttttgtaaaataaaaaggtattaaatgtgtatttctgccatgtacctaatgattattcagtgcgtatatatctgaaaagtcatgttgcaaatctttctgtgaaacagatgctattttaaattcactgggagaaatatcctatttaaagtaatctatagtaatttctttttatataataaaaatatatttgtaaagtc

SEQ ID NO: 1693 - DNA, 60135 bp, Homo sapiens
gccgctgcaaagttacaaatttattggtctggaaataaatacaaatatctcattaagaaactcctctggaaagacttgtgcacaatagtttcccatccgtactcagcctctcttgccccgatccccgacttttctactcaaggccagggaaggcctccaaggtgatgggcggcaggtaacgagtcattgcctctcacgccacctggaaggctggactacttcctcctcccaactgcggggtcccagaaatcctcgggtcccagtggctgacttacaatattcaattcactctgaccaaacttcctatgagaaaatccacggtgagccaaaatgaaaagtacaaggcagtagtacaggaacctggcagccgcactggccgcccagaaacgtcagtggtgctgccccattcggcgaaaggttagggagcaggaaaagaggaagcaggagagggaaggaaagtcccatggaatatgtattccagaatccttacattttctcagccaccgctccccacgtgagttcccacccccaccccgacaagagcaaagagttctgaggatccaagaacgtgaccgggtcagacaggttcagctactgagttcacgttccagcccagctgtcgaagattgaaaactggatttaagccaatcacacaaaattcctggaaccaagctgggatccacagaaatcacaactgcactggatctcaacacaacaacaaggaatcccttacatcgagtaaccccaattccacccccaccccagtgctcctactccggcccctgcaaggacactcatcacagccagggcagctgtggaatgttgccctccattctaaggaatgcaaaacaaatctaaatgatcttctccctgaacaagaataatcactggctcatgtatcaggggtgggaggttggggctgtggaggagaggcagaaagcagaactaaagccttcaaaaaccatgatgcccaacgtttgctgaaatatttttgtctgtaaagccaggagattttgtcgcctgcttttgctgcacattaagaggatgctagaaaaatcaagcttgtttgcttctgcattcaaagctttctagatgcaccaactttaaaaatcggtttcttcaagttaactacgtagatttgttgttccaaatgcctctagcctcgacatgaatcccaccttttcccccttcctgttttgcctgtttaaaagaggtgcctgcatgtcactattacccccctccccaaatgagaaaaggattttgtttccggaaactggatcagcttctcctcagttaaagaggaaacgggaagtgggcggctggccttctgaccaggcacccgtttgaaccaggatgctcagggcggcctaggcttggctttgtgaagtgtgtgctgctacgcgtcttgtttttggcagtttggtgtctctgagggaggggaggagagtggcaaccggccactggttaatggaagaggatgcgatgcggagatgcttgcttccttcctttggtccaccgccaccccgcctttggagagggcacccacgtaatagacctcatttgtctccaccagagctcactcttacaaaataagctttggattaataccgagttaggcgcagtatggcaggcagggggcgaaaaggggccggggaggagggggccactacagagatcagagtccgggggcggcagctgggcaggccgcctagcaggagacctccatggacttgggcccggcgctgttcccagcagcacccgagttgggggtgatgtccaggtgggccccctcgctggtgtgcgagcggctgcgggtgccctcgctggtgtgggagcggcttcgggtgccctcgctggtgtgggagcggctgcgggtgccatccagagaagtgacgctggaaccagaggctgtgcgggaccgcatcaggcgggtcatgctagccgagggcactaggggaacaagagacagccggttagagggcaggagactgccaggtgaggagccaggcatgcccgtccaccagccacatgctcttttacgtgccagccccagagaagacttgatccctgcagccatccagctgctgggcccccgtcctctccatgtccactcggagagagagatggcaaggcccagatgcgggaaggaactgccgcaatcacaccatgagtgacttgaacccagatctgggtctgaaccccaattctgccacctgttaaaagctgtgtaattttgagagtgtccccctgagcctccctgttcccatctgtaaagcaagtatgttaaatactgacccctggtatcagcacctgtgtgtacgcccatgaccccatgctgtccatgatcactggagcagggaggacacctggggtcagtggccctgcacatcacaggtggggaaagggagaggggccacacggcaagttcccggcatggctattcgttgtcatctctcccaaagaagcctgtcagcccaggtgctaacaagggcgctgtctattctttgggatcttctctgagacctcaaatgctcttgcacatggcacgtgcaagtggcacatgctgatggggtagcacgtgctgatggggtggaatgaggaggaacaatcctgcccacctgtaccgggtgggacagtgtcccggaagattcacacctacctgaaacttcagaagggaaccttatttggaaatagggtctttgcatatgtaattagttaaggatcttgagatgaaatcatcctgggttgagagggaaccctaaacccaatgactgtgatgtccttatagaaacagcacacagggatatgcaggggagaagtccacgcaaagacagaggctgagattggagtgatgcagccacaagccacataaagccaaggattgctggggccaccagaagccaggaagaggcatggaaggttcttccacagcagcgttggagggagcaaggccctgcccacaccttgattttggactttaggcctcctgaactttgagagaatggatttctattgttttcagccacccagtttgtggagatttgttacggcagctttaggaaactagtactccacccaactgaagcatcatggctaggaggccacactgagtcagacatcagaaacaggggcagttgatccacaccaagcatgcagggcttatgttatctccttgataggcacagggaggggcttttgatgtcaggcactcccaaacagaattaatccttgctgaattgtcttaaagagctagttttgaattcagaaagaattggggtcaatgccacatccgcagctcacatatttctctgagcccctacttctcacccacaaatctgggatgtctactgagcaggatgagaagcgtacagtgagcactgatgccaggtgtgcaaagggttcatcaagccagcaccccgtggtgtgcagaaggccagtgaccggttcctttccttctctttggctgatgcctttgagaccatagctcttcctgttattttccccccaagacctgcaggaggcttcagctttctggtaatagaagccgatttggggagaaagatgaggtctagcattcacttcctttctctccagaacacactctcaaagcagaaatccaaaccctggcgggaccaagacaaatgggagccacaattcacaccgtgcagggtaaagcaggactgccccgcggctgtctccatggctgtctccaatgacaacctttgcctgcaacttccgtcggggaaagcaggctagaaaggcaggagccccactagcagatagcttctgttggaagagggcacctggggatgtggatcctgcctgagcctgaggcatggaaatcaaacctgccagcctcgccttgctagagctaatcatggctaaggccaatgctaggactgcagtcagcttaccaagcatactcttactatacatgggcaaacagtttaaggaaatgataaaagggatcagaagttcaataacttcctagtaagggaggacacacgaattatagttccaagcagtagggtcagaagagccactagtcatgtcagggccggaccatggctgacaggcccacagcactgagtgtggctgctgttcagccgagttacaactcgccagggtctgtcctagtcctgggacagcacttctggaaaaaaggctgtatgtgtctaacaaactataactgcaaaataagaacgagtgagttcctgaatgatgcttccaatgtatcctccacttcccaaagctcatgacttgactatggcatgctccaccttgaatgtaagcaactttgttagccacttccacagagcttcacagtcttcaaagaatttccacagatccgccctctgctccctgcttacaaccccgaagcatcagcttcatcactgataagatgggctaagaatatgtcaaaggagtactgtgatggttcagtgagataaaataatgtgttagtaatctttcatcatcatcgacaccatcttcatcatcactgtagctagtggtctcttaaaacttgtgatcaaaatttttaaaaatgttattgtttcactgttggtcattgtcttggtgcttaaagggacagtcctcatctaaaccccccaaaatccctggtgtgaaacaacttctattcaacaaaggaggaaaaatgagcctcactgataaatgagaggctagatcctccaggctgccacatgccctccacacacctaactgtttcctcccagaaagctgaagctggccagggggacacagaattgctcatccaaacctggctcaggacagagcacttccaattccgacacatgccccgacccactgcacacggggaatgccatactcactgtatcccatgccctgcacgaagtacttgaaggcctcagcgagcttggccggctgcgagagacaaggagagaaaatgcagtcagttgctggggagccagatcacccgaggccatggggggctgtgcctgtggtcaccttcatttgagagtttggctcaagacaaaagccatcacgtgttgacaggacaaaacacaaaagtaagagtatgggacaatgatgggaaattcaccccacagctgtggaacttggacaagttacatgacctgtctgagccagtttcctcacctgtaatacagggcagagtatcacagctatttctgtgtgtttctgaggagattaccatccacaaagggacatgtctaacccagcaagtggaacataactgcatcggcatcatgagccactcccaatgcaaggggctttgctgcgttcattcatttactcctgacaacccctcacgaggtcagtgctaccttagatacatttcatagctgaacagatttggacaggtaaatccactcagggtcccacaacaagtaagtggtgggtcctgtacattaacccagggctctccaaacctaaaacacttgttcttgaggcaaatcactgtcagcctcaatagcaggctggctgaaagaagggatgatggatagatggatgggtggaaagaaaaggatggatggaaagaaggaaggaaaaaagaaagaaaggaagagaaggaaggaaggaaggaaagatggattaaaaaaagaattgatggacaaaaggaagaaaaaaagagaaatatgaacaaaagaaggacaaataaaaggaagaaaggatatgaagaagaatgaatggatgatggttggatggttcgttggatgggtaaacaaaccaattaattaacaactaactgggctactttaagtgaaatgcgtatggaatgctgagaccacatccagttctaccagttctctcagttcatttaatgtaaacttggaggtgaatgctcaaatatcaagggcatacgtgcaaggcgtatctgttcttcagttaatcccaactgttctatccagtgccctgggtcctattctcctgaggcagtgagagggcactggtagaggctgggctgacccccctccctgctctccactaactcctgccaggattccacaaagagccaaatgacatttaaaagagcggctatgctcaaattgccctctggaatttgtgtgacagtggaagaaagagacaagagaagcaggtcagggctgcagggaacagggacgcctgtgttcgagatggtggagagaaccaagaatacacgcttgggaatgagaacacttgggcccaattttagctccagtaatcatgggcaatctctctcaacttttggcctcagtttcctcttctgtgacactgggataaaatgcttgctcttcccacctctgaggactattgcaaggacctaatttaatcaaggatgggaaaaccctgtgtaaacatacacccaacctgcaacggcatgaggacgacagtgtcacacaggaattgctcccccctgtgctggtgtcctcgaagcctgtgctcgttgcactcctctgaagctctgaaaattcttttaattatgaccagggttacatctgttctcattttaagtagagaaagaaaaaaaggaggaagaaaggaggcagggcaggttttggataaaaaagatgacaaaaaactctatttcattttaagatggaacacaaaactgtcaggatataaaattataagacaacaaattaaaagtttacttgttaggttggtgagattctttataggaggggaaattgaagggatcagttacgtagcaaacacattacgttgatcaatgtgtttatttgtacatgtgcacacacatttacacatgcacacagacatgtgtacacatgcacacacacagacgtgtacacatgcacacacagaaacatgcatgcacacacacacaatttggcttaatctcctccatgtccctctgctctgggctggagctccttgcggcccttcactccagcagaagcccgtggtctttggggcagacatacccagattctgacccatgatgaccaaggtgtgtctacttggcaaatcccccaacctctgtgaaccgcagtatcacctactccacaggggttggttcctagggaatcagagtcctcctatatagcaccttttcccaacagtccacaaactgtcatccgatgtcacagcaaggtaatgagggaacaggtgtcacagaggcacatgcactccacccagggggaagcgacagctgtataatgcaaaagccaacatggcactcacctgggagatctgcgggaggccgccacagtccgccatctaggagagagggaagctcgttagtgccaaacaccacagccaaggccctctgcgctctatgaattttttccgaaaggatgcccatccgcccgctgccctgccctgccttgtcctgccttacaaaggaggaacagggtggaccgtgggtagggaacaatccagccccaccaggcaaggctgctggtgtctccgtggcaaccatcacttgcagcttgctacgtgccaggcactatgctaggccctacagataatttcactccattccccaagaaccatggaaggtacagctgtcccattttacaggcagaaactgggccaggaagagcttgagggactcgcaaggttccaggccaggatctctctgacccgaaagggtttgataaacaagaccctcttcatatattcccttgaaagtttccctcaaaaggaagtggttgaatttgggtcttcaggccggattcagctgaccagtacccttcctaaatggtggacgttcaaagtccctgtgaaatcaccgaaccgcaagaggccattgcaggctgtgagactgtgcagccagcctggaaatgggcagcgctgacggcaagggagcagggggaggctgcggggagggtggcctggggtgaaacggggctggaggagttcatgggagtggtgaggctgtgggcatcctacagcccagggcgcctcaagtgtggacccccaacactagccacaaagcgacactgacctggggcagccctcagctcaaccagcacgcagggagcaggatgcccgaatttttcctccaggcggggcactcagcacattagactgacgctgtggaagtctccagaatcaggcctaagtgagttctgtttctggatctaccatcaaatcggccaccccacctcagtcaggccacctaccctttgctgtaggttgtggttgaattgtgtccccaaaatagacatactgaagtcctaaccccagtacctatcactgtggctatacttggaaatagggtctttgcaggtaaaatcaagttaagatgaggtcatattggattagagcgggccctaaagctaacggctgatgttattaaaagaagaaggaaatttggacatagacgcagagatacaatcgggagagtgctgagtgaggatggaggcagagactggagtgatgtgtctactagctaaggtgaaccaagtgtggccagcagccaccagaagctggaagaggcaggcagcattctcccctagcaccttcagagggagcacggccctgcccacaccttgatttcggacttttagcttccagaactaaaagggaataaatatctgttgctttaagccacccattttgtgatacttgtgacaaccgccctcaaagtacggcattatgcaagcttgacgcccagcagcttctaatcttgcaatttccttttgagggaatcttgaaagaaaatctatgtaaagagcccaatacaggaaaacagcctcccactcaataagtatcggacaccccctacatgcctttcaaaggcattctacttctatgggggaagttgagggcacggtgacctacagatgccacctctttgtccttcccccagtgcgagggagccgcctcatctccacccaggtcccgcctggtcatctgcccctgcaggggtgcaccccggctgagaggcccctctgaaaggttcccactcttgggctgcatctccggacgaggccgccacaaacagccagtggtttgcattgtgcaatcagtcataactggcaaaggactggcggaggttgctacagacactcaaatccagctgcgagtgagctggctcaccatgtgctcagatgaacttgctggacaaagtcctgaccttccccggctgtgggacacgtctcttcttattgtgacaagcagagagcccctcttggaggaatgtcctggccccagcctatggagggcccttgccaagccatccctggtccctctatccccaaagcccccagaccagcagcctattgattcctgcagtcccagagaaggatccctcatctttgcagcctcagatcaccagtcagcacccaatatatgttcataaacagatagattaaatcattaattctatagtttctgatcgtgtgccttgcctttttcaagcctaactcaatgttgcagaaaacgtctgagagtttctaagaaataacaaacacgaacccccactgttttccctgtaccttgaggagagtggtctttgttgggtccaattttgagttgcactccacctgcacaagagggaggaaatctgttaattttctacgtgaagccaaagccaaaacatctcccccttctccgccactctgccaccgtcaccagaaactccagtatttctgctggcaaagaagaaagtatgtggagttattgggattcagcagatgtggcttgaaatcccagccttgccattaccagctgtgacaacttggataagtgatttaacttctttgggcctcagtttcctcatcaataaaatggagctaatatcttttttcaaaaggttattatgaagattagccgaaatgtaaacagtactgtagaaatacctgctaaataaatatccttgtttaaccagcagctgccagagattctacaggtttaatattcccagatctaacaactattcttcatgtaaaatcacactggtttctctcttcattttgtcagtgaacctcttgaaaggggcatctggaattgggcagaatacccatatgtaacccaggatgttcaaaatgcttaaagtaaaactatcacctcccttgatttgaacagtgtatctctattgatgtatcccatgattatctccagtcagtcagcccgtaagaaactcatggttcactaaggcatgccaggtatttactacatgaacatttgcaaatgtcactctgcagatcactgcacaaagcatggcagtactgcaggactctgatccatagcccctaagtcttccatctccccagctgtggggttgtttgaaaggcagattcctctctttgctgccacaaagttgcaggtgggagttaaggggtgaaaggagtcaggaagctttgctaagccctgcctcccagtgcctctctcccctgccagctcatcaggcaccagtcagtttggaaagatccagctgcttcccaaataagaggtgagtctcttggccaggaagccaagtggcaaacatgcccatataaacaagccgatgggacacagactggcgggtgaggggacctgggagaggagacactgccaagcaaccagggctggcagccaccagggaaagagactgagtggctgggccctctgcccaaaggccaatatggcatttcaaaaaacatcacctgccctgatggggcagaggagaggaggggcaggcagggccacttcaacaaagtcaaccagactttgcctgttgaattaaacacagaaatcagctgtgatttctacataccacggcatccactgcaggcgagctgtccccaaccaccaacagagcagggcacctggggtcagggatagagcagagaattagcacaaggttcctttaaagattgtcccactcccaggcctgccaggctggggcctgcattctacaaacaatgtcattttggtttccccaacaccctttgctcttttacttcattctcctttgatcttaggataacattggttactagtcattcacaacttagtatgaatttcagccagggaatttctgtgactcagtgcttttgttttaaagcatcttctcctcaaggatggttaagcaggacttagctggcaatcaagaccgaaacaagaacagcatgaaggacaaaggcaatgacgtgccaggttcccaagtgtcacacaacgcggtgcactcagccacaaaaagacaccatcattactggtggaaacccagttagttctgtccatgactgtcttttcctcctaggtgtatggagcactttaaggctgggtcctgtgctatccatccctaggcttcatggagcaaagcctcacacagttattgatgtagtaggtgcttaataaatgctgtcccaagtacaatcaaccatccttctccaagatcaaaggcctaggtcatggggacaccctagaaacggatgccaccggcacagggagaagtccaagtcaggctgggtaatgctcagtctctgggtggaatatatccaggtctcactgacacaatgtcctgccacactcagaaagaaggccctgccagcaaggccacctttatagtgggcagccccgactgcaagtgctgggggagagaaaagccactcactgcagggtgactgtgtgggttcccggcattggtcgctcaatctccaggtcgcgccggctgcaggaaacaaatgcatcattagcatgaggacccctcccctggagaaatctcccactcccatccagccaagcccaggaggtcctgccagtggccattctggtaagctacccacatccccaacttgagagaggccctgtggctttcaggactccacaccctcttggtgtccacagacctggttagagggacagcacaacacatgcatttcaagcagagccccctcattttgtcacaaatatttgtggggcttttttttccaggagtagaagtcagattctccaccatagagggtccccgccttccctgtccccctagtcagagcccccacctgacagaggggccacctcccaaatgctctcgcagcctcttagtttaagtcccagcctcaccaactctgagtcctctataaagcacccaaatgatctctttaaaactcaggcctcatctttccattccctgtctcaaaccctgtggtggtttcccactgcactcgtgtgaggcccagtgtgggtccagcccagtgccgaccacctttcctgcacgcagccacccaccctctctgctatcttgcagctcccaacatgagaagctctttcccagctcacagcctggagttagacaagcaggatccaaatcatgctctgccactttctagctgtgtggccttggggagaacacaggatctctttgcgcctttgcttcctcaacaggaaatgacagtaattccaggaccttcacagtgggatttggagaggggtcagttaattacggtgctatctacacgggcaagttaacagtgtggagtctgcgggctgtgctggtttcctctgtgtctccagcgcccagccgaatgcctgactcgctccagttctcagaaagtgtttactaagtgaaccgcactgccaggtttcggtttcttcagtcacatccacagtgaggatgttaccactgagatgagggcaggattgtaaaaggaggcagatactaagctctgttacaaatgttaatttcaagaagtcactttattaacatttgagcagagataaacactatgaggctcatttctatctcctgttctgcgagcgtggcagagcgagctcagcaggttgagcgagctccctggaagattacagagtctctggctgacaccaatggccctgagctgtctcctcccctagctgagctccagataagcacctagtgctggttgagagggccacgccttaggcaaaggccatgttcaggtcctccttatccttggaatgacaaactcccagaagcctgcctggattatccccggcctccaggagtgctttgctgctctctcacttagctcttcttacatttggcctttcgtgaaggtcagcagcgggcacacatatttactctcaaccctctgagtgtgcgactgcgtccctctcacgtctgcacccccagtggtctggagtgtttgttcagatccctgcaaggcgagctgaatgccaggaaccagcttacaggccaggtgtccttcctggggacacctgtcctattaatctatttgctcaaactcagagcctgcctcttccgctcattttatactctccctctcatctgtcccacatttcggatctacagaagacacctcataaatagcaatgatgtggctgaactacatcccaatacctgttgtaggcattgatgaacaggtgcaggttgccggggttcatgtcattcacaatgtgctggcggtaggtgtggaccacttccacgttactctgcatttcttcctgcatttagagaggtgagaagatggtcctcatcgcactgtggccctgagctggtcactactctctccattctccaggttatttggagacaaagtaaagataataatgcctaatccacaagacagcgacggacctaaaaaaaaaacctttgggaaagcaacacgcccaaccaggtgcagacaggggtttcactatccgctgggagcagaaaagacccccatcctggaaaggccacaccccacccttccaaactcattactttgggagtttcaatttgaagtcagacatcctggatctagagcttagcttcatcactgtccctttcgtaggcaaatctttcaacctctctgagcctcagatctcttaaaaaaaaaaaaaaaaaaaagggaagagagagaatgttgcctacttcactaggttgtaggacttaatggaggttgtgttctcacctctactaacagtaaaaattggaggcaaatgttagtaattgttttccaatgggaagagctgaaaagaagtttttcatgcttgaaaagcaaaatcaactcatgccacaggaagttactgaaaagaagggcaattgcaactcccaccacggccaaccagagccttggggaagtcggcctcagcctccccgtctctgggtgctttttgaatgttatttgcgacaaacaacttgtttgctctgtttctcatttgtacgagggcagacactgtaggtttcacacaagggtctgatatgaccagtggcaaccagatgagaagttggagttgggggtcaaagaaagccggtgtcaagcttgagctgcatcaaacagtccaggatcatttaggcagcaaggaggtcaactggctactaagagcaaactctggaaaaaatagtcaggaatcacgctgggatttcagatcaaaaccaactatagcgatctgggggtaccctcagacaccatggccggaccaaccagtctccaaataacttggggtataatcagatcagatgctcaacgctatgtctgacatccctcctccagtgaaacagagacagtggctgtgaatttttcccaattcctatcagtttcagattacacactcaggacagggaaaatgtgtcacacgctgtggaatgaatcgtaaaaggggaaagaggactctagtgggctaaactgtggccctcaaaagatatgtccatgtcaaatctcttgaacttgggaatgcaaacttgctgggaaaaagggtttttgcaggtgtaattaattaaggatcttgagatgagataatcctggattacatgagccgggatgaaatccaatggaaagtatccttaaaagaggaaggagagggagaaataaaacagacacagaggagaagaccatgtgaagacagaggcagagagtggtgtgagcagccactagccaaggaatgccgacagcgacctggagcagtaagaagcaaggacgaatttcccctggagcctgtggcggaggggcggccctgccagcgcttgacatcggagttctagactcagagctgtgagagaatacacttttgttttcctttttctctgtttttgagacagagtctccctctgtctcacccaggctgcagtgcatggcgcgatctcggctcactgcagcctctgcctcccaggttcaagtgattctcctgtctcagcctcccgagtagctgggattacaggcgcgtgccaccacatccggttaattttgtattttcagtagagacggggtttcaccatgttggccaggctcgtctcgaactcctgacctcaggtgatccactcgcctaagcctcccaaagtgctgggattataggtgtgagccaccctgctcatcccactttcgctgttctaagccatcctgtttgtggtaatttgttacagaagccacaggaaaccaacacaacaggcaaacctagcagttgtactcgccaactccagagtggagcctctgttcccctggtacactcgccaactccagagtggggtctctgttcccctggtacactcgccaactccggagtggggcctctgtttccctcgtacactcgccaactccggagtggggcctctgtttccctcgtacactcgccaactccagagtggggcctctgttcccctggtacacttgccaactccagagtggggcctctattcccctcgtacactcgccagctccagagtggggcctctgtttccctcgtacactcaccagctccagagtggaggctctattcccctcgtacactcgccaactccagagtggggactctattcccctcgtacactcgccaactccagagtggggcctctattgccctcgtacactcgtcaactccagagtggggcctctattcccctggtacactcgtcaactccagagtggggcgtctgttcccctggtgtactcgccagctccagagtggaggctgtgtccccaggactcatgggagtgtcagatggtcacacatgttagctcagaagcagacagtggtatgtaagcaaagcaggtcactgcaatttcaggcaaccaaggggttttccagaccctgggcttgcaaccaagcccatggcatacccttcccgagggtagctggccccagctagagacacaaaaccagtgtctggggccaggcaggctgggctgataagatgactgctcacttctagcatgctgtgaggggcttggctcaatcccctttagtggggtaactctgcagaagagcagctcatctcagagccaggcagcagcacaggcagccgccatcctgctgtggtgaccagaatgaagccagattcataggttctaataccggccccacctctccctggttgagaccctatgcaagtcactcaacctctctggtctgtttcctcttccataaactgggaatgagaacagaatttatcacacaggtcacagagcacctgggtggaatcctattcctatagttaacacttgtgaagctcttaggactgagcccagcccagcacacagctaactccacggacatgtttgctactgaccagatttataacagcccagaactgggaacaactcaaaggtcttatcaacaggtgaatggaaaaacaaactgttgcacatacataaaatggaatacttctcagcactaaaaaggaataaacttttttttaagagacagggtctctctgtcacctaggcggaatacagtgggctatcccagctcactgctcactgtagcctcaaactcctgggctcaagcaatcctcctgcctcagcctcccaagtagctaggactataggcatgcagaaccaccatgcctggccaatttttaatttttctgtagagacaaggtgtcactatgttgcccaggctggtcttgaactcctgggctcaagcaatcctcctgccatggcctcccaaagtgctgggattataggaatgagcactgcaccccgactaggaataaactattgatccactcattaacatggacaaatctcaaaatggttatgctgagggaaagaagccagaccaaaaaaaaaaaaaaaagagtacctactatataatgccatttatataaaattctaggaattgcaaagcaatctatagaggccaatgctgatcagaagttgcctgaggaggagggagaggaggactatcaaggggcacaaggaaactcttggagtgatggagacgttattctcctgattacagggatggttttacaaatgtatatgcatgtcaattgtacactttaaatatgtgcagttaattgtacttcaatcagctgtttttaaaagacacataaaaaagagagagaatgaatgacttgttgcttatgaatgaataatgtcacattatctcatgagcaccagctcggtggcccccagttgattgtgtcttgttctctccacccccacatggggccctgtgctgagcaccacacaatgccttgctcagcaggaacaacagatttgccagaccacgcaactcaccttcccaaaaaggtgggacaccaccatgtccggcagagcttgggtccatcctgagatctggaaaggagtaaagtgggtggatgagaaaccaggagctaacagtagttaacaaggtcagcaaaaccccacttccctgggtgcagggtggcattgctggactcccccctacatgcaggcctcaaggacatcccccttgatagaaactcagttcctgtctccagttccctcctggacctgatcccccaaatgcagggcctgggactatatccagttccttattttcagaggcccatgcacaagatgcacagcaaataagtgctgaataaagacccagctactgctagcttaccctgctccaaacattcaccaagtcctcagcaaagagggccatccattcacctcttctaaaaacacactgagctccccagtctataccccaagatatgcttggctcccaactatccctcctctctcatctccaagccagtttcccctttctaagtatactgatattaccaaagacactgacaatcttcttttcctacctctccccagtgactaggtttgcagcaggagctctataagtcctagtatacagcagaagctccataaatgtgtgctgacctaagcattaggcaaaaatgagtaggagagaagctctagacctaagggtctttggctggcccttgcctgccacagcctagctgtgtggcactgggcagtctgcatacctctgggtctcagacttctaatctggaactgggagtgccaggaacttcaaggccacaaggtcaagggaaggactgcaagaagtaactgcacacatcacagtatctaataccaatgcctggtaatcgaaaggctggagttgaaaaagaagggaatagtacagctattaaagctgtactgaagggaatagtacagctattaaagacaatcctcaggcttcacattagccagtggtcgacatccccagaccttcgagtctcactcaggacagctatcatgaagcccagcgggttgactggaatgtcacttcctttgctggaaaatcaaataaaaaacagggagtgtgttccactccagaacgtcatacaggctggacggaagggctcctgcattctggaggaatgttcaaagaacaaatgcaaaatcacagtggctggtacagggcaggggatggggcaagaggcagggccccttcaaaccatcggtccctggcagccacccaaaattgggcaaaaatgcacttgcagaatgagaagctgcgatcacctcagcttgaaagactctgtcctatttcaactggaatgacctccccctctccttggccaacactgaggcctttacagggaaaaaaacaaaaacaaaaacaccacaatgataatttttaaaagataaacaaggaaccttaggacaccagccaggacagagcttcccaagacagcacaggtcccttctcctccaggcagcctaccctgcttgccaggcctgcctgtctcccaccctggacaggagccccaggggcacgggtggtcaggtccacgaaccacaaagtcaaagcaagctgcatccagtccccgttctactgcctagctttatgtgaccctggacaatccccttagccacaccgagtccttacctctgaaacggtgataaaaattctcacctcctagagttactatgaagattaactgagatcatgcacacacagcaacgtagaatgaaactagcacatggtaaactctcaatctacgttagctaattattatcgtaaaattctgtggcacagtccgtactaaatacatatttatttttctttaataatatgtgaatggattcctaagattcattcctagaggcttttgtcttgttcatctcaagaagtcttgttcttcaagatgctcagcatcttgaccaaagcctggcacaagttatgtacccagctaatactcattaatccaagcaatgcttctccaagctgcctcagggacctgtgtcccagtgctttccctggcttagacagcttggtggtatttaagtcttctgaatggcaaacggctgaggtcatgtgtactgttctaagtaaagcagagggaactggagtgggcagtagagggtagtggaggagtgggtaaagagagagctcgtagctccagggatcccccaggcagaggctgtgtgcacctgtccctcttcttgcagggatcccgccggcctgacaggcccccacctcaccttggaggcggcccagtccatccagccttccgcacaagggttcacgttgataaggacaaggccctccaccatctcagggttgtttagctgcaattcaagacacaaagtgagacagacatcccagcaatctgaaacactaggaactttccaaggcaaaccaaagcttgagagaagtacccagaaaaaggcagtgtgggcagcagagcaggctgctgctccccggccccaccccatgcaaaactgaggttccagcacagcagacacggtatcgggtcctagagagagtgggaaggagaaagaggaagtgcaggagaagtaggaagcccgctgctttgcaggcctgccttgggcaagtcacttcaacccacggaggctcagcttctccagctatcaaatgggtgtaacacaccatcgacctcatcaatcaaacaaggcgcacagcacaaatgctctctagttgtggcagtaacaactgtattacttacttccaggataaacacatgcatacacacacacacacacacacacacacacacacacagagagagagacagagttatgcatcgctgaataacagggatactttctgagaaaattcatcattaggagattttgtcattgtgtgaagatctcagagtatacttacacacacctagacagtatagtctacaactcaccaaggctgtatagaacagccctttgctcctaggtttgctgtacaaacctgtacagcatatgacgctacccaatactgcagggaattgcaacacaatgctaagtattgatgtatctaagcaaatctaaacataaaaatggtacagtaaaaatgaaccattataatcttatggaaccactgtcaaatgtgcagtctgtcattgaccaaaatgtcattatgtgatgcagatacatacagatatagatatgtacacctggggtacagttgagaccatttttaatttgctgagagcctatatggccagaccattttgtattcatgtcagcattcctttcttttttttgtaagatggatgttgtagaatcatgtcagtattcccaacctccagcaaagcccagcaaataataggtagtcaaaataccaatggatgtacaaaatgagtattgttgcattcttacacaattgctcggtgaggatacaaaggaacagtggctcttgacctgagcccagagaaataacaatgacaactgtcatgaaaacttcccgtgtctgattctagtttagaatcagttatgacccaggagtgccctgactacaaaaacctgtacagctgttacaaagcagtgtcatagcagagtactcagtgagtgaggagcgtcctcactagatggctaagcggacaaagcccatgacaaaggaatgtgtccagtatcatccttgagtggaggaagagaaaaggctgtgagtatatatatatacgagtacccatgcaccacacacacacacacacacaactgtggagaatacgggtcatttctttttcccttttgggtttttgatgcttttccaatgtcttccttcatcttaaaatgttatttaaaatgcgattttcaaaaaatgccaaagcactcacagcaaatcgagttaggatgtaggcgcctgctcctgttcccatgccaataatgcttttcagcctggaagcaaaaatacaaatgcatgtcacacaaggacagagtgacgggagcctccaaggacccacttagaacttcctgagggtgaccgcctggctaggcaatgcgggagcatgctgccgtaactgcctgcacagctctgaggtcaccatgctttaggactggacagagacctcgaccttggagagccgcgccccttctcctcacttccctcctggccgccacccaggctctgagagaccgtctgacatttacgggaaggcccgttacggcatcatttcttcccactcttaagctttattttggattctaaaacttggaatgaaaacaaattgagcaagaaccatgaagttatcattctttgaagagctcaagacagagaggaacactggaaaaatgagggtgtggagagaaaagctaaggactcaggcaactccattccagaacattccatgggaaagagaagggaatggaagaacaggaggcaagagcaaatgggtggggcagctgccatcatgcaatataacattcacgcaagaggaaaactgaagttagaggagacagactagagctcagagactgtgtgaagaacagtgttcacagagtgacgagctaatttcttgcctcatctctaaattgcaaccttaattttagtggtcagtccagatcaaagccaaggggcaggaagatgctagaaaccaggcttctctgcagacagagaaggagctgatccttcgctcttacccaaactgttgaaggactccaggaagcatttcagccagctgatccatggaggggtacatgtacctggggatgacacagagaagccattagtgagcgcccggacagaaacgggtaatccaaacagggacacgcttgaagggtggggaccatgcagcagcctgccccatgcacccagacccccccacccccaagtctagtcccttcgcatcctccttccaagacccctgcagcacactctatcaattgcttcctacgctccaggtcccatggacacattctgggaattagctcattcaattttcacaataactctaggaggctgctaggatttcccctcatagcaagattataaacatcactgaggctgagagatgagacacttggcctcacaagagcagtagatggttagccagaaacatgtcctcactgtgtttgtctggttttgggtctagggtgttgcagaaactgactagaaggcatttcacaattccaatgtcagggagaaggaattaaaacaggcatgaatgagttccatccgcaaagcagtgattgatcctcacacatgccgggctcttggtgaggcaatggcaggggtctgtgagcaaagcagatgcaaaccaggacaggagccagccctcgagtcaacagaaacagggggtgttactcataacaaagcctatcgaaacagagacctgccgtgctcagatgatcagggagggcttcttggaagaagtgacgctgaaggggtcatgggaacctgatgagtaaagcgtgtgggcagggaagcagtgtatgcggacgccctgggaagagccagaaagagcccgtatggtgtggctccacatcaacagagccactgagctgagaagccgcagggcagaagtgcggcaaagacatgaagctcctctgaaatggccatggctcaatttggagccagcagctcctaaggtgtgacactggagaagccacttaattgcagggccctctgtttcttccctgttccccagggctggtgtgaggcgaggaagcagcagaattctacttccaaggtccctcctgtgtaggtggtggacaccggggccaggaggagcccagccagggatcccctaccctgctctgctgtctcggcttcagaatacagggggctcacccttaaagggcctgggagatgctccctcacccctcccaagccccacactctcctctgccctactccaggaggaagaaacaagtcaggtcccactctgacagtgggtcccaccagatgcacacgaaaaccacatagtaaactagggggaaaatgcgctgtaatacccagaccaacggaataaaaattcctgggggtggggctcaggcctcagaatatttgtaaaacttcaccagggggaactaagagtctctgctttcccccaagtctttcacacaactggtccaaccaaagatttacggacacacctctggctttatctgctggttaacaattaaccacgtcccactgttttaatacacttttaatttttggtcctggccccatacggttggctgtcccttcccttcctctctgataaaggttaattattaaggataattctgaacactaataaaaaaggatatctatttataaatgccaagaaggccccttctggaagactttaagcccaagaacctgctcctgccctagtttaaacacaggtcaggtgcagggacaagaggggttatctctgaggtctgccacccccacatgatgctgattgggggatccaacaagcttgaccataattgcacaaggggaaattgaaaggccatgcccatacagatcacgagctgacaagggccaggcagtgcaaatactctcaactaaggcagcctgatgttccaaagaggatacacgtctcagtagataggatcaaagccaactccccagtcatcagctgtgcaacctttttttcttttttggagacagagtcttgctctgtcacccaggctggagtgcagtggtgcgatcttggctcactgtaacctctgcctcccaggttcaagggattatctggcctaagcctcccgagtagcagggattatagccacccgccaccacgcccagctcatttttgtatttttagtggagacagggtttcatcacgttggccggagacagggtttcaccatgttggccaggctggtctcaaactcccaacctcggtggtccgcccaccttggcctcccaaagtgctgagattacaggcatgaaccaccatgcccggcctcagctgtgcaaccttcagcaaggtagttaatgcctccatgcctcaatatgtttgtctggaaaatggagctaacaacagcagccacacagagctagctgtaaggattaagcccagtgttagacacaaatgatgaagcctagcccacaggaagggctccatcaatgttacttctctccctctctgtttctccccagacttctaggtttttcttcacactatttggtggtgtcaagtcctcctccactgaagtcctgtccaggctgagcacacctatcgtaacgccagccttgcaggaaggctgggggaatggggagatagtatctgataagtatgttgtttcagtttgggaagatgaaaaagtcctggagatggatggtggtgacggctgcacaacaatgtctgcatgtccttaatgccactgaactatatacttaaaaatagtgaaagtgctaacttttatgttatgtatcttttcccacaatttaaaaagtgcttaagatgatacgttttatattttaccacagttaaaaagtatttaaaagagcaaagcacctgaacccctccccgacacccagtttccaccctgtagagctcatagggcaagaggcctctcaccctgcggggaaggaggctgcgccgtcctgctggccaggggcgtccacgtggcagacggcaaagtgctgggtgatctcctgcatgtcctcgtagttgaagagggggttgtagcaggttttgtctgaagaacagcagtgagggagagaagagaaaaaagtaagatgagaaaaaaattaggtgtctcggtggcaaagcacattcattttgtttcattcctattcagaagtaggaagtgaacttagaagaacacagatgttggcgttttttgttttttggttttgtccccatgcccactttcctctgctgataaaaagcaagagtaagtttcatggggcaagggagtggtagctggcagatgagtcttgcagttggtgctggaaggggttcccaggctggctcctgtagctcctccagtcagccagggtcaggatggccctggcatgagatggctttgccctcctgatcctctctttccatctgggtccactataccctcccatctggggtactggtccaggacacacataattttcaaacgaggaggagcatgggaggtgaggcgtgcctcctcctttcatgtggcctggatgagtctcctcactgctgaagcctaaggaagtcgggctgctcaccctacctcctgtcccttttcctcctgggcactcagctagacggtatatcccaagctcccttgcaatgagaggcagccatgtgatctgtttctggccgatagcctgtgaccgtcaccatttcctcaccatacctgccacccagattctctaagatcctctaagtttctctcttctctcatctacctgccagaagcacagtttccagcagaaggctctgcagccccaggggatggcaaacccacaagctagaaggagcctgggtccttgaattgccaaatagaacatgtcccactaaacacccactaaactgttacatgagcgagaaataaaacatatactgtgttaagccacagagggcttggcatcttttgttacagtggtaagcctattataaaccaacaatgagcctctccgaatggggagagacgctgccatatgcaattccagttccttgtcagagtcaataaaatgagatagtgtaaatcaaaatacctagcatggacctggtacaaaatggatataagggaaacagacaggggaagaagtgagataaaagaaggtgagaatgaagtgaaaaagtgttttcagtggatttcagtgacaccatccccagcctcaaggtattaataaggtattaataagctttatagaaacaaatgaaaatcaggcagtccatcgtcaaaaatcaagcaagcttgcaatactcaagttcataaaaattacgggaccagtgaaacctgtgtcttctgattcctcacagaagaattcacctctattccatgaaatttcaacattcagtagcttccattccattctcatctatgaaaaatggggaacccacctaagaaaaccctcctggtaatcttggaattcacagtctaaacattcgtagcagagttactcacacagccaaaaagtgaaaatgccccaaatgcccatcaactgaagaatagatggccgggcccaatggctcatgcctgtaatcccagcactttgggaggtggaggtgggtggatcacctgaggtcaggagttcgaggtcagcctggccaacacagtgaaaccccgtctctactaaaaatacaaaaattagtcaggcgtggtggtgggtgcccgtaatcccaggtacttgggaggctgaggcaaaagaattgcttgaacccagtaggtggagattgcagtgagccacgatcgcaccactgcactccagcctgggcaacagagcgagattctgtctcagaaaaaaaaaaaaaaagaaagaaagaaaaagaaaaaagaacgaataaagtgtggtaaatccatacaatggaatattattattcaataaaggaataaaggaaatacaaatattaatgcatggcctggataaaccttgaaagcactaagaaagaagccagttaccaaaaaaaaatcacatattatttgattcaatgtatacaaaattccagaacaggcaaattcacagaaaaggaaagtcaatgaagggtcagtcatctgagggtggggtgacagataaaaggtacaggattttttggaaggatgaaaatgttccaaaattgtgctgatcgttgcacaattctgtgaaaagactgaaaaccatatgcgtgcattaatatagaagtcactgccacagatagcaaacagcttcctgtgttcccagcgcctccgggcacacagacaactccgtgcccacatgcagcgcatttctggcttttccaggctgtggcaagagttcttcccagaacagccccaggaagtcccaggcaaaaagaaaccaccagctcccggccatcagcccttctcggctgcctttttccgccactctcttgggaaccggctgacagggaatcagagctcctcagaacttacggttcatgccgatgtcatggtaggtgaggatgacaggccggtttcccttgggagtcccacacagcgtgacgtgaacagagccatgtaaagtctcgatgtcctgctcctgaggagacacagcagacagtgggctggtcatgtggggttcatggcatccgcgtggctgaagacagccagcctgtttccaactgtgttttgaggaagctctcttctcatctggccataagagccccggcttcgggcagcagctctctctggccagaagccactccaaggaccagggctaggaggggactcccaggaggcaggggacagaggcctggctcagactgcgctgttaaatgcaccaaatgctggggaaagggcttgcccgccaccatctctgccccggactgtttgctccatctggaaaacaggccatcaagcctgcgcttccttgcttccttgccctcaggccccactggccccacaggttactgtacctgtgactaacatctgctggcttggggctacacagaattcactccccacttccaagaacagccctcagtttccttcaggaacccacccaaccctcaccctcagtcctaagtgttctgttgacagtgacccccctccccacgtttcacaagtcaaggccaattcatgcactccacctcccagttgcaaggactggatcaggaaagaacacatgggttggctcaggccaactaaagccagctgcacttatttctagtaattggggaactggatcggacttgatggagcaaggttgggagggctggatctgtagcagccacattgtcaccgtgaggcaagggcctgcctgaaagtatggccagcccagggatggaaaagagtgaaagacggtttggggatggcatccaccacctgggattttcagttacacggcccaccaacttccaatcccatgtaagccatgttgagttgaccaaaagattctgaatgataccatgcccatcctccctcctgcccttccttcttgttgagccagatggttctctgggtcaaggccaactctccagctcggccagtgacccccagccagcttactcccagtcatccctgcacctctccgcaccaaaccttcctaacagctgaagacctgctcacctttcttcctctggaaaacaaaaaaaaaaggcaccctgccttggttccaagcaccccagctcactcatggaccaatctgtcacctgccatgttcatctaaactcctgcagagggtggtcgtgactctttctcaattgtcacttccactcacccttcaccccatgcctaccctgggcttccgccctcctcaaggtcaaccagaagttcccgaggaccccagtcactcatctcccttgagcaatttccacatctgagagcagtgacctcccctttgaagtgccccactctgggctctgctcccacagggcagttggggagcaggaggcaaggccatcaggctgctgagacctgccaggtgtcaaggcagtgctgaaccatgtccctccatgtcctcaccctcacaggagccctgccagagccatgtgacccagctggctgaggaagtgaagtcagtatcccagagtcacacgggcaggcagcacagaggcaggtcccccagacaatcagcctccgcggggccccaggcttctcagcacttgacccgcccgcaagcggcgcacactcaggcctcacgaggccacctcagctcagcacgctgcattgattttccaaagattaaatgaggcagtgaagtggaacacagaacactctaaatgctgttgaacctgcttctagaagctggcagaaatgcgacccatacagatcactgccgtgtggcagcagagaggaaggtcagcgttcacaaactcacgcttgagaagaagggatgggacagatcaccacttaggcaccctgtgggggcaagtcacctcctccccagcttgaatctttaaaacaggaacagcctggcccttcctacctcctagaggtgctgaaggcccagagaatgtaggctgctccatctgtgagtgaccccccgtgaagtggtacgaggcagccacccccacgccatccacacccgctggtgatcggattccacctctgctacttcttacccctgatacttaaggcagttcaatttcatctgagaaacattcattaggcacctattgtatgccaggtcccctttgtccccgcagggacgagtgggtgacaactcacaagctagtgggggcagtggaaatggccccggggggctgcagttcctctgggtcctctgagaaaggagaaagaggatttaacccactggggggttgctgggaatgggaccaggaaagcctcctgaatcccttaagaccaacgattctcaacctgaggaacaagttcaaaaataaagaaaaatggcatccaattcccaggttcccccgcagcgtatgaaagctccgtactgagtttccaacaagaactcaccacctccccctccccagcggaggagtgcaggggttcccgacactcacttggagaaccccgaagccagccagccccaggccaccatcgtgcttctgcagaaaggagacaagcaccccagctcactcatggaccaatctctcacctgccatgttcatctaaactcctgcagagggtggtcgtgactctttctcaattgccacttcactcgcctgccctgggtttccgccctcctcaaggttacctaaaagttccctgttcctgaatggcacagggacgcagcagtggttaccaggtgagggtggtgacacataaagaggcactgtacagggccaggcccagccccctgggagcacccgggcccgcccagcacggggtcatcctggcacctgcattagcccccaacaccgttaagtcccctggcacacagagctcagccccatctcccttctcccctctctgcccctcagggcccaacacttctttcctgcccataacaggcactggaaaaatccatagatgagggagcagtggcccagcttccagggggccggagatcatctgctgggcccagcccagccctgaagccactgtgggaacaaaggtccatttgtttgtgggggcacattcttcattgtctccccagctgacccacatggctccctctaaaagacaggccagggcaggcggtgtccccaccgccacggacatcggagttcaaatccaagtcctaccactccccaacctccgagcctccaggtcctcacccctgagctgggagggccgcctgcaccccagactccatagcaggagaggagtcacctgcacggagcccagagcacagcaccaggcaggatggggactcccggtgcaggcagcagagggtactaatgtggcagcaggtatgggacacgccaccccagctggcatcaagaatgtccctggcagcccccggagttgcgagtgggtagcagatttttgactcatctctttgaaggtcttaaaattatacagccatggaaccagaactaaactggaggatctattcctcagtccaagaaggaaaggctgcctaggtctcactcactttctgtccacaggcctctgcatagctgcctgctctcagtgggcacccggtatctgctggataagagatctgatcccgacagatgatggtgagcattacaccctagaaaggaactttctctcctaagggcatcgatccatgttgggatcttccccactctgctcttggattggccatgagatgctcagctccctcctgataagacccccagggttggtgagagcctcacagagcactaacacttcaccccagctcatgagtgtcaggaccctggctgctgcctcatcactgccccaaacctcagcctgagcaggactcaaaaaagaggctttcgacattgctagccttggtgggaaggacaaagaccccgtctgagaacatggaagtgaagtggtgaaggtcacacaggggcagggctgcttcccaggcataggtgagcagaggtgagggagaacatttgctaagcgcctacgaagagtaaggcagggtatcagacctccatgccaccgggaggcccatcaatcccattttataggtaaagaagttgaagggactctcccaaggtcataggtttgtggtggtagaactaggattcgaactctctccgctgggcccttgctcctttgtgccagggtctgctggcccccatcggtcctccactcagttcctggccccccagcacacacaggaggaggaggaaaaaagcaagtgttgtcatcttccctgtacccaagtcccatcccctaagtcacacacacacacacacacacacacaacaaacacacccaccaacaaacacacgtgcacgcacgcggttctaagccagtcaagaagactgtctgagattgaatgggagaattacaacactcacaaacacaggcctttgtcctattcagtcccaaaggaatgttctgtccttctgtccctgcggggatcaatcactcagtgttctggagagaggaacccatcccgtgtcttctatgttttcccaaagagaaagcacaaggaacccagaacatcagaactgcaaggtgcactgttcgtcctcttgcctgagagagcaaattgcctgtctcgaagctcatgagggaccccccaacttctggctgggacaaggctggcaacacaaacacaactcctccaccatccagagccccacacccagctcttccacagttcaggaccaggccacagaagaccctgctcacagggcctgatccagacaagaggatgaaaagacaaaaacctggctgcacacactttcctctcacctgctctggaagagtctagaaagctgctctttcaagtctagaggtgatggcagggatgggggcagtaataaacagccactgcatcttaccccatgcctgctttgagtttctcacacgtgttttctcattaaatacacggaacaaccattgcagagatgagaaagctgaggctgagagagattaaggacttcatccaaggccacacagctggaataatggggcaggatctgaaccaagcttggattcgaatgtctgcatccaaagcctgttctctttaacatcctgtttcacattctgtgccgggcagaagaggggaaggaaacctttctctgcaacgtgcactgtgactccctaaaggggatgcagcaagtcagatttcccacacttatttgactgcaaaacactcgtacctccccagcgtctccaaggactggccatccatgcagcacaggctgttccactaccaaacagaatcgagaaataatatctgctgctcccatcctcctaaaacaggcacctgcccccaaactgcacgcatgtgtgtctttgtgaggaagtgtgccaacactggaaacacctcagcacagacatgagacgtcacctcctccttcctgctacccaccatacacatgccatgcaaaccctgttctcttctttgcagcacgaccacaattacaaatatatgtgtaacagctgcctccccagccaggccgccaattcccagagggaaaggctggctctccaattgacagagtctggcccggagggtacacttagagatttacagtctacactgcctatatgctggcaagtagcaaccatggcacgtaccactatggtctacaccgcctggaagctgtcaagtggggaaacaggacctaacaccaagcatgccttaaagatttcatctctttggctgtcaaccctggcttgggagctttaaaactatggcagactctgttggttggcatcccaaacatctgttgttcccttctttttgaggatagaattccaactgatgtactaagcagcaaagtgcctgataaagtggtccccttccttactcacctcccttgtaaccaaagatggtcaggaggttcagttctggccaatgaaatgccagcagaaaattcctgtagcttcaaggagagttttttaaaaagggtcaaacttgaccttttgattcttgtcctttcaccctcctgcctgcatcctacttggaacatggatgagatgcttgggggttcggtggctatcctaccaatctgaggaccaaagccgcatgctcaggtgacagtaggaagctgtaaggactaactccagctgggctgggtgacattcatagctggggtgttagctttctaggttggtgagaatagcaaacatttccttggcacagcactgttttttgagcaatacttatcctaatgatataaccaccacgtgcccttggccaagttatcagccttctctgacaatccctgccatcagttgtaagctgaggtcaatgacaaggcctcctgctccattaagatgctcccaagactaaaaccatggtacagacctgaatgtgttttgcaagctgcagcatttccctccatgtcagttgttatggacaaccgctccagagatgattagtgtgaagctcccagggccagccccactggcttaagtcaactctctggatgatccggaggggctctggaggccagctgtgactgtctccccgctgcccctggtaatcccctccttcccagcaggccctgggcagatgccgaccgttctaggctctaagaggatcaccgcatacccaggatctaagtcagttggtgggcttggtgaccctccctcagtctagcaagtggggtccaagcatggccagagcagttacggtgccctctggaacagctgtccaggaagctgactatggctcatcagcataaagtcaaggcccatggcagcaagaaaggcaaatcatgggaacagaggctcaagagagaatgtcaggggcctgccccctccccaccatcttttcataaaatgatacactcctccccctatattttcctggttcatcgcctatgcccatggaggaggaggtggagacacagcagtgccattcatcttaatgatccattccattaagtaacaaacataggctaggtgtgatggctcacacctgtaactttgagtttgagaccagcatctgcaacataatgagacctcctttctacaaaaaataaaattagccaggcatggtggctcacgcctatagtcccaactactagggaggctgaggtaggaggatcacttgagcccaggaggtcacagttgcagtgagccgagatcacactactacactccagcatgggcaacaaagggagaccctgtctaaaaaaaaaaaaaaaaaaaaaaaaaaaaggagtaaagaacacataaagtaccagagataaccaggggaggtgtgtgtgtagccaggaggaacacgataaaaagacagccacccacttactgagcaagtctgataaagccagctttgtctcctgtgctatatcatgacagccattgaacagcctttggggctgaagtataggtgcccaatgagataacagaattaagattcaagatagataggtccttgggcttccaaagccaagactcccctgcaagcctcacacaatggaagaccttcaagaggtcaagctgggcctgtcacttctcgcttcattccccagtcttcttttatgttgacatcaggtcaagagaattaaacaaagttacagagggtcagggaacaggctgcagtgggcagaaggtgtcagcctgggaatacagcatgcaactggaacccacgctgaagacctcagttctccaaggaaacaagaattaggaagaacatctttgtttggattagggtgaagagatggagcagaccccatcatccatggagcaggggagggcgacaaagacctgtgagctgagcccgctgctgtgtgcattcagtgtttgcaatgtgctcagggacagcgatgctccccactgtttcacagattacgaaactaagccccagggaggtcaagcgagtggccaaggacacgcgagtagcaaatgacagggctgggtctgcactcgctgccgctcactgcaccctttctgggacaccaggagatgagtgaggtcagcctggcagagcctggcctggacacacctcggaggcctgggtatgagccccacctctcctgttccattggagggtgctcctaggaaacccacagcagaattgcagaagtatgctgtgtttattttccaaagtctcattttgtgctgatccagatgagcgttcctgccatctgtcactctaagggtttgctctaagtcccaatggctttgctaggaagtagggctgggggagggcgagaatgggaaatggtgagtttaggatttccaggcttctgtctgagttctgcccaccttcagtcatggggcatgaaaacaagaagcaactgtgtggaaagagagaaattagcaaaaggtcaccatttccattttccctgtgagctggtccgcttccaagaaaaggagggaaaacagcccccccaccgaatgggattgtacatccctaagaccagctcagctctgctgaacaagaggccttgcagcagaacgggagccagacctccagagccctgcccggccctggtgctgccccagccccctccaccactccacacggaggccctgtgggtcacatcagctcatttcccacagagccctggtgagcacacaaacacagattcccatggaaaccaaatcaaatctaaccatctgaataactcaagatccaggtggagggaattagaagcagcaaatccaacagaaaaagcaatttgaagccacagaaagtcactcggcccacgaggtacaatttatcggtgatgaagtcaactctgctgtcccttccccaaaactcgttaaatgaactttggctccagacgtgtggattgaatcagctttcaccatctatctcaccatggcgtgacactgggcaaatccctccagattttctgggcctcgtatcttcaacataaaacaaggatggcaaggatagatggcaaggatacctccctcaacaaggtttcatgaggatcacatgagcggatgcaggaaaatagcccagcacggtttctgacgtacagcagagctcaagagaggccagccattacgacttccatgactataacatttttcggaagcagatggatctaagtctaggactatctctacagtaccctttggcaagttccctaacatcttcaaatgggtctctcatctgcaaaagaggccaacacccctcaccttagcagggaagccctgagacaatgagtatgcaaatattcattcttcctcctcttccctcccccaggtggccttccacaaagctctccaactggagcagaagtcttggactctagaattctagccaaagaaaataagctggaacccaaaatactccccccctccctactcatcaaatctgcaaacacaattgcctaaaacctgatgctggaggcctctcagccgagccagatcagaccgtgtccttcctgcaacccggacacctaggccagcagcccgcccaccccgtgccctgagggttctggaatcttttcaggaaccagagccaggtgggggcctgacagcgctggcagaacctcatatgcaaatcaccaatcactttgcccgaacatcacccaggacaaaacaaagagaccgcctaaaggcgatgccagtgatggagagataaggcctgatgccatctgctctggcaggcgagctgtctccagagacaggccacccagcagctcaatgcagactccgccagcagctcctcagtgccgagctctgggctcagtgtgtgtgttttgattcatttaaaaaacaaaaacaataaaagcctaaattattgactacattggtaaaggaagtaggaatctgcctgagttagtcaaagtgctgaagcagtaattatttttcaaggaatgacatcggctgctttcagatacacaaaataaagcgactcagactccttagactggaccaggagggaagctatgcccagggcaagaactgcccaggagggagccctattttaacaagcaggtaagaaaccaactaaatgaatagataaaattcatttgccattaaggcacagcaactcttgagtcctacaacaactcattgtcagtaggctgaacataagcccaatgaagtgttgcttagattatctgcttggctagattttttgacaagcagacgtgtcaaaggtgaaccacaatctagtccataagggcttgatcagcctttccaggaacagggctatactcaagcatcacggttgagagaactgtctacgtcagacagccctgggctcaatgtggctcacttcacagctgccgcccctgggaaagcctcagtttccttatctgtaaaggaaggatgatggtacaggtccccaaagattcagcaagagggcgtgggaggccctcagtgctggcctggctcatcagaggacactgaagtgcatggcagacaggtgctgtcctgtcgctttgctgcaactcccatgtgaatctgaggtcagattatgctgaccagtccccgggctgatacgccctgtaggcccccttgaccaaagctctgtccttctcagttcctggccctggaacccatcaggccccagagagcttccgtcgtcacactgcactgcatcttctgaaggaaattctacagcaaccctacacccaagattttggagactgctgaaaatctgggggacgctttcatcaatctcttgagtccctaacaccttccaatctaagaagccaaatctaaatgaatacagttttagacaaagattttcttttggtaacaaccttgaaaagtgtcattcaacactcagatttcagctcaaatattgtgacttactgggaacactgagcctgttaacagcttacaggaataacacatttttgcccttggaaatttcagaattcagatcagaaaggcctttgcttgtgctgttacctctgcctggaatgatctatccccagtctctttgtcacgtgactggctctatctatcttttagacttcagtgcaatgtcaccacttaaaaaaaagcctcaacctaagacagcaccccagccatgccctatcccatcacctggctccatatcacccttcactgttatcttcaaagcacctacagaagctggaatgctcacatttgcttgtttgtatgtttgtttgactctttcttctgaggaatcgggattggtttcaaatatgtgccctggaagcaaatggcttgaggtcccctttccagctctgcgatctcaggcaagttccctaacctctctgtgcttcaggtcctctctctccgtaggatggggacaggatcgccgtaagcacacgtggggcacatttggcatgctgccagacacattctgtgctcggcagtgctgagctattattccagaatttaggttcctgaaaacacaggtcactgcctgtcatgctcatcactgcatccccagcacctaaactaatgccaggcacaaagtgggcatttgttaaagaaataaaggaaggcacaatagggaaaatgctccgacctcataggacagcttggggaattaactcagacggctcagcccaggctggtgcacaatgctgggaaatcttatcctgacctctgctctatccttccaaaggcttctctgtgtggcccccactttaatgatgtcctaaggggcagcgccttagccgaccccagcctgagccacataggttgaccttccctgggagtaggtcagttgcctgtgtcctgagatgggagaatgtaaaagtgttttgcagactttccagagaaacaaaaatgtgaggaattatcttcgcagggagcagataaactatgctttctaggtttctcagaattggtaaccaagattttaaaatccaaaataaccatatgatccagtgatagggtttggctgtgtccccacccaaatctcatcttgaattgtagctcccataatccccacgtgtcgtgggagggaaccagtgggaggtaattgaatcatggggtcaggttttgcctgtgctgttctcgtgatagtgaatgagtctcaagagatctcatggttttataaagagcaagagatctcatggttttataaacggcagttcccctgcacacacacactcttgcctgccgccatgtaaggcgtgccttggttcctccttcaccttctgccatgaatgtgaggcctccccagccatgtgaaactgtgagtccattaaacctctttttctttataaattacccagtttctgatatgtccttatagcagcttgagaatggactgatacctctagcaattccacttctgggtatatgtcccccaaaactgaaagcaggatctcaaagagatatctgtacacatgttcacagcagcagtattcacaatagcccaaagtgcccaaagtgtccaccaacggacaaatggataagcaaaatgtggggcatacatacaacagaatatgattcagccttaaaaaggaaggaaatgctgacacctgctacaacagggatgaaccctgaggacacgatgctaacttataccagccagacactggcaaagaacaaatcaatgcaaattaatacagttttataataataatatagtgtatgactgcacttgtatgaggtacttagaggaatcaaaatctagagtaatcaaaatcacagagacagaaaatagaaggatgactgcctaaagctagaatgaggagttgtttaatgggacagagtttcagttctgcaggttttaaagttccaggggtacagtggctcaagcctgtaattccagcactttgggaggctgaggcaggtagatcacttgaagtcaggagttcgagaccagactggccaacatggaaaaacccatctctactaaaaatacaaaaattagcccggtgtggtggcgggcacctgtaatcccagccactcaggaggctggggcatgagaattgcttgaacccaggaggtaaagaaaggttgcagtgagccaagatcgcaccactacactccagcctggatgacagagcaagactctgtctaaacagaaataaaaataaataaatacagttctgaaaatggacgatagtgatggttgcacaggaatatgaatgtacttaatatgacggaactgtacatttaaaagtagttaagttggtaaattggatgttacgtgtatgtttccacaacagcaaaaataattcgggaaaacactccatgatagttagtggatagggtgtgtgatgtttggcccggcactgatgcgggaagcaccacatcattggcccttgtcagtgtcctctctccaccaccacttaacaagcctggagcactgtctccatttcacaggtggggaaacagaggtgaagcatcttgtgctaagggtcaatcaccaggaaagggcacccatggggcttgcgcttcactcttcctggctctggaatggggccttcacctgaggaggatggacaatcacatccccactgcaggaagatacaacctcagtgccagcaagccgctcccctggggaacacaaggagctgacatttcagccacagggaaggttggcaagggcagcttcgatcaggctgagggaggctggggtggcccggcccatccctgaatgagcagatgacccctggggctaacttccagctgttctcagctcagagaaccagtcaaataaccaaggccatggtgctggtgccacagccactgcatctattgcagctctgacttccctgggtgcattttttcccattctcaggagggtgaaaaagaggattgctaccataactcttagctgccccaccatgccaccctcaatgagtgacttccccctttctctgtccctcaggttccccagctgtaaaatgaaggcttggacttgataaacctcaagatagtacattcacctcccaccctcctggagcaccttcgcatgcccagcgtcctgcaacatagagaggaacgggatggagctctggccagggcatgggagaagcctggacctcagcacatgagtggtgcgggaagaacatgggcttccttcctggtcaggcagagctaggtgtggctcccagtccctccactctggcctcagtatacccatctgaaaaataaagctaatggtgcctctcctgttatcatgagatattgaggcattacatgagatattggctggcaagctctcagcacagcacctggcaggtaagaagccctcaccaacatcattaaaacctacacaagcagcaaggggagcactcagggctggaagaggtgaggcccagagtctggcaccacttccccaatcactgctgagtgaccccaggcaagtcacttcccagtgctgtctctcttcttcttttttttttttttttttttgagacagagtttcactcttgttgcccaggctggagtgcaacgacgtggtctcagctcactgcaacctctgcctcccaggttcaagcaattctcctgtctcagcccccaagtagctggggttataggtgcttaccaccatgcctggctaatttttgtatttttagtagagacagggtttctccttgttggccaggctggcctcgagctcctgacctcaggtgatctgcctgcctcggccttccaaagtgctaggattacaggcatgagccactgcatctggcccttcttcttaaacactgaggtcagggtgatctctagggacagcctgacacaaccaggatgatgagaaaatacacaccttggtggtggtatagaaagcctcgatcatctactagccaatgcttccagcccctctcccatcctttcctttccttccaaagacagtgcaagattcctcgcctcgggatggatgggggagcattcatgaaatcagagattcaagaggaaaagcggagttgttttgaggtaaggaggtagaatagaggagtgagatgcagagtgcagaatgggtcccaaactggggacacctgtgcaacacatgggtagcggttcaggtgagaacacctcagccacctctggctctctggctggtccaggagtgcgcctctcctccttcaaggagaccacaagctcgccatatgctcaggctttctgccccaccctccagaggccagcacagcatgggacccaccccagcttggggctaacgagtccaggacttagatttcctgaagttctgacccagccctcggctgagagagcccagcccgttctcctgagagcctattcttggacacagctgaggtgcaccccctggcccaccctgcaatcctgagtgggaatggagatacttcagttctgggccagtaaaccacagagaaggctggtttcagtttcccaagtggagccaagaacatcaagcttttgcttccgttccctcccctcacagggtcccaagccagcccagcatcacaccattttccccacacacgccccaccgttctggccagctctttgggactgaaacaggcggtgtctctgtcctgctttcgtgggaagtgactggttcctgattctttggccagcactcaagtcagcttctgtctgggagcagcagctgagggtgaggacctagctgagaccactgccttctctccccttgcccgcaatgtttgcacaatgatctacttaaaccaatggaaagaaaaaggaaaaagagaagacgggatgaggaaggggaaggaaagccacatcctctacttgcctggacatcaaactcttgcaggaggccggtgatggtctgtgaaaagacaaaaaaaattgtcaatttcatctgttttctctgtaagagaaataatattgggacatatgggcctttctatgacctgaatctgtacctacacttcctcctttgtggggtctccttaattcctcacaaaggcaggctttccttttctcttttttttttttttttgagacggagtcttgctctgtcgcccaggttagagtacagtggtgtgatcgcagctcactgcaagctccgcctcccagggtcacgccattctcctgcctcagcctcctgagtagctgggactacaggtgcccgccaccacgcccagttatttttatttttattttttgtatttttagtagagacgggatttcaccatgttagccaggatggtctcgatttcctgacctcatgatccacctgcctcggcctcccaaagtgctggggattacaggtgtgagccactgtgcccagccgagactttccttttcatctcaaaatagaagtccagcagaaaagcagacacattaactggactcctttctgacaatagccttgatagataaaaagctgaaggtctaagctgatcacaagcttgagagatacagaaatgtgatatctgactattaactggtctccccggctccacccatgtgctatacttttaaaactcaaacctgaccacatcatggtcctccttacattttttccatggctgctgtcatctggacctggattaaatttcagtctcttgtgagtagaagaggcagtggagacctctaagcatttccctcaatctaaaaattctgagtttcaggctgggtgctgtggctcacgcctgtaatctcagcactttgggaggctgaggcaggcgggatcacctgaggtcaggagttcaagaccagcttgaccagcatggagaaaccccgtctctactaaaaatacaaaattagccaggcatgatggcgcatgcctgtaatcccagctactcgggaggctaaggcaggagaattccttgaacccaggagacagaggttgcagtgagcctagatcacaccatggcactccagcctgggcaacaagagtgaaactccgtctcaaaaaaaaaaaaaaaaaatctgagtttcagcccaaattctatcttttaccagagctgtccatggcaggacaggcccaggaagacagagaaaagtcttgtgtcccctctggcctggtgaaagtgtgactcggaggaccaactggagtcttggctggccaacatttctaagagatgttgctggcatgttttcctactgacccagagatggagtcccaacactgtgaaaactgagccccagcctcacccaccacaaacccccagaaaacaagacggctcagcagagcgaaatgcagaagcgatgaggggaacaggatgatggaatggagctcccattagatggcagggattggaagactagatgacaacacaggccctcgtgctggggattcaaatagccccacatcccctgagctgtgggcaagaacatcagggactttgggtaaattcaagtggaaacaaacgtggctggcacctataccattgccctgtgtgtgtatatgtgcatgtgagtgtgtactggtgggaaagaatggggaaagccattctgtacagcaaacaccaaccttcaaaacgtcatcagagtatagtggcaatctagattgaggacagacacaaggaagaacttcccaatagtcaagcctaactctaaatactttgctgagtcaatctaaggaattgaaagaaatttatttccgtctaaaccttgaaagaaagggtaaatattcactgagagatgcactggcatgtaaccctgaatgggcaagctcttagacatgtgtttcatacataaaatgttctaaggattccagtaggctgcccgaaataaataaaaaatgttgttttaaatgcatttacccttggacccagcgatgccacttctgagaacttttttctagggctgtacctgcacatgtatgtaatgacacacatgaaagatacaagggtgcaaatttcttgcagtgctgtctgtaatagcaaaaggctggaaagacacatgtgttcatatactgggcactgggcaaatacatgtagtggaatactatgtacctaaaaagagaaaagcaagtggattatggactgatgttgaaaagatctcccagaaatgtcaagtgaataaagcaaagtgtgggatactattttcacagggttttttaaaagggagaaataagaatatggtgatatgtatttgttctatctagaagtttctgtttgactatttcagaagactatgtcacagacccagagtttagaggacacagatttagaaattgcatagtatacagtaggggttggcacactgcaatccgcctcaccacattttaaatttttgttggaacacattaagtacattcacttgtatactgtctatggttgctttcttgctataatggcaaagttgagcagttgcaacagaggtcatgtggccttcaatgcctaagatatttactatttgaccctttgcagaaaaggtttgcagaccttagtgtggaatgataagcaagcatctgtagcctccccaggcttggtttctaactctagttgtaccagctatctggatgaacttgaccaatccccttcctgtctaggaccagtttgtttttatttttaaatctgcaaaaggggaaaagagatggttgcctcacacatttgtaaagaaaagtctatgaaattatgaacctaaaacagagcagccacatgtagagtcataaggaaattaaatgaacagtctattcaccaacgtccgctggcctgggtttgattccatgtcccacactttgtaactatgcaaagaagacaaattaacctccctaagacccaacttcctcctctacaaaatgagtacgatcacagaacctgggacctgcatgaaccaaagttgaaatacggtcggcggagaagcaggcatgcaggatgtggttagtgcatggtaattatcacttttaaaagcatttagttggctttagactaacttcacttttggaccaaagcttccacatttttaaaaagacatatcagaggcagttatgaggctaagtgagaattgggatgtaaacatgctttgaagctacggtgtcaactgtgcaaatgtaaaggttcattcatcttcagaacaatcagcccaggctgggccctgccagcccagcctatagacaggggcttctgtttccaacaggaagagctctgttgacagaagaggtttgcccaaaaagataataatagcaagtgaaaaagtgactatgcattgcccatctcctctatggcaaagttctaactgttccctatgaattaggtcactccatcctcacttggccccatgaggtaagtcctaatgtcaccattttacagatgaagaactagaatatgaagatactgagaggttagcaagtggacaccaagctgcaaagtgtcacagctgggatttaagcccagacagtgcggccccagagtatgtggctttaatgagagctgaggcaggcagtccctatgggcaactgggccccatgttgcatgttctataaccacagaatgttagagacgggaaagctgagagaacctctggttcgatgtcttcactttacaaatgagagcagaaaggcccagagaagtgggcaaggggcccagccctcgatcctatgggacttgaaccagagcctctcacaactttgcatttcaaggaagcagtggacaaatgtgttatgtgtgtacgcatgtgtgtctgtatgctatgtacatgtgtgtgcagcatgtttgtatgccgtgtgtatgctgtatacatgtgtatttgtgcagtgtttgcatgcccataagtacaagtgtgagctccggtgtgcctgtgtgtgtctatgtgcacatgtgcctgtgatggggtagccaggaagatctccactcacctcccctttctccaccaaaggcttcacctcagcgaggtctacatcctgcatctcccgagacatgtccctgctgtcacctgcctgcaaggagacaaaggccaaaaggtcaacacttcctgctgagaggtttcctaaaggaagcaaatccaagaccaatggcaagaaggccaggcctgcgctctgcccagcagcttcacctccctcgtgatgcactgcaggggatgaggaggtcccttgtacacacagcccatggacccaacccagtcttcccattggggccagcgcagtggatttcctgggagaggatactgaggctcacagacaccaccctcccaatgaaatggatagatcagcctcacaaacaggtccccataccaagttcaggcccacccaccatacccaggatgcagctcactgcattctagaaggggacctgcattgctgatcccaaagtcaggcagcccccgtgtgacaatgaaaggggaacacaagctcacacgatgcttaccacgtataggcatagtgcaagcttcagcctcacagttagccctaacagaaggttggtgatgcagacgcacagacacacaggcacacgcatgcgcgtgaacacacatacacaccccacggtgcaggactctcggctgcctgctaaaagggaagaggggcagaggaaaaccttaagtcaaggagtttggcaggcatttgaacgcacagtacaattttgtaagaaaaaagacctccaaggcagaaagcacttcctggatcaaagcaggggatggaccagaggggttacctgtgctctaacacagggcaggtgcagaagtgtgggctgcaaaaccagactgaagcacagcccaggaagacttggaatgctgccactgactccctggggtgcaaggcttgggcaggtggtgctatctattaagcatgcctccaagagctgaatctagaaaccagaagtataagcatgtattcttctagatcagtagtcaagttagaaaaactaaatgcccatcaatccctggggtgaagcataaaaaatgcagaataaggtcaagtcttacagacagcagcagaggaccggcggagaagaagtaagtgacaagagggaagagcccaggccacccacccagttcacagatccagactttctgaatggaaaacgcctgaccaaagccctcacacagccagcttcagagtgggaacctgggccccgcactgcccaaggcccctcggatgcaatggtcgagagaatgcaagcctctgaaattcctgcctagggctcctctgaagacccaggaactcccaagaacctggtgaaacacctcttagaggtcagccggcaagtgcgggccaccccgaatccaccccgggtccatcccttgtgccaacacatggcattccgtgggcagatcctgctctccactggggtgctctggtctggggccccagcatgattttccccagtagataaccagccccacaagaatggctttatacagactttggagtctatgctccagaacattctgaaaacaaagtcggttttatatttgtgagcattcctgggcagctgccagcttggaggcaggaggcatgaaaggcccgcgtctgttagccttgctaattcagcaggttcgtggtcccaagaccctggcctgtgggacacctcgcctacatggcctagggagccttccagaaacccagggccctgccaacgccacccctcattctgggagtgaaaggacttctcatttcacaggagcttcttagcataccctgctcagcaaagcgcgccagggtgaagtcagggggctctcactgtcccaccaggtgggttcaagcagtcctatctgtgagcttcatcaagcaggtagcttgttcttttctctacctctagctcccagcacgagagactctcctaggcagaaagtcaggctgcaactccctctctgaataaatgagcaatgtagctcaacagcatgctttcagtaaaattcacttttaaatcattgctaaaccccaagagtgcaatgtctggaaaacaaattctacatttaaaaggactcgagaaatgctgtggttcagcccagtttggtcagttctctttggcttccagaaaccgtgatcacattaggacatagtgtctgtcagtctccaccagctctctcgttctccagaacagaaaagacagaaatgtccaccttccccgtttcctctatctggtgaaacctctttaccctacccggcaccttttttattcctacagcttagcttcccagaccacatgaggcaatgggttaaaaaaatcgctgtgtgtcctagaaatatcaagttcttgagcatctgcttttgggagctggtggggccttctctgacccagccccctcactgctaaaggcctttgggaagtccagagataaaactgctgaggatgatcacggggtatatctaaactaggggggattttctctcccaggggacatttggcaatgtctagtgacattatttattgtcccccaaatgattccattgattttgaaccatttaggaagtgtcctagactctgaagtctgccgggagactggataaagctttgcactagtctggggggactgtgggggctgcaggcctcggggtagcctgcatgttggtcgcgtcctgcaatactaaggccgcatgaaccaaggactgcagaaggtgctctctgcaggttgacccagccagctgctggcggtccaccatctggccagcctgtagggtgggaggagagcggctccctcacctcagttctcccgagttgggcccatcaagcagcccttaccttgtccctgatgcctcaaccaaaaaacttttcaaactttttttgcaggagcttttatccaaaggaaatcatgtaaggaagttcaacatataaaaatgttaaaaaataaaaattttaaaatttaaaaagccaaggtgcttcggctcaagccagggaaaggggcctgaaccccactccaccccaggacttggctccctacaatctgcccactcccagcccccacgccaccaggctggccctcaaagaacatctgagttcacggaagcaggatggaaaactcaggatttattcagaggtttctacccactaggttctatgtgcccaacacagagctcagaacaaaaataacaccagctatggtgatgagactggctatgggactcatctggggatcatgagcaaacagacccagttcctgcccccacggagctcacagtcccgaggggacaggcactcccttgggctcactcatcaggctgcatctgggctgtgtccactgtctgtctgtccccctggagggcagagcagatgctgtctggacagcatccaggacagcgtctgtgcctcctggacagagatcctcagctcagcactgctgacatttgggccccacaagcagcctctgccttaggggctgccctgagcacgggaggaggctcagcagcatccctggcctctgcccaccacatgcccacagcatacaccccacgctgcgaccagcaaaagaatctgcaaacgttgccaaatgtcccctggtgcgacatccaccctcctctggaatagctgattttagtaattcctagtaggtaacagtatccagaaaatgtcagttggatgcattcttatttaatctagtgcatgcgtgcacacacgcacacacacacacacacactctcaaatgcactcacacattccctcacactgacacacttgcaaactttcattctcacactcagacattctcacattcacacacttatactcacacatacatacattctcacaaacacactcattctcacatactcacactttcttacacactgatacattctcactttcatggactctcacatccacagtcatttatactcacacgcactcacacgcacacgtgcactccccaccaccttcattcacggaggagggggctgggcccaagcggctgccagctgtcctgagctcaccctgctggctgcagcacaggggctggagtggagtcagatccaatgttcacactcttccttcactccactctccccaaaacactttttctgggattcaaagtcaccacctgagaatcatggaaggacccagttctggcagaagctgctgtcttctggtgtctgtgatctccttctgccagcaggaaatggcaggtgatacgtgacctggtttggcggctcgagctggtgcttccactcctgctccctcctcccgggcacctgaggccctcacggcttagcaagtgtggcaggtggagcctgtccctgggcttgaggtccttgctggactccagctcctgccctccctctgcctcatgcaaagtcctaatcacagaatgttgggacccactagaaagcatcaaagaggtcctccagcaggtggggtggcaaggcagggccacacacagcatggcgggggaaccagggctgactcctagcccaccagccccacctttggagtggcttgggactgacaaaccgtgtctccatctccaaggccatctttgctccccaagaagcacagaagaaacccctccagcaggtctccttcagctaaaacccagcttagcaccaaaaacagggctccaggtcacagcaccagctgccagcctgtatcttcacttcttttcccatccacctgcctgggaggaattccgagaagaccaatgccagagaagcgaaaggtagccaggagctgggggaaggcttgcaggccatggtgtcaccatttattagctctgtgatcctgcataatttatcgaatctctttttaaaaatgtattattcatcttgttttttagagagacagggtcttgctatgttgcccagactggtctcaaactcctgggttcaagtgatcctcctactccggcctcctgagtagctgagattacaggcatatgccaccatgcctggctatctaacctctttgcctcagtttgcttgtctgtcaatgggcatgctaactcctgctcccaatgatcagcagtggggcttaaattcaagaatggcatggagaattaagcaaacagttgcttaattcatcaacatactttcctttcagggttgccttggagatgccaggacatctgtgaggatgtggcctgggtttcagtcctagagtcccagcgaggagagggacacatggaaaatgctcagcaaatgccaccaaggtttctgattatcaggcccagtgcgtcaccactggggcccttctctccaccagcactgtctgtcaatgagtaatgagggcccaagaggggctacacaaatacccttccagtccagcagacccaggagagtcagaggagagctggatcacaggtgccaggcaaagccaaggccaggatctgcccgaggaagaaaagaacgtgacccgtgaccctgggacctgggagggcagtgggcagaggcatcttcagtaatccgacaccacttgagaactgttcaacagcccctgggggactgagggggacacacagagcctgtgattcccaaaaacctcagtggggcagcaggaacgctggcctaggaatcagggcatggggaccctgccactttcctattccatgactctgagcaagtcacttcctctctgggccttggtttctccatctgtaaagtaggcacagtgtacgtctatggagatcacgctgtccacaacaaacttacaggcaaatggaaacccaggcaggaaggtgcttcaccaagacaaaagggccacagggtcttaccaaggccctgccaggctcagctctggccagattagccccgcaccttggaccaaggcccccacttctgccagcctcagactcctgtctgttaagactagtgccttgctccagctctgccacccacctgcacaccctcttgagcaaactctcctgggccccgccacaactcccacagggtgaggctgaaggggtatccagcagagaaacatccatgatctgttctagaagttccaggttccgcccaccaggaagagcagccacaggaaggcaacaatgtaaccctacacagacacaccacaaaaacagcaccaggaacagtatctgtggcactaactggactctaaacccggtacttcctttaagcctcacagaaaccctaggagggaggtgccagcatgtcaccatttaacagacggggaaactgaggcatcaagaggttaagatgtgtgccccaagtcagcaagcatcaagctggctgctttaaggttaaagcaaccttaaagggaatgttgacaatgatctcacattgccctaaatatatccacagtcctcaccaccacccgtggcccagatacaacgttgtaaggtgggctgcacgtgaccatgaggctttcagcgtgtggaggtcagctgggacagtcacatgcctctcctccaccctgcagtcaccactgagccatcatgagcaggcttgagcttttggcaaaaccagcatcttgaacttttctcccttcacaacacccagaaggttctctgttttcagctcccccatagtaccttcctaagacggccaactcaatgctttggaaaagcattcactcagcacactgtttcacttgctcctcaaggaggttgccccgggagaggctgggtattatacccagttcacaaatgggtaacctgaggctcaaaaacaaacacaaaggcccacttgacttccaaaggccacatgtctagattcctccctactgagggaaaggtgaaaaactcactggtttgttgtgggtgcaggtgtggcactcattccctcgggggagggcggacaacagtcccctggaggccttcagtgaagcagataaagggagagcaggcgggaattgctgacaagggtagcatcgattgtcaccaacagcaactggcccagattccaccctctgtaacatgcctggttttaaggccacatgaaagccagtgttctctccagcacattgtgctctttatagaacagatttttaaaaggagggaaaaaatcaacatgtgctgtggctgtttgctgtagcaacttccccagaaaattgccgagaacagcaccatttctgcctgaacctcaaggaaaaccaccttgagataggccctggatagccctgccttactgtggatacaatcctttgtcatttctttgcccaaagagattttgaagtcaagctacaaagcagttcatgggctctcttggtgttttctggcccttctgaaactcaaggccctggggagggtgaggaagttggcagtcttcacgaactgtctttcttaactaatcaactcagcaaacaatatgggtggattcactggaccttcaagaaagttccctagtttagaggttagggaactgtatcagagcaatcagaatcaaggaaacagtacaaatgtcagagaacaaaaccacagtaggaactcctcgagggcccctgtactttgcagtggagcctgaaacccaggaggcatcagtgatgtttgatattcaaggaatgaaaaagggatcactaagaaggtgaaccccactgtctccctctcaaacaagccaaagccgcattcactccctgggtgtgggtccagaggggctggagctgaaactgaactgctgtgtgttcaacttgagcacagcaccagggaggtcagcaagagtgtcccaaacacaacagcaggaagagggaggtgtcaggaatctcgtcagggcccacctcttttctgcaatacaaccgagatcttcctggagattctcagtggagttttggcagcacgagtaatttgtttggcagacagaagacgaccgtctgaggggacgaggtgaataactggaagtccaaaggaggacactggtctccttagaggattattttgtgaaattgcaagacaggcatgagctgcgctggatggtctgagataatttgtggaaatcacacaaacggagccagtgttagcagaggacgaggaaatggcttcctcatacagaaccctttgtcccgagatgggatgctagccacgctaacaggatccttccccagaatggtcttgcagtttccaccctccggaatgggcctccgatcttgtctatgcaagatggtccaagttacttccttaatcagtggagatgtcctttccaccaccactaacacaacacctactaaggacaggctctcaggtttcatgggagacatggacaggtcccaggaaggacccaacccagcctcccctccagcagaggacagccaaggaggcctttctggagaaaggaggagagttccatgattaaaaaggaggaaggagagatggtaagcattcccagctgagagaggccatagacccacctcttaaatggccctctcacatccatatttgaagagggttacttggaatcttcttaggttccgtgggggtggggcagagggtgaaggcaggagaacaaggtggagacctgggcccccacccacctctcttcaaacagaactctatgcagatttaaaatgtatagctgcagaaagtctccccacagatttaaagaaaggaaagattaaactgctggggagggcactcaaggcccccagactgttaaggagcctcactttctaccagctcagttgcaagaaaacccgctggactcaaaaggtcagagatggagcccaggcaggtagggcataggcaggtctgcaaacaatgttaggtgggaaagtcaaagatctgggtcaaagagacctgcttatggccccgattgtgtaatccattcccattctgtagtgctggggcttacgccccacccgagggagcccaggtttcttttcacatggcccccaccccgagaacacggctccaggttggcacctactcatggccctctacctctgcagccgccttcctgtggggcctcagtgtccccagcccttctgcctacctgcctgggctaagttctcagccaagaccgctatctagcctgcctctatctccaagttgaaagataaaaagcaagtggacacgcggtacttccatcacacagccatcaagggaggcaggaacaacagcctggggtggatccaggaaacaagctccttctcaaaaggtgggcccagagggtgtgggtggcctccaagcgcaatgttggagggtggaaagggctcaggaggctcaccttgggcagaaccccactcactggactctggacagaagagtcaccagcctgagcctcaattttctgacctgagaggtggaaagaatgtcttctacctcagttagctgatgtgatgcattgaacctccaaggcactatagcaaacaagagctatttactgagcactcactaattccctggcactgtggacacagggtggcctgaaggtacagcggcatgtatgactacaccttccttcttctctcccctgtcattccagagcagaggttctcaactctgtctgcctgcaggataccccattcccaacccagccaaaggagctttgaaacaacagcatatcccctgatggagagagaatcgcaggagaccgggcctggaaatgtgcatttcagacaagattttcatgacactattatgcaacctacataagcttagcaaaaagcaatacctaggtcaagcatttgcaggcactttcacagccttgggtaggtttaggacaaagggtcccagactctgcctgccaagaagatgccttgagaatgtcttctgcgggtgctactgacggcaaacacctacacgctgttttccacatgctcagtgctgttctcaggttacacagattaatatttacacattctgatggcatcatgtctgttactctcattttacagaaaagcaaactgaggcatggagctcctgactgccttttcatttgagcctgatttcttcaggcgccccaacatgttgtcatggaaaaaaaacaaaggctctgaagtccaactgtccgggttcaaagtctggctctcccacctgagccatatggcaacaggcaaatcctgaaactctcctggcctcagttgcctcatccattcaatggagcaatacgatccaggcaacgttcttgcgaggatgaaggcagatggagggagacagtggctgctctggagggagagagatgtcgtgtccctccctggccttccttccaggctgagtcaaacctgaaccctgcttgagtctcagatgctgagtcatcacgctttctctcccaggacaaggcctctgagtcacatctggaatgggattctctggggttgggtcccaaggaagaactgcagctttgggccacccgaaaaacacaatgctatctttctttcaggtccatgaggaggcaagttcaggccagcggatttcaacgtaacccaggggggccctcagctcagttgagatctgtcttctgtcatggggggggggcagccccattcagtcaaaggccaactcagggggctgcagcctctaagcccctgcccttcaggctggctttgctaatctctcaagaacacctgatttacacttaaaaaaaatcattccgctctgcccctttggcctcaaaagtttcctcaccagaaattcaatgaagatgcaatttcctttcgcccctccatagcaggcaggcaaaatcctgccaggaaccctttccactgccttcagtcccacccaggagcctctcacaaagctgagctccagctcagttcggcctgggcacatccctccccatccctgtgcctcattttccatctgtaaaatggaaagaagttggactaggtaggtcctgtgtgagttttttattccattccaaatgatcaaactttgttgctccaaaagaacttcctcacaagagacccaaacagacactccaggatccctcaaaagcaaaagccaacacctccacccatgcacagtctattacctcgcccgaaactcaacctgctggttcacaggagaatggggcagaagacccagagccatccacttcatcccatgtgcatatttcaactcctcccacctgccaggcgctgggccaggggccaggttacagggcagggcaggcaaatcctcctccttgcccagatgcagtgggagacacggtcccacaaagctaagaagtcacaggtcaggggaacacccagttttccatccacaccaaaaccctctctctcccttacaccttccttcatccccgacactgtgccaccccagcctggggctggctctgccgccacacacaccacacagaaccggtctgcgtctccagccgtgtgtcttccccaccagaaggcagcccttccaagaaaggcgctggggtttgccccctctgtaccttgcttatttcaatcacatttgtgaaactcaataagaacgccagaatttctcaacaggaagagtctagactgaaaaattcgccttgaaactacatttctgcagcaagaacagggggtttgtatttagatatgttcttttgaggcagcttaggagaaggtcccgtgcagctgatgggtattataaggatgtctaccgccctcctgcctggccactggctgacttctgaatattagatatttcccagtagcttaaagaaaccaaacaaactgaagtgcccccagcgtccgtgaggaaggggtgttcttggatgggcataagataaccaagggccctgcctcccccacccactgccaggcatctcccacttccaagccacagaggcgtgctgttcaggacccccagggacagcagggacaacaggcgggggatatgggggaggggtgggtaaggaaccgacccactaaatcccagctccagctactaatttgacagaggcgtgacagcgtgtttcccccagaaccagccgcattccccaagcccagcccgaaatctcctcccgaggctgaatcagagaccgcggcggatcccccaggaacgtcgaagtaattccagctgttttcccccgtggagggcaggagcggccagcaccagaggcaggggaggggaggaaagcgggggagggtgggcggaggcgaaaatgacgccactcctagctccagccagctcaaggggccgccaaatgtccgcgagacccctctcgcccaggtcacttctcccacgccgccgatgcgccaatcccgggttcctccgggggcgcaccctgcccagtggcgctcgcagacacttgctccggctcgcgtgttgcactgtgacacaccctggaccctccccccacacacacgcttacactcacacatgcacaccgccctgtgtgtgctacgggactgaagcgccaccagcctctcggatccacacccgttcccgacccagtctgcaagccagacacacccacgcccccctctccagcctccttgccagcgccactcacctctaccaacccctcatctacacactcgcgcgcaatctctccgttcccagacacagacacacacacacacacacacacacacacacacacacactcacctagtcccttctgcacccacgtccagcgcgcacccctgccagcggcgccagctgggattcggagacgacgccaggaaacgctatcctggtattttttcggaccgtctcatcgcccccttcccgacctccagaaccccaatccccagctaggggggagatgaatgggaccctgtctttttttcctccctttccgtaattgaaccccccacttcagcggtgtctgcacccaaagccccctcgcgcccgcgccccggggtgaccgcgcacttgcagctccggggcgcttactcctggagtacgcggggctacaaagggcggtcctggcgctccagcggcaccgcacgggcggcccctttctgctccgcgtcgcgcctgggagaagagggcgcgggcttacctaacgcgagggagaaaggaaaggacggtgccgaggctggcggcccagcgccccgcggaagccgagggcggatggtgaactgacgagcttcagcaccagctgggagccaggcgaggtttgtttacgtccgggcggagggcgactttataggcgccgcggccccgcccccgc

SEQ ID NO: 1694 - DNA, 60135 bp, Homo sapiens; identical to SEQ ID NO: 1693

SEQ ID NO: 1695 - DNA, 60135 bp, Homo sapiens; identical to SEQ ID NO: 1693

SEQ ID NO: 1696 - DNA, 60135 bp, Homo sapiens; identical to SEQ ID NO: 1693

SEQ ID NO: 1697 - DNA, 63274 bp, Homo sapiens
ccctccgaagctctgtggtccgatctgcggtccgcttgctttccctgcccggtcccgagcgctcagcctgaagcgccgctttcgagggcaccctgcatacactggccgcgcctcagggatctcattgcccgcgctttctcattgcctctttccgtgttcgattcggctgatctgggcccagcctccgctcccgctctctgtcggtgggcgcgggggaatccgaaacggctcagcagaatcccagcagcttgctgctactggagcgggccgcctccatggcctccaggcaggccgggctggaccgcgtgaggtcctaggagacgggattccgggaagcggggagtatggtgggggtcctggccatggcggctgcagctgctccgcctcccgtgaaggactgcgagattgaggtgaggttgagtcgaggatctgttgagttccttcctctatcttttgggggattggaaggtgggtcttggcggaaggtgatcctgactttgtaaggggaaaggtgggacattgtgaggacccacagctgtgacacattgtgtgcaacagttgccagagtgtgtcgtttagagtcgtgtcaagtcctgataaacatttggattctgagatatttgcggggtcacagtaaattggggacttaagataacacggccagttcccagatcccgaaatgttggtggaacgtgatgttttggacttccgacatgtcacagaggatcccagggtcaagttctgggttcgtgatacggaatcactgaactttagcgctgaagaagatctttaagttaaactagttcatacatccacctgtgcttggaatgccactttagaatgtcactacagaaatcaagcaaggtacttaaagaaaacagtttctcatggcttagtatctgcggttaggaatcgcagtgtaacatgttcttttgggtttatcaggtttcagtgacaggcactaagcggtcattataaagagattctaatgccatgaagtagtgggctagcatcttaaggtagacttgttatattttacaccttttcatctcagactagcattctaactgaagcatgtatcttggcgtccttgaagagagttaagatgtatgtatgttcatttaactgcgaccagttgtttttttcagaatctggtgacttgtctacttagtttttgtttttgtttttttttgtctacttagttgttatgctgatattcctttgctaaatcaaggcagttagttactcagcttgtcttctggtacttgatgtacacagttcttgatttctatgtggtctgttttatcaatctttccgttacagtttctggttttggtgccctaatgctaagaaaccctatttcataataatgatacttaccatttaatatgttaggggtaagaaccttaaacacattattttgcttaatagcaaccctatgatctattgtctgtattctacaaatgaaagaaggtaaaaagtagctaaaagtaagttaaattttttgaaaaattaaatggaaaagttaaaagtaatttgcttaacgttttacaccagtaaatgtcagagccagcatttaacttagatttgcctgactccagagcctatgtatgttgcctttgatacaattgcagctttataaataataactgaatggcgtttttctaatacatgtatggtttctttttgttttttgagacaaggtcttgctctgtcacccaggctggagtgcagtggcacaatcttggctcactgcaacctccgcctcccaggttcaagtgattctcctgcctcagcctccggagtagctgggattacaggcgtgcaccactatgctcagctaattttttgtatttttagtagagacagggtttcaccacgttggccaggctggtctcgaattcctgacctcaagtgatccacccgccttggcctcctgaagtactgggattacaggcgtgagccaccgcacctggcctggtttaactttaaagcctattttctttctaatatatcacgtttttcacctaaaggaggcttcctttttttaatcctattatgtaaactattagatccatgtttaaaatttatattttgtattatattgcttgaaataagtgcctttttctcttttaaattgccagccatgcaaaaagcgaaagaaagatgatgacacatctacctgcaaaacaattacaaaatatttatcaccactagggaagactagagacagggtttttgctccaccaaaacctagtaatattctggattattttagaaagacttcacccacaaatgagaagacacaattagggaaagagtgcaagataaagtcacctgaatcagtacctgttgacagcaacaaagactgtacgacacctttggaaatgttctcaaatgtagagtttaagaagaaaagaaagagggttaatttatctcatcaactaaataatattaaaactgaaaatgaagctccaattgaaattagtagcgacgatagcaaagaagactatagtttaaataatgattttgtggaaagtagtacttctgttttacgttacaagaaacaagtagaggtacttgcagaaaacattcaagatacaaaaagtcaaccaaatactatgacctccctgcaaaattctaaaaaagtaaatcctaaacaagggaccacaaaaaatgacttcaaaaagttgagaaaaaggaaatgcagagatgtagtagatctatctgaaagcttacccttggcagaggaactaaatttgcttaaaaaagatggtaaagatactaaacagatggagaatactacaagccatgcaaactctagagataacgtaactgaagcagcccagttaaatgatagtataataactgtctcatatgaggaatttttaaaaagtcacaaggaaaataaagtggaagagataccagactctacaatgtcaatttgtgttccttctgaaactgtcgacgaaatagtcaaaagtggttatataagtgaatcagaaaactccgaaatttcccagcaggtacgctttaagacagttactgttcttgcacaggttcaccctattccgcccaaaaagacagggaaaataccccgaattttcttgaaacaaaagcaatttgaaatggaaaatagtttatctgatcctgagaatgaacagacagttcagaaaagaaaatctaatgttgttatacaggaggaagaattagaattggctgttttggaagctggaagttctgaagctgtgaaaccaaaatgcactctagaagaaagacagcaatttatgaaagcatttaggcagccagcatcagatgcacttaaaaatggagttaaaaagtcttctgataagcagaaagaccttaatgaaaaatgtctatatgaagtaggaagagatgataattctaaaaaaatcatggaaaattctggtatccaaatggtttcaaaaaatggcaatttacagttacacactgataaaggaagttttctgaaggagaaaaataaaaagctaaagaagaagaataagaaaacattagatactggggctattccaggcaaaaacagagagggaaacactcaaaagaaagaaacaacctttttcttaaaagagaaacaatatcaaaatagaatgagtttaagacaaaggaaaacagagtttttcaaaagcagcactttatttaacaatgaaagtcttgtttatgaagatatagcaaatgatgaccttctaaaggtttcctctctgtgtaacaataataaattgtcaagaaaaaccagcataccagttaaagatattaagcttacacagtctaaagctgaatctgaagccagcttgctaaatgtttccacgcccaagtcaactagaagatctggaagaattagcagcacacctactacagaaaccattagaggtattgattctgacgatgtacaagataatagtcaactaaaggcttccactcaaaaagcagccaacttatcggaaaagcacagcttatatacagcagaattaataacagtaccctttgattcagagagccctattaggtaaggtttgtttttgttctaacgttctagtattctgcatgtattattagctggggacaaaaatgcttcaagtattggagggtatttttttttctagaacacagctgtttaaaagaaaaagaacaggatttcttttttttttttctttgagatggagtcttgctgtgtcgcccaggctggagtgcagtggggcaatctcggctcactgcaacctccacctcccaggttcaagcaattctcctgccttagcctcccaagtagctgggactacaggcacccgccaccacgcccagctaatttttgtatttttagtagacatggggtttcaccgtgttggtcaggctggtcttgaacccctgacctcaagcaatccacccacccggcctcccaaagtgctgggattatagtcgtgagccactgcgcccggcctggaagaaaaagaacagagcttcaaaaatgcttctttgtttgccacatgtaattaaattttttttttaattttaatttttaatttaatttaattttattttattttgagatggagtctcactcactgttgtccagtctggagtgcagtagcacaatctcagctcacgacaacctccaccttctgggttcaagtgattctcgtgcctcagcctcctgagtagctgggattacaggtgcgtgccaccatacccggctgatctttgtatttttagtagagacggggttttaccatgttggccaggccagtctcgaactcctgacctcaagtgatctgcctgcctcggcctcccaaagtactgggtttacaggtgtgagccaccacacccggcaagtttgattacttttgaatcagtggtttgaaactgatgggaattatttttttcctcctgtttcagaacattccagaaattggagccctagttggttctttgctgtctatctatctgtctatgcatctctatctatctctctggaaacaagttctcactgtgttgcccaggctggtcttgaactcctggggtcaagcaatccttccatattagggtcctgagtagctgggattacatgcagatgccactgcaccagctctattttatctatatttaattgagattcttgtgtatgttataatcatgaaaatgtttctgaataccttatttttatttcagaatgaaattcaccagaattagtactcccaaaaaatctaagaaaaaatctaacaaaagatctgagaaatctgaagcaactgatggaggttttacttctcagattagaaaggtaattaaaatattagagagtcctataagtgccattctgtttccttaaaaaacaaacaaaaaacccccacattactatgggaagtaatgagccaaaataaaattcatgtatttcataaattggttaactacaaccctatgatatttttcactattatcctgttcctctagttaattaagatatcttattgtgaggtgaaagcaattgataaaggcagagtataatttacttataaaaagctttcttagtgagtttacatcgtgatcatttttcctaacactgccgatcttagtttgggctcctgtagcaaattaccatagactgagtggcttaaacaacagaaacatatttctcacagttatggggattgagaaatgcacgatcaaagcatcagctatgcagtgtctggtgaagctgtcttcttgttttctcacatggtagagaacagctagagagaggggtctccaccctcatgacctaatcacctcctaaaggccctacctcctaataccattacatagtgggttaggattccaacatatgaattttcaggggatgtattcagtctgtaacactgcctataggtcatgattgaatttttcatttatttctatagattatagagactgaaaagcagagtttctcaaccttgctattattgacattttggctggataattctttactgtggagggctgtcctgtgcattgtaggatgtttagcaacactctggcctctatccataagatgccagtagcacccaactaactcctgtataatgacaaccaaaaatgtgtccagacattgctaaatatccctcggaggggaaaataatcacttccacttgaaaaactacagctctaaagggagaagtaagatacataagaatggtttagttgtttcggcaaaataagctccttgtccccaccatggcagaattggagtaggtacaggtatgtgtatttcgaaaaagccaccaaggtgactctgaattaatccttgagtgaaaaccactgctacattggtatctcctttggttttatttaacagctgtcattttttggcatcttaccacattctaggcagtgtgcttagtactcacatcattaatctcataaagtaaatattatttaacccttttttatagatgaagaaacttgctgttagttcatagggtgaggaaacgtgtttttatttgtgattctgggaagtgtctttcctagagttatacaactacaagcagttagaaagacggtctttagtcttttggaaaacatgcgagatgccagctgattgtactacagctaaaggttgaaagtctctttggtgaactttgtcccacatattttattcttcttgatttcattctagaggacagcttcaactttaatttttttagagataattataccttggtttgcctcatgtactacttaaaattgggatttaatagtaaattttccagcaagagaagtctcaaaattaaatgtatccaaattgggacctttatccaaacttacttagatcagttattttatctcatactctgtcaatggacttcttaccacagggcccttgttgttcactgaagacttatccagccttgtgtactagctctaggagaaaatcttagtaattttctgggtgagatttttcttttttatttcttttttcttttcgtttgttatttttgtagagacagggtcttgctattttgcccaggctggtctcgaactgctagcctcaagcaatcctccagccttggactcccacagtgctgtgctggttggtattcaggcatgagccactgtgcctggccagatttttaatgtttctatgagaataaggagtaaactggttcccctaagagccccatattcataacagcttattgtttatcctttcagataatagtttaatagttagatttttttctctccagatattttttctctgcttaaatagatatatcttttttttttttctttttgagacggagtcttgctgtgttgcccaggctggagtgcagtggcacggtctcggctcactgcactctgcttcacgccattctcctgccttagcctcctgagtagctgggactacaggcacccgcctccatgcccagctaatttttgtatttttagtagagatggggtttcaccgtgttagccaggatggtctccatctcctgaccttgtgatctgcccacctcggcctcccaaagtgctgggattacaggcgtgagacactgcacccggccatcttcttttttttttttttttgagatggagtttccctcttgttgcccaggctggagtgcaatggcgcgattttggctcactgcaacctcggcttcctgggttcaagcggattctcctgcctcagccgccccaagtcgttgggattacagacgcccgccaccaagcccagctaatttttgttatttttagtagagacgggggtttcgccatgttgacccagggatgtctggaactcctgacttcaggtgatccacccacctcggcctcccaaagtgctggaattagaggcatgagccactgtgtccagactctttcttctttatcatatataagaagcttgaggctgggtgtggtggctcacgcctgtaatcccagcactttgggaggctaaggcaggcagatcacctgaggtcaggagtttgagaccagcctggccaacatggcgaaccccatctctactaaaaatacgaaaattagctgggtgtggtggtgtgcacctgtagtcccagctacttgggaggctgaggcaggagaatcacttgaactcgggaggcagaggttgcactgagccgagatcatgccactgcactctagccttggcagcagagctagactctgttaaaaaaaaaaaaaaaaaaaaaaaacaaccttgaggccaaggtccatgtattataatactgttttctttatagtatccagcctagagccattcatatagtaggctgggtaactgtttggatttggaaagtactttgcctgaatttggtgactaaaattaaaaaatagattgccaagtctatactacagacatcctcttgggtgttttgctcacatgtaaatatatttacctggatgatttcaagtaagaaataaaggcaaactaatgataactagacacatttcaatttaaggcccctggtaagatttgaataaccatttctttgttgattatttaatgtgatttgtgattgtatttttttctattattaaatataaaatattttcttgtgatgtaaattaatgtttcaattttttgtttaggcaagcaatacttcaaaaaacatatcaaaagcaaaacaattgattgaaaaagcaaaagctttacacatcagtaggtcaaaggtgactgaagaaatagcgatacccttaaggcgctcctctagacatcagacacttcctgaaaggaagaaattgtcagaaacagaagtaagtattataaatatctgttggtataaattctctcctattttgctgtttggagtgggagaaggaaaccattataaagttataaggtaggtttgtgtgatagcttgaagtggtagagagaatatcattttcagttttgctttaaaagccttctgcttttttttgtctgcagaatacagtttgaatccttcttaagtcactcaagatctttcataagctgaactacctcttccttttttttttttgagacagagtttcgctcttgttgcccaggcgagagtgcaatggctggatctcggctcactgcaacttctgcctcctgggttcgagcgattctcctgcctcggcctcccaagtagctgagattacgagtgtgtaccaccatgcccggccagttttgtatttttggtagagacagggtttcacagtgattggccaggctggttttgaactcctgacctcaggtgatccacctgccttggcctactagggtgccagccctcttgcctttcttcaaaacgactctttgctctagtcacacagaattgttcatttctccctaaatggtgcagttttcacggtatttgttttattgttatcagcttgaaatatacgttccaagtactctcttctatgtgaggaattcctacttaaactttgagatcctgctaactgccagtacctctttctaataaaatagtttgagatataattcatatacatgcatttcaccatttaaagtgtacaattcagtgacttttgtatattggaagagttgtgcatccattaccgtagtcaattttggaacattttcatttccccaaaaatagactcttttcttcttggttgtcaccccccaatcccctcattccaccagccatagctaactactaacctgcttctgtctctgtagatttgcttgttctggacatttcatatcaatggtatcatatagcatgtggttttttgtgtctggcttctattacttaggatgtgttttcaagatttatgttacagcctcagtatttcttttctttctgttgccaaatatcccattcatcacctgatggacatttgggttgttttcactttttggctattctgaacattttaccccctcctcttcaaagctgtgcttgtattcaagactcttctggttgaatatataaaaagaaaaataaaaacaaattaaaaaaataaaataatgggatgggcacagtggctcacacctgtaatcccagcactttgagaggctgaggcgggaggatcacgaggtcaggagtttgagaccagtctgaccaacatggtgaaaccccgtctttactaaaaatacaaacattagccgggcatggtggcgcgagcccgtaatctcagctactcaggaggctgaggcagaagaatcacttgaacccgggaggcggaggttgcagtgagctgagaccacaccattgccttccagcctgggtaacagagtgagactccatctcaaaaataaataaataaataaataaataaataataaataaaataaaatagtgaaaataatgaatactgtgcttgctgatgccttcaagacaaatattttctttcctgatatgtacttttgtatatttttttgtgttgatggtgcactcaccatgctgtattataactagttaaactatctgctcatgggctagctctccctctctcccctacattcagatgtaacatttgatgccaattcttgaattttgtctgtgtattcccaatttcttctatattgcttcacatatggtaagtgctcggtaaatctatgctgatgacaggaaaatcacagacttcattacatttctaggatgtacagttccaacagggctataaccagactttttatagcttggtcatattgactgttttatttggagtacagtctgttagttgctttttaaaaattttctgcatatgaataccaggtcatatgttagttgctttattttttagacagagttttgctcttgttgcccaggctagagttaatggcgcgatctcagctcactgaaacctccacttcctgggttcaagcgattctcctgcctcagcctctcgagtagctgggattacaggcatgcaccatcacacctggctaattttgtatttttagtagagacggggtttctccatgtttctcaggctggtcttgaactcctgacctcaggtaatcccccctgccttggcctccccaagtgctgagattacaggcgtgaaccaccgtccggcattagttgctttttcaaaaaagaaagcctttttgggcctggtggctcacgcctgtaatcccagcactttgggaggccaaggtgggaggattgcctgagcccaggagttcgagaccagcctggtcaacatagggagaacctggctctgcaaagaacacaaaaattagccaggtgtggtggtgtgcgcctgtagtcctggcttcttgggcagctgaggtgggaggatggcttgaggtcgggagtttgaggctgcagtgagccatgatcatgttactgcactccaccttgggtggcagagtgagaccctgtcacaatttaaaaaaacacatgaggccaggtgcggtggctcactcctgtaatccccgcactttgagaggctgaggcaggcggatcacctgtcaggagttcgagaccagcctggccaacatggcgaaaccccatgtctactaaaaatacaaaaattagctgggcgtggtggcgcgcacctccaatcccagctacttgggaggctgaggcaggagaatcacttgaacacgggaggcggaggttgcagtgagccaagagtacaccactgcactccagcctgggcgacagagagagactccatttcaaaaaaaaaaaaagaataaaaataaaaaagaaagcccatggtcataataaacgtaccctgatatcatataaacttgtttgatgtaagcatggactcctgctattctattgtgtgttttctgtttcaatgagataatatctgatgggaggtgtatggagctgctaattatgttttctgtggtttctatcactgtgattcttttgaaatttcaatgatattaattatatgatttaattaaaatttattctcttattttgtcttaggattctgttataataatagattcaagtcctactgctttaaagcatccagagaaaaatcagaagaaacttcagtgtttgaatgatgtgctaggaaaaaaacttaacacatccactaaaaatgtacctggtaatcagagttaataatatttatgatgtatattagaatgttttggggtttttgttttgttttgtttttgtgttctggggtatttatttatttatttatttatttttgagacggagtctcgctttgtcactcaggctggagtgcagcgccggcgggatctcggctcactgcagcctccacctcctaagttcaagtgattctcctgcctcagcctcctgagtagctgggactacaggcacccaccaccatgcccggctaattttttgtatttttagtagagacggggtttcaccatgttagccaggctggtctcgaactcctgaccttgtgatctgcctgtcttggcttcccaaagtgctgggattacaggcatgagccactgcacccggcctgtgttttggggtattattctgaacgtgcttatgattgaaatttagtatcttatgtaaaattttaactgtattatatttctattttagtaagtaaagttatggtatagtgaagagtttttctttttttttttttgtgacagagtcttgctctactaaaatacaaaaaattagctgggtgtggtggtaggtacccgtagttccagctactcgggaggctgaggcatgagaatcacttgagccctggaggtggaggttgcagtgagccaagatcgtggcactgcactccagcttgggctacagagtgagactccatctcaaaaaaaaaaaaaaaaaaaaaaaaagaaagtagctgaaggtggagatggtaaacattgatactaacccaagtatttatttttctaaggaaaaatgaaagtcgctcctttatttcttgtcagaaaagcacaaaaagcagctgatcctgtccctagttttgatgaaagcaggtcagtccaatacaaatttttaaatgccaaaatattttatagaatgtatttgtattgatgtgtttactttgatgagaaagcatgtgaattatcatttgaagctctagtaagtccagtttcaaagttgacaatattgacagtgctgcaactgctatttgaatatcttggttttttgcaagtgctttggccatcgctagacaaaacagaaaaataagcaaaccaaaaatacaaaaaagctgataatgaattttattcagtaaatatttaaatacctactagtatgtaccaggtactgtttttggtatcagagatattatggggataagacaggacacattccctgtcctcctgtggcttaagtggagatggaagatggtctatgattaaacattcattgggtcaacaaatgaaaaattgcagttgtgctaaggagaggtataattcatattgaggagggttggtctgattaaagaagacttcaatgaggaaatgatgtctgaactgaaatctgagggatgagcaggagttcatcaggaggaggaactgtgtttcagccagagagaactgtctatgtaaagtctctgtagctggaaggaacttgctaaataccaaaaactgatagaatgctagtgtgactagagcacagagaacaagggtgagaggtgggtgccagccaatgtaggacctaggaggccatgttaagggattttatcattatattaagagcaaataagaagcagccaaagggttttaaacataaatatagacctaaacagatttggattttagaagtttaattggcctgctggataaagaatggaatggaagaggggttagagtagatgtaggagtccaggtattgtgagatgatggaggtaaggactaggttgttgggaatgacatatgaaaagattttaggagatgaattaaaaatccctcgatgattaatgagatttgtgggagtgagagtgtgggagaggaaggtataggatgacatgtaagttctagtttatgcgcctgggtggcatgatggaaggtcaggtctaggagcaacatgggtttagattatctttttttctgttcaagttttactgaggtgtaattatatattgttaagcacacatatcttaagtatgcagttttgacaagtgcatcttatcaagaaataacaatcttctttttagctcagaaaggttttgtgtgctctttcctattatccccaccaccaccatcaccacaagattaccaaaatattcgatttctatttccatcaattagtttgatttctattaccatagattaattgtgtctattctagaacatcacataaacttcatatatatattattttgtgtctggctgcttttgcatagtatacacgcccacaaacaaatgcacacatacatatttttaaatcaacttcattcagttatattgtccatataataatatgtgcccattttaagtaaagagtttgaggtttttttttttttcttttttttttttagacggagtctcactctgtcactaggctggagtgcagtggcgtgatctcggctcactgcaacctctgcctcccgggttcaagcgattctcctgtcttagcctcctgagtagctgggactacaggcacgcaccaccatgcccagctaatttttgtatttttagtagagatggggtttcaccatgttggccaggattgtctcgatctcttgaccttgtgatccgcctgccttggcctcccaaagtgctgggattataggcgtgagccaccgtgtccagccaacagtttgaatttttctctcttttttttttttttttgagacggagtttcgctcttgttgcccaggctggagtgcgatggtgtgatatcagctcaccgcaacctccacctcccaggttcaagtgattcttctgcctcagcttcccgagtagctgggattacaggcatgtgccaccacgcctggctaattttgtattttagtagagatggggtttttccatgttggtcgggctggtctctaactcctgacctcaggtgatctggccccctcagcctcccatagtgctgggattacaggtatgagccaccgtgcctggcccacagtttgagttttgacaaatgtacatacctgtaattaccaccacaataaaaatatagaacattttcatcactctcaaaaaaaagtcttcttgtgcctcattgcagttaatttctgcccaatcccatgcaatctcttatctgctttctgttggtatagactagtttgccttttctagactctcatataaatgaaatcctgcagtaggtatacttttgtctctagtttctttggcaaggtagcatatcagttgtctgttctttttcgtagttaagtagtactcatatgaatatgccgctatatatatatagagagagagagagagagagagagatggagtcttgcactgtcgcccaggctggagtgcagtggcgcgatgtccgctcactgtaacctccgcttcctgggttcaagcgattctcctgcctcagactcccgagtagctgggattacaggcatccgccaccacgcctggctaattttttgtatttttagtagaaacggggtttcactatgttggccaggctggtcttgaactcctgacctcgtgatccgcctgcctcggcctcccaaagtgctgagattacaggcatgagccactgtgcctggcctactgcaatattttttatttattctttattaatgggcatttgggttattttcagtatttggctattattaaatagactgctatgaacattttttttttttttttttttgagacagagtctcactctgtcgcccaggctggagtgcagtggcacagtctaggctcactgtaacctccgccccccgggtttatgccattctcctgcctcagcctcccgagtagctgggactgcaggcgcctgtcaccacgcctggctaatttttttgtatttttagtagagatggggtttcaccatgttagccaggatggtctcgatctcctgacctcatgatccacccacctcggcctcccaaagtgctgggattacaagcgcgagccaccgcgctccgcctgactgctatgaacattcttatacacatgtatggacaagtgttctcatttttcttgggtaaataaatacctagaagtggaattgctctgtcattagggaggtacatgtttaacattataagaacctggcaaactgttgtcccaagttgttgttcggttttacactcccaccagcaatgtataagcgttctggtagctgcctatctttgataacacttggcattatcaggcttttttttttttgagacggagtctcactctgtcatccccagactggagtatagtggcgcaattacagcttactgtagccgtgacctccaagggtcaggtgatcgtccctcccacctcagcctcccaagtagctgggactacaggcatgtgccaccatgccccactaattttttgtatttttttttctttggtagagacagggttttgccatgttgcccaggctggtctcaaactcttggactcaggtgatctacccaccttggcctcccaaagtgttgggattacaggcgtgagccacaaggcaaggtcaattctatcaattcaaagtgtgtattttggtgagctttgtcagttgtacacccagtgaaaccaccataatcaagataccaagttatttccattgcctgcctcagacttgtcatgctcttttgtagtctgttctctaagtggccccaacccaggcaaacgctagtctcttttctttatactaatttatattttctagaattttatattaatgaaatcatatagtatatgctcttttgtgtctggcttcttgtaggtggcatgatgattttgagatttattcatgttgtcaaatatatcattagttttctttttcttttctttttttgttttgagacagagtctcgctctgtcgcccagactggagtacagtggcatgatcttggctcactgcagtctccgccttccgggttcaagtgattcttgtgcatcagcctcctgagtagctgggacgacaggcctacgccaccatgctcggctaatttttgtattttttgtagaggcagggtttcaccatgttggccagactgatttcgaattcctgacctccagtgatctgcctgcctcggcctcccaaagtgctaggattacaggtgtgagccaccgtgcctggctatatttttgctcagtagtattcattgtatggatataccactttttgtctctccatacacctattaatggacatctggattgtttccttttgtcttttccctccactataagagatggagtcttgctgtgtttctcagcctggccttgaactcctgggctcaagcaatcttccttcctcagtctcctgagcagctgggactcaaacgtgcaccgctgcacccagctgtttgcaatttgaagctattgggaataaagctgctatgaacattcatgtataagtctttgtgtggatatacatcttcatttctctttttaattttatatatttgaatggctatgtagtcatatctcatagttttaattttcatttttctcatgtctactgatggtgaacatcttgtgattattggccttttgtatgtcttccttagggaaatcttttgccccttttcttactgacttgtctttcttcttgttgagttgtgaggattctttatatattctgactacatgtcctctgtcagatacatgttttgcaaatatattaccttgcctttttatttgttgtgtcttttgaagtacagaagtttgatgacgtccagtttatgggtttgacaaacctaacatttaaaagacacaaagaacctagaatagacaagataatcttgaaaaagaagaaaaatttgaaggcctctacactacctgatttcaagacattgaacaaacctacagtaatagaagtgtgttgtattggtataagaacagaaaaataccagcctgggcaccactgtgggactccatctctttaaaaaagtaaacaactagccaggcatggtggtgtatgcctataggcccagctacttgggagtctgagacaggaggatcacatgagcctgggaggtcatggctgcagtgagctgtaatcatgccactgcactccagcttgggtaacagagcaagatgcggtcgctaaaaaaaaattttttttttgctcttcttcaaaatttgaaaatatataataaatttttgtttattatggtgaccatatagtactgtagaacactagaagttattcctcctatctagctatacttttatatctgttaaccaacctctggctatgtctccctctcccctcccctctcccacctctattaaccactattctactctctacttctatgagacttcttttttttttttttttaaaggcagcaacttgctctgttgcccaggctggagtgcagtggtgtgctcacagctcactgcagcctcaacctcctgggttcaagtgatcctgccatctcagcccctcaaatagctggaaccacagatgtgcaccaccatgtccagctaattgtttttttggtagagacaagttgttgctgtgttacccaggctaaggttaacttttttagtctccacataagagtgagaacatggggtatttatctttctgtgttcagcttatttcacttaacgtaatatcctccaagctctaagacatctcttactagaggtcctggatagttcaattaggaaagaagaatatataaaaggacataaaggtttggaaggggagaagtaaaactatccttatttgcaaatcatatattaaaaaatcattattttaaagaaattattatttatatttatatatttttatatatatatatatatatatatatatatatatatatttttttttttttttttttttttttttttttttgagatagagtcttgctctgtcagccaggctggagtgcagtggcacgatctcgactcactgcaacctctgcctcccaggctcaagcaattctcctgcctcagcatcccgagtagctgggattacaggggtgtgccaccacaccccgctaatttttttttgtatttttagtagagatggggtttcaccatgttggccaggctggtcttgaactcctgacctcaggtaatccacctgcctcggcctcccaaagtgctgggattataggcgtgagccaccgtgccggtctctaaaaatatatatttaaaaattctgagctgggtgcggtggctcacatctataatcccagcactttgggaggccaaggcgtgtggatcacgaggtcagcagatcaagaccatcctggctaacatggtgaaaccccatctctactaaaaatacaaaaaattagccaggcgtggtggcgggcgcctgtagtcccagctacttgggaggctgaggcaggagaatggcgtgaacctgggaggtggagcttacagtgagccgagatcccgccactgcactccagcctgggcaacagagcaagactctgtctcaaaaaaaaaaaaaaaaaatcctaagggtaggccaggcatagtggctcacacctgtaatcccaacactctgggaggccgagttgggcagattgcttgagagcaggaggtcaagggtcaagacaggaggactgctttggagtgcaatggcactatcttggctcactgcatcctccgcctcccgggttcaagtgattatcgtgccttagcctcccaagtagctgggattacaggtatgcaccaccacacctggctaatttttgtactcttagtagagacggggttttgccgtgttggccaggctgtctcaaactcctggtctcaagttatctgctcgcctcagccttctaaagtgctgggattacaggcatgagctatcttgcctggcctcttttgcttttttaaaaatagagactagatcttactattttgcccaggctggtcttgaactcctggctggggttacaaatgtgagccacccacctggccaaatgccaaaatcttgtttctcatcaaacctgcaattatgggccttaatattgacgaattccaatggaattaaccacatgatgatggtttccaaatggcaattctctattgcagtcattctttctttgttagttggctgctataagagcttttttgtctcctcagtttatctatttattcacttatttcttcatttttattatattcagtggattgtaatccattcatattagttattttgatgctcaaattgtttttaatttggccagtgtgagctcttcagcttggtttctatgtccctttgacatgtcctcataatttatggagcatttcttaatttctggaacaggaagatattctaggcttctattttacttgccttgtctcagctctgcagttagccatttctctgtggacccctggttccttttcgtggaggatggtatttagagacgaaggtctagcattaaattcattgctcctgatgtggcagtgcttctaggccttttcagtagataaagttaggatactgtgtttgtctgttttgcattcccataaacgaatacctaagactcggtaatttatagagaaaaagaggtttatttggctcacagctctgtagattgtacaagcatggttgtacagcatcggcttggctgttagtgaggcctcagtaatcttcaactcatggcagaaggtgaagggagagcaggcctgtcacatggcgagagaagtggcaagagagaggaggaggtaccagcctcttttaaacaaccatctctcgggtgaactaatagatggagaagttactcattactgtgaggacagcaccaatccgttcatgagggatctgcccccatgaccccaaacacctaggcctgcctccaacattggaggttatatttctttctttttttttttttttgagacagaatctccctctcttgaccaggctggagtgcaatggcatgatctcgactcactgcaacttccgcctcctaggttaaagcaattctccctgcctcagcctcccgagtagctgggattacaggcgcctgccaccacagccagctaatttttgtatttttagtagagatggggtttcgccatgttggcctggctggtcttgaactcctgacctcaggtgatctgtccatctcagcctcccaaagtgctgggattacaggcatgagccactgcgcctggcctgtatttcaatatgaaatttggaggggacacacatccaaaccataccagctatatatgtatgtatatgtgtacacacaaacatttaaaactatttatatgtgtgtaatatatgtatatgcatgtaatatatatgtaatatatgatacattatatataatatgtatattttttattagtaccttgtacccctctccttaacacctaccttctgctatagagacatactaatttaactacaactttacccatcttcctccttcccgccaattaacagttaaaaaaaatacacttcttcttttctaaaaaagaaaagagatatctcatttagtatctatctggcttcatagcttattttcccttcatttcactcaaagaggaaaagaaaacagaaatacagaaaaagtttttgtagtctcttttgaattaccagcccaaatatctaattgcacagaatattgtgagtcttgttctttctacaggcaggctaggaaggacatataagctgtgacacaccatcttccactactccaacctcccattctccccacccttttgcctctgtcccactcctgccactgtagtcagcctccctatgatttgcaatctgaagataaactgggcaaaactgagacaataataaggaccctactcttcctcctgttacattgggaacaatattacatcagaagttcttgtattaactttttgaaatatgacagtgattttttttttttctgattgtttagcaagaaaacaaaagacaagagggaaaaaactcacctaccacccaaagatagcccctgttaacattttggtggatgtcctttaagtcacttttttctatacatatttatttttatttaatttcttaacatgggtagactttcatttttgtgatgagcaaaaaagaatttgatcagctaatattttaggtaattttattacctaaatgtattaaataaattttaaaaattaatatttgtcaatatcttatataaaatctaaaacaaaatttttatataattatatataaattatataattatattttatagataaagctaatatttaagcattttatattaattacctaatatatattttatatttaggtaaatttattacctaaaatactaatttattgaatttatttaatacattttattaaattaatttaaattttttttttttttttttttgagatggagtctccctctttcacccaggctggagtgaagtggcatgatctcggctccctgtaacctctgccccctgggtttaagccattctcctgcctcagcatcctgagtaggtgggattacaggcacccgccaccatgcccggctaatttttgtatttttagtagagatggcgtttcgtcatgttggccaggctggtctcaaactcctgacctcaggtgatccaccctcctcggcctcccaaagtgctgggattacaggcgtgagccaccatgccctgccaatttatttaatttttaaaaattaaatttaaaggtgtttcttctcttttctggtttttgttttgttttgttttgttttgttttttgttattttttgagacagtctcactctgttgcccagactggaaggctagatagagtacagtggcgcgatcctgactcactgcaacctctgctttccaggctcaagtgattctcgtgcctcagccacccaagtagcttggattacaggcatttgccaccacacctggctaatttttgtatttttagtagagatggggtttcaccacgttgaccaggctggtctggaaatccttgccttaagtgatccgcccacctctgcctctcaaagtacttatattacaggcatgagccaccatgcccagccctaaaaatgtttattttccagatagtttattcctttaaatgtttataaccttagcttttctttttcaaatcattttcttaaaagtcaagatacatctgaaaaatctcaggattgtgatgttcaatgtaaagcaaagcgtgacttcctaatgagtggtttgccagatttgttgaaacggcaaattgcaaagaaagctgctgcgctggatgtgtacaatgcagtgagtaccagtttccagagagtcgtacatgtgcaacaaaaggatgatggtaagtttgttttttattattgaatatttactcttcagctgttagcaggaacattaaactatgtaagtttcttaaagatgaggctgaagtttaattatcattcttatggtgactttagtgggaattttaaggacaatttctctcactatccatggggtttgattccaggacccccttgtggatactagcactcatggatgctcaagtttcttgtataaaatggtgtaggctgggtgtggtgtctcatgcctgtaatcccagaactttgagaggacaatgcaggagaagagcttgagcccaggagttcgagaccagcctgggcaacacagcaagatcctgtctctaaactagctaactaacttaattaattaattaattaaaatttgctgggcatgacggtgtatgcctgtagtcccagctactcgggaggctgaggtgggaggatcacttgagcctaggaggtcaaggctgcagtgagccatgatcatgccactgcattccagcctaggtgacagagcgagaccctgtctcaaaaaaagaaaaaaaaaaaaaagtttagcctttcttctgtacgtgggaatttcccagctagtcttttcagtaatttattctactttttcttatttcccatctctgccactggccattcagttgatgaaggctttcttgttatttttactagtacagctttatatagcattttccaatagtatgttcaactgtagaaattagttatgcttttcttgactcattttgataaactcattttcacaggagtgctgccataaaacttagcatatctatttgtagatgagcagagaggcaagcacagagggaacctctctctcttacaaccttcagaattattgaacgcttactattgtctggaattctgctgagcaattcatatacatatctagtttaatcctgataacaactctaagaggttgagtattataattatcaccctcactttgaatgtaaggatgaagaaactaagatttaggatctcgccagtgctcacaaggttagtaagtggcagaggttgggtttgaatccaggtctaacttgaaagtttagactttagaccaggttgctaactgcctcttaaaaggtttttgtttgtttgtttgtttgttttgacagagtcttgctttgttgcccaggctggagtgcagtgatgagatctcagctcactgcaacctctgtctcctgggttcaagcaattctcttgcctcagcctcctgagtagctgggattgctggtctcgaactcctgacctcaagtgatccacctgccttggcctcccaaagtgctggaattacaggcgtgagccaccacgcctggccctcctaaaagttttaacctgagtatcaaggttgatttgaaaagaaaggaaagtttgttaatatttgtttgttttaaacaactggaagggaagtctaggtgatttttattaattctatttgttggagggtaggattttgttccctttatagtcatgtggtttttggtatgtttgtgttaattatgtagttgtcaacttttcatgtttacgtatttgacattcagtaaatggatagtgtataaataaggtttattaagatatttgtctatttttctttagggtgttgtttgtggcatttgaaaccaccctcttgtcctctcttaactaaatttaaagaactgaacactaaagtaatagatctctcaaaatgtggtattgctcttggtgaattttcaacattgaattcaaagttgaaaagcggtaactctgctgctgtggtaagtattaaatagttcatccattgtagagtgtttcccttacatcttgcagaggaaaaacatttttggatatctactcttatagcctcgagtgttgtcctagagtttaattttttttttttttgagacagagtctccctctgttgcccaggctggagtgcagtggtgcaatcttggctcactgcaacctctgcttcccgagttcaagcaattctgcctcagcctcccgagtagctgggactacaggcacacaccaccatgcccggctaatttttgtatttttagtagagacggaatttctccatgttggtcaggctggtcttgaactccctacttcaggtgattcccccgcctcggcctcacaaagtgctggggttacaggcgtaagccactgtacccagcctaatatttaaaaataaatcctaattgtagtacacatttcttttaaatacccatagagctttaaaaacattttaagaattaatgattgccagttctcaaagaatgttagattacatagcacatttagatactttataagtaggtcatataatctaatagatataattagttcaaagggagaaaaataaattaattcttcataagctttatatttagtgactaaagctattttttttttttttttgagttggagtctcaccctgttgcccaggctggagtacagtggcacgatctcggctcactgcaacctctgcctcccgggttcaagcgatcctcctgcctcagctccccctagtagctggaattacaggcacacgccaccatgcccagcaaatttttgtatttttagtagacacggggttttgccatgttggctaggctggtctcaaactcctaacttcagatgatccacctgtctcttggcctcccaaagtgctgggaatataggcgtgagccaccacgcccggcctaaagctaatcttacgttgatactgatttatgatggacagaaagtggttggtagtattgtaattaacatgaatagatgatgttggtctgttattgtgcattttattctttattgcagttcatgaggacaaggaaggaatttactgaagaagtaagaaatcttttgcttgaggaaattaggtggtcaaatcctgaattttcattgaaaaaatattttcccttactcctaaaaaaacaaattgagcaccaagtactttcttccgagtgtcatagtaaacaaggttagtgataattattatcatttatgttaacataccagttttgggtttttatattatttattattttatttttatttctgagacggagttttgctcttgtcgccctggctggagtgcagtggcacaaacctggctcactgcaacctctgcttcctgggttcaagtgattctcctgcctcagcctcctgagtagctgggattacaggcacccaccatgacgccctgctaatttttgtatttttagtagagatggggtttcaccatgttggccaggctcgtcttgaactcttgatctcaggtgatccatctacctcagccccccaaaatgctgggattacaggcatgagccactgcgcttggcctattttttctttttttttagagtgttgctctgtcacccaggctggaatgcagtggtgcaactttgcctcactgcaaccttcgcctcccgggctcaagtgattcctgtgtctcagcctcctgagtagctgggaccacaggcttgcgccactgcacctagcttattttattttttaatttttacttattctcttgagactgggttatgagactggctagtttttgtatttttggtagagaccaggtcttgccatgttgcccaggctggtcttgaactcctgggctcaagtgatcctttcgccttagcttcccaaagtgctgggattacaggcatgagtcaccacgcccagcctaacgtgtcagttttgaaaaacactaagacttaaccaatgacacttggaagtgttcaccacagacaacattgcttacacttggcagggagaattgttcagctgaagtaaaagtatcttgtacaatgcaatgtgcaacattaatccccgccagtttccaaaaatgccaactcaaagatagctttaattatgttaaaatattatgtacttaaggaatgccttagataattttagcttatatagcttgtataaaagacagtctaagtattaaaatctccagcttgctttcagtatgttatatttgattcttgcctttttattttattttattttatttattttttgagacagagtcttgctctgacacccaggctgaagtgcagtggcgcgatctcagctcagtgcaacctctgcctcccagatttgagtgattctggtgtctcagcctgcctagtagctgagattgcaggcacctgccaccatgcctttctaatttttgtattttttagtagagatggggtttcaccatgttggtcaggctggtctcgacctcctgacctcaagtgattcactcgcctcagcctcccaaattgctgggattataggcatgagccaccatacctggcctatttatttattttttaagagacacggtctcactttgttgcccaggctagaatacagtttgtttgtttgtttatttatttttattttttgagacggcgtcttgctctgccgcccaggcagtggtgtgatctcggctcactgcagcctcagccttctaggttccaccgattctcctgcttctgcctcctaggtagctgagattacaggcacacgccaccatgcctggctaatttttgtatttttagtagagatggggtttcaacatgttggccaggctggtcttgaactcctgacctcaggtgatccacccaccttggcctcccaaagtgctgggattacaggtgtgagccaccgcgcctggcctatttatttattttttaagagacagggtctcactttgtcgcccaggctagagtacagtggtgttttcatggctccctgcagcctcgatctcccgggttcatgtgatcctcccacctcagcctcccaagtagctgggactacaggtgcatgccaccacccctggctgatttttgtatctttagtagagatggagtttccccatgttaccgaggctggtcttaaacgcgtagactcaagcaatccgctcacctcaacctcccaaagttctgggattagaggcctgagccactgcacctggattgcctttgcattttaaagttacaagactattggatacttggaagtgatattaatattactggtttttgttgattagtaagcacatgcacttctttaattcccaaagcagaactggaggctgatgtcagccataaagaaaccaaaaggaaactcgtagaagcagaaaattctaagtcaaaaagaaagaaaccaaatgagtattcaaaaaatctggagaagaccaataggaagtcagaagaacttagcaaaagaaacaactcttctgggataaagctagattcttccaaaggtatattttctaaaacatcccaaaagaaatagattgctttgaggacatgcaaagtggaaaccaaagcagtagaagattttgatatgctttttaaaaaattttaattcaattgtattttaattttagattttctttttcttttttgagacacagtttctctcttgtcacccaggctggagtgcaatggcacgatcttcgctcactgcaacgtccctccacctcctgggttcaggtgattctcctgcttcagcctcccgggtagctgggattacaggcacccacctgcacgcccagataatttttttttttttttgagatggagtcttgcacggtcgcccgggctggagcccaccatcatgcccagctaactttttgtatttttagtagagacggaattggccaggctggtctcgaactcctgaccgcattattcacccacctcggcctcccaaagtgctgggattacaggtgtgagccaccgtgcctggccacgcccaggtaatttttatatttttagtagagacagagttttaccatgttggccaggctggtctcaaactcctgacctcaggtgatccaccccccacccccctccccgcccttggcctcccaaagtgcagattttgatattctaatagatgatgacagtctgcaccagaaatattaacatcttccattcctggtaaattcgagtttttccttctagtcctagaactctttttgttttttaacttttcattctttctccttctctctcttttttttttcttttgctcattgcaactttcaaacaataaatatgtgtttgaaataaatagaacctcacggattatgggcttacaaatgaccatattaacagataggtgttcagtctttgatttttctgtgcttccataaatacatgtgcttttatttttttattttttattttttgagacagcatctctctccgtcgcttgcctgatctcagctcactgcaacctctgcctcccgggttcaagtgattctcctgcctcagcctcctcagtagctgggactacaggcgcacgccaccacgcccagctaaattttgtattttcagtagagacagggtttcactgtgtggtccgggcaggtcttgaactcctgacctcaaatgatctgcccactttggcctcccaaagtgctgggattacaggcatgagccactgcacccggccaatatatgtgctttaaaaaaaatctggtattgtgctcgctttggcagcacatatactaaaattggaatgatacagagaaaattagcatggccccttgtgcaaagatgacaattttttttttttttttggtatttttagtagagatggggtttcgccatgttggccaggctggcctcaaactgacctcaagtgaagggatgacaattttaaaattaaaaagtaaaaaaaaaagtaacacagtgtccgggcatagtggctcataactgtaatcccagcactttgggaggccgaggtgggtggatcacctgcagtcaggagtttgagaccagcctgccaacatggcaaaaccctgtctctactaaaaatacaaaaattaaccaggtgtggtggtgcgtgcctgtaatcccagctacttgggaggccgaggcaggagaatcgcttgaacctgggaggcggaggctgcagtgagccaagatctcgccactgcactccagcccaggagacagagcaagactccgtctagggggcaaaaaaaaaggtaacaaagttgaaaaaaaaatatggtcttatcccatacatactattttacaccatgttttacatatctctgacatgttctcattcagtttatttatttactttttttgagacagttttgctctttttgcttaggctgcagtgccatggcatgatcttggctcattgttgcaacctctgcctcccggattcaagcgattctcctgcctcagcctcccgagtaactgggattataggcatgtgccaccacgcccggctaattctgtatttttagtagagactgggtttctccatgttggtcaggctggttttgaactcccaacctcaggttatccacccgccttggcctcccaaagtgctgggattacaggcatgagccaccgtgcccagccccattcagtatatatagcttttccaaagtatgctattgatttattcatttatatagctttatacaggatgaatatccctaatccaaaaatctgaaatttgaaatgctccaaaatccaaaacattttgagtgctgacatggtgccctaagtggaaaattccatacctggggccaggcaccatggctcatccctataatcccagcactttgagaggccgaggtgggagcattgcttgagcctaggagtttgaggccaggctgagcaacacagggagaccacacctttaccaaaaaaaaaagaaaaaaaaattggctaggcatggtggcacatgcctgtagtctcagctccacaggaggctgatgtgagaggatcacttgaggttaaggctgcagtgagccatgattgcaccactactccaggctgggtaacagagcaagaccctgtctcaagaaaaaaagaaaattccacatctaacctctggtcatagtcaaaatgcccaggctggactgtggtagcatgatctggactcactgcagcctccacctcctgagttcaagcgattcttctgcctcagcctcctgagtagctgggattacaggagcccaccaccatgctcggctactttatgtattttttttttttttgagacagagtctcactctgttgcccatgctggagtgcagtggcgcgatctcggctcactgcaagctccgcctcctgggttcgtaccatcctcctgcctcagcttcctgagtagctgggactacaggtacatgctgccacgcctggctaattttttgtatttttagtagagatggggtttcaccgtgttagccaggatggtcttgatctcctgaccttgtgatccaccctcctcagcctccgaaaatgctgggattacaggcgtgagccaccgcgtccggcttttttttttttttttttgagacaaagtctcgctctgtcacccaggttggagtgtagtggcacaatctcggctcactgcaacctccacctcccaggttcaagctattctcctgcctcagcctctttagtagctgggactacaggcgtgtgccaccacgcctggctaatttttatatttttagtagtgacggggtttcaccgtgttggccaggctggtctcgaactcctgacctcaagtgatcctcccacctcggcctcccaaagtgctgggattacagatgtgaaccaccgagcccggcctactttttgtatttttagtagagatggggtttcaccatgttggccaggctggtctcgaactcctgatctcaagtgatctgcccgcctcggcctcccaaagtgctgggattacaggcatgagccactgcacccatcccgattattggttttatgccacaaattatttctcatcattcatgtttcttcagtggttattaaaaatttaaatattgctgtttgtggtggctcacatctgtagtcccacctactcaggaggctgaggtgggagcttgagtctggaagttcaggaatgcagggagctgtgtttgtgcttgtgaatagccactgcagtccagcctgggcagcatagcaagacctcatctcttaaaaaaagaaaaaaactatttatttttaattttcaactcaaggggcacatatgcaggtttgttacatggatacattccatgatgctgagatttggacttcaattgaacctgtcacccaaatagtgaacatactgcccaatagatagtttttcaacccttgtcctcacttcttccctcctcccttttgtagtccccagtgtcttttttgttgttgttaagagacagggtcacactatgttgcccaggccaatcccgatctcttgggttcaagtgatctacctgccttggccttccaaagtgctgggattataagtgtgagccaccacatgtggcctccagtgtcttttgttcccatctttatgtccatgtgtacccagtgtttaggttcagcttataaaggagaacatgcattatttggttttctgtttctgcatttattcacttaggataatagcctccagctgcaaccatgttgctgcaaaggatatgatttttttcttttttatggctgcatactatcccatggtgtatatatgtcctacaaattctttatccaatccaccatttttgggcacttaggttgattccatttttgctttttttttttttgagatggactgtcactctgttgctcaggctggagtgcagtggcacaatcctggctcactgcaacctccgtctcccaggttcagtctctttgctgttctaaatataaacatgtgagtacatgtgtctttttggtagaacagtttattttcctttgggtatatacccagtaatgtgattgctgggccagatggtaatcctaaaaaaaaaaaaaccaatgtttaagtgtgcactttaatttttttttttttttttgagacggagtctcgctctgtcgcccaggctagagtgcagtggcgcgatctccgctcattgcaagctccgcctcccgggttcacaccattctcctgcctcagcctcccgagtagctgggactacaggcccccgccaccacgcccggctaattttttgtacttttagtagagacggggtttcaccgtgttagccaggatggtatcgatctcctgacctcgtgatccgcccacctcagcctcccaaagtgctgggattacaggcgtgaaccaccgcgcctggctaacactttaatattttaataagattatggtggttatttttttttagggggaagggtttggtgtgaagaattttaaatgtaatgttgttttaaaagtacctctggcattttgtaaatataaatatttctgcaaatacctactgtgacattgtaacaataatgtaaatgactaataattcatatatgtttatgtcaaggaatgaataccttaattttttttttttttgctttagattctggaactgaagacatgctttggacagaaaagtatcaacctcagactgccagtgaacttataggaaatgagttagctataaaaaagttacataggttggtaaaatgtgtaaggaattgagaaatagtttacaaacttagttttactgtttttgtttcgaaattgtagttacaaagtaatatatctcatgataaaatcttcaaaaaactggtagaagtttaagtgaaaagtagccctcttttcttacatttctacttctcagagataatcattgaaaattttttgtaaaagcttccagaaaaatatttttatgcatatgttagttccttcctttctaacaaatgggatcacattactactaattcaggtccccagtccttcatcttcaattctcacatccaaaaaattctgaataatgaaagtttattgactttattacatgaaatttgttacacctttacacttagtagaatttacaaatttttttttttttttttttttttttttttcaagacagagtctcactctgttgcctaggctggagtgtaatggcacgatcttggctcactacagtcgctgcctcccaggttcaacagattctcctgcctcagcctcctgagtagctgggactacaggggtgcaccgccatgccaggctaatttttgtatttttggtagagacagtttcgccatgttggccaggctggtctcaaactcctgacctcaggtggtccacccgccttggcctcctaaagtgctgggattacaggtgtgagccactgcacttggccagaattcatatattttttaataaaaatattaagtgatggcccagtgcagtggctcacacctgtaatcccagcactttgggaagctgaggcgggcagatcacttgaggctgggagttcgagaccagcctggccaacatggtgaaaccccatctctactaaaaatacaaaaattagctgggtgtggtgatgcacgcctgtaatcctggctactggagaggctgaggcatgagaatcgcctgaacccgggaggtgaggattgcagcgagccgaggtcgtgccagtgcactccagcctgggcaacagagtaagactctgtcccaaaacaaagcaaaaaaacaaaccaaaccaacttaaatgattatgggtgtactgcctagaccccattaggggtattatgtaatatgcagtatatgtaccaaataaccttttaagtatctgaaaaattaattctaaaacaatctggtccaaaggatttcatataaggatttacggacccataattacagttaatagcgtgaacttggtactactgttctaagtacttgtattgttccttctttcttttttttttttttacttgtactgttcttaattcattttatccttagaatggtactgtgagcagtgggtacagtggctcaagcctgtaatcccagtgctttcgtaagctgaggcagaaggactgcttgtggccaggagtttgagagcagcctgggtgaaatagggagaccccatctctacaaaaaataaaaaaaatagctgggaatgatggcgcccacttggattctgagccactcaggagcctgaggtgggagggtcacatgagtccaaggattcgaggctgcagtgagctatgatcgcacccctacactccagtgacaaagcaagactgtctcaaaaaaagaaaaatactatgagcataaatactgttgtcctcatctcatagatgaagaaaccaaggcctagagaggctgagttatttgtccaaagtcacacagctagaaagtgatggaactgggatttaaactcaggcattctagctctagactagaacttaatctttctgttgtacattgtatattaggcatctttcatggaattacacaacataccgcagttctttttttttattttgaaacagggtcttgctctgttgcccaggctggagtgcagtggttgaatcttggctcactgcaaccttcgcctctcaggctcaagccatcctcccacctgagcctcccaagtcgctgggactacaggtgtgcaccaacatgcctggctaatgttttttgtagagacaggtttcgctgtgttgcccaggctggttgcaaattcctgggctgaagcaattcacctgcctccgccttccaaagtgctgggattacaggcctgagccactgtgcctgccctgccacctcagttctttttaattgctgtataccagtttctaagtgagtgtactataatgtatttttcccaatggtgtatttttatgtttttcctgttagaggctaatatgaacaatgctacagtgaatattcttacacatatagtcttgtatattttggcagaaactacttcatttaaaaatgttcatgtccatgtaaaactattttactctttagttgattcacaagcactgtggagtgtttagaaactaacaatatgccatataaagctgtactagtaaaaataacaagaaagccttcatcagttgaatggccagtggcagagaaactaacaatatgccataacttcccccgataatcattttaacataaagtctaaggcatagctatattctgtgaattatttttattatgttttcttgtggcagttggttgaaagactggaaaagaagagctgaattggaagaaaggcagaatctgaagggaaaaagagatgagaaacatgaaggtattttgtgtgtctttttttttttttttaccatttcactgaacatttttagagttacattaactaaaactttctataaaatttcttttttttttaatttttttttttttttggagacagagtcttgctctgtttcccatagtggagtgcagtggcgcaatctcggctcactgctacctccgcctcccgggtcaagtgattctcatgcctcagcctcctgagtagctgggattacaggcgcctgccgccacgcccgactaatttttgtatttttagtagagatggggtttcaccatcttggccaggctggtcttgaactcctgacctcgtgatccacccaccttggcctcccaaagtgctgggattaagcagtggcatgagccactgcacctggcctataaaatttcttaattggtattttatatttgattttctactttttttttttttttttcactctgtcacccaggctggagtgcaatggtgtgatctcggctaactgcaacctccacctcctgggttcaagtgattctcccatctcagcctaccgagtacctgggactacaggcatgtgtcaccacacctggctaatttttgtatttttagtagagatggggtttggccaggctggtctcgaactcctgaccttgtgatctgcccgcctcagcttcccaaagtgctgggattacaggcatgtgccactgcgtccggcctgtataaagtaatttttcagcatctattgcaagaagtttgtgggatttgatcactgggtttcataaggtagaattgcttcctcagcaattgtcattttatatgcatttgaataatttttcagatttctcgggtggcatagactttaaaggcagttcagatgatgaagaagagagtcgtctttgcaatactgtccttataacagggccaacaggagtgggaaaaactgctgcagtgtatgcttgtgcccaggagcttggatttaaggttagtaacagctatgatgagagaatgttaatgtaataattacccttggattaaaaggaaacataaaccattctcccttcgttttttcttatattcttcttttagatatttgaagtgaatgcctcttcccagcgcagtggtagacaaattctatctcagttgaaggaagctactcagtcccatcaagtagacaaacaaggtgtaaactcacaaaaaccctgtttttttaatagctactacataggcaagtcaccaagtaagtaaactattttccttaagccataatgttttgaaaaaaataaaatctaagaaagtaatgttaattatcagcattttgccatttattttttatcttctacacgtacacgtttcctgcccacccctgccagattattttaaaacaaatctgaagaccatcatatcatttcacccataccttcttcaatatttatctctatctgataaggacttttaaaaaagcataactataatatcgtaatcagacccaacagagttaacaaccagcctaagcagcatagcgagaccttgtctctacaaataataaaaaaaaaaagtagctaggtgtggtggtgtatgcctgtagtcccagctactctggaagttgatgtgggaggttcacttgagcctagaaggttgaggctgcagtgagctgtgattgggccactgcactccagcctgggtgacagagtgagatcccatctccaaaaaaaaagatctattaactatatttcttcatataatctcatacacagtctaatgtcaattttctgttgtttcaaatgatttgttcaaatctggatccaaacaaggttcatatcttacatttgattcagttctcttaactttcttttaatctcgctaacaattcactcacctttcttttcatgtcattaatttgttgaagaatctgagtcatttgtcatgaaattcttcacattctggatttgtctgctgattatatcctcatggtgtcagttagtatagtcctcttccctatatttcttgtaaactggcagttagatctatgggccttattagattcaggttctgttctgggtctggcatacatatacaggtggcctgtgtacttcctatgacatcatagcagattatcccttgtagattacaaaatgataattttataattctcttttttgcatttattagaattttaaaaggaagcactattcctcatcaactctttggatgctttggaatacagtttataggcaccagaaatgcttcattcattcctttatttattagtacttagagtgatggtgtcctagcaaccttgacagttgaccagtgagtttttgtgtagtttaattttttaagtattattatgaactcatggatttttatatatataatatgtttcacctctttgtgtttattatttctttgttgctttggagattttctcactggttttaagtaatttgattatgatgtgccttggtgtacttctcttcatgtttcttgtgcttgggatttgttgagtttcttgcatatatgagtttatagttgggaagatcaaagttgataaaatttcaaccagtatttcttaaaatattttttctgtcctccccttttcctttggcaactccagttattattataggtattttagaccacttgaaattgtctcctggcacactgatgctttgttcaatttttcagtctttttcctctttttgtttcagtttggttagttgttattactattcaagtttacacatcttttctgtagtatctagtatgctgtcactgctataagtatagttttcatttctagaagtttgatttgggtcctttttatatcttctgtgtttctacttaccatgtgcccagtctttcctgtaggtttttgaacatatggaatacagttataacaactgttttaatggtcttggttattaattctatcatctgtgtaatttttgtttttttgaaacggagtctcgcacttgtcgcccaggctggagtgcagtggcacaatcttggctcgctgcaacctccacctcccaggttcaagcaattctcctgcctcagcctcccgagtagctgggattataggcaaccgccaccacgcccagctaatgtttttgtatttttaatagagacagggtttgaccatattggccaggctggtctcaaactcctgacctcaggtgatccaccccccatggcctcccaaagtgctgagattacaggcatcagccaccacgcctggcccatctgtgtcatttctgagttgttttttcaattgattgattattccctctttcattatggattgtatttttctgattctttggatgcctgataattctgattgcatgtcagactttgtagagtttgccttcttgggtgctggatatttatgtattcctgactgttcttttttttctaaatttatcaatcctgcactttttgtacctataactgttcgttaactttcttctgtgatgtggttaagttagttgggaaaagtttatcttcaggtcttgtgtatgtgtttgtttttgagacagtctcaatctgttgccaaggctggagtggagtggcacgattatggttccctgccacctcgaagtgggcttgggcaatcccccaaccttagccttttgagtagctaggactacagaccaccgcactcagctaattaaaagaaatttttttttgtagagggggtcttgctgtgttgtcaggctagtctcaaactcctggcctccagcagtcttcctgccttggcctcccgtagtgctaggattacaagtgtgagccgtcaccacgcccagctttttcaggtcttttaaactgtagtaggcaaaaaagtagcagcatttagtctagggctaattttgccccactccttaggcaaaacctttctgagtgcttcaatattccattagttatgtttgccagtctacctgatgggaagacgaatcattcacagctctctgtgagcctcagagattgtttcctctgatctttcactgatgagtactcaattttagacttgagagggactctgcaaatttccagagctttgcccagctgtttcttctgtattcttccccacatctctgtctgcttggcctcctcaggtttctttttctttttttttttcttttttctttttttttttctttttttgagacggagtctcacactgttgcctgggctagagtgcagtggtgcgatcttggtgcactgcaagctctgcctcccaggttcaagtgatcttcctgcctcagcctcttaagtagctgggattacaggcgctcgccatcacgcacagctaatttttttgtatttttagtagagacagggtttcactatgttggccaggctggtctcaaattcctgaccttgtgatctgcccgcctcggtctcccagagtgctgggattacaggcatgagctactgcacccagccaacctcctcaggtttctagtgcagtctcaactcagaaaacatggattgactttcccctcactatggaaattttctcagggcaataggctgggcaatcctagtgttcaccttatttgtttttatatctcagagattactgtccattgttgcatcatgacaaaagtcttgaaaagtgttatttcatatattatgtccagttttcttgttcttatttatgatgggaggataaatccagtgccagttctataccttgactagaagcagaatcccatcttattttcttttggtgctcatatttttccatctttgactagcaaggaactattttaattggtttgtgtccttttgacattaccccagcaatagttgatattttacttgctttctggcatgtcaggatgtcccagacctacagttagctgtttctgcaagaaggtagttcttttggtgtgaaatttctttttcttttttttttttttttgagacggagtcttgctctgtcacgaggctggagtgcagtggtgtgatcttggctcactgcaacctccgtctcccaggttcaagtgattctcatgcctcagcctcctgagtagctgagactacaggtgtgcgccaccatgcctggctaatatttgtgtttttagtagagacacggtttcaccatgttggctaggctggtctcgaactcctaacctcaggtgatccatctgccttggattcttgaagtgctgggattacaggcgtgagccactgtgcctggccaatttttttagaaagaatatattgatatagtttagccagctactcacagagtatcttaaaataaaaattgcctttttttttttttttttgaaaagacggggtcttcctctgttgccaaggttggattgcagtgatgcaatcatagctcattgcaaacttgaactcctgggctcagatgatcctcctgctttagcctcccagagtgctgggattgcaggtatgtgccactgcacttggctaagcatgtatttttaaaaccagtctttgggccgggtacagtgggtcatgcctgtaatcccagcactatgggaggctgaggcaggtggatcacaaggtcaggagttcaagaccagcctggccaacatggtgaaatgccatctctactaaaaatagaaaaattagccaggtgtggtggtgcacacctgtaatcccagctacttgggagactgaggcaggagaattgcttgaacttgggaggtggaggttacagtgagctgagattgtgccactgcactccagcctgggcgacagtgtgagactccgtctcagaaaaaataaataaataaaaccagtctttggactggtattcatacatgatcaagcagtccttggtctatatcaaaataagaaaaataaggacaaaggccaggcacggtggctcatgcctgtaatcccagcactttgggaggctgaggtgggcggatcacgaggtcaggagattgagaccatcctggccaatatgttgaaatcccgtctctactaaaaatacaaaaattagctgggcatggtggcgtgtgcttgtaatcccagctactcgggaggctgaggcaggagaattacttgaacccggaaggcagaggttgcagtgagctgagattgtgtcactgcactccagcctggtgacagagtgagactccatctcaaaagaaacaaaaaaaaaaaaaaaaagaggaaaaaatggtgttttttataaattgatatctgttcaactatttatttatttatttatttatttatttatttatttatttgagatggagtcttggtctgtcgcccaggcagcagtgcagtggagcgatctcagctcactgcaacctccacctcccaggttcaagtgattctcctgcctcagcctcccgagtagctgggattacaggcacctgccaccatccccagctaatttttgtatttttagtagagacacggtttcaccatgttggccaggctggtctcaaacttctgaccttgtgatctgcctgccttggccccccaaagtgctgagattacaggcgtgagccactgtgccctgccaaatatttttatattttaagatattgcatctcttacctgtggtgttgaaatgttctatatttttgaaatgatggtcatgtctgtgacagcttttttaacctcgagattttcagtaagcttattgaacacctctaatatacaagggctatgataagatctatggagatagagggtagaaaaaaagaataggacacagatatggaactgtgatcatgagatggtatgtgaggaagatcctgttctgaggccatacagtaattaggatttgtaaggactaaatccaggtacctagaggggaagagaggatgtattatgtggaaaaatgccatggggcttttggagaatagaggtgaactatttattttttaacttcgtatctatcttccaaagcatctctaaaaatacattttattggcttgcaatattaatttactgcaggtctaaattaaagttgaacaacaaagttctgtaatgtgctcagtgtatactgttattttccctccaccctcttctttctttaagcaggtgtagaaaaaaatgaacagaggtactgtgaacagtatttgttgtaagaatgtgtatttctggctgggtacaggggcccacgcttgtaatcctagcactttaggaggctgaggcaggcggatcgcttgagctcaggagtttgagaccagcctggacaacatggcaaaacccatctctactaaaaatacaaacgattagccaggcgtggtggtgtgctcctgtagtcccagctacttggggggctgggcaggaggatcacttgagcctgggaggtggaaactgcagtgagctgagatcataccacttcactccagcctgggtgacaaagtgagaccctgactcaaaaaaaaaaaaaaatgtgtgtttctttggagtagagtgtcttttctaaatgactggcttggccgtgtgcggtggctcatgcctgtaatccgagcactttgggaggccgaggcgggtagatcacgaggtcaggagatcgagaccatcctggctaacacggtgaaaccccgtctctactaaatatacaaaaaattagctgggcgtggtggcgagtgcctgtagtcccagctactcgggaggctgaggcaggagaatggcgtgaacccaggaggtggagcttgtagtgagccgagatcatgccactgcactccagcctgggcgacggagcgagaccctgtctcaaaaaaataaaataaaataaaataaaataaataaatgactggcttaaccttctgtactggtagaataaataaatatagtaatatttggatgtacatagtatttttaagaatgaaagaaaatttctgtgtctttgatttttaactgttaagagtagaaatacagaatgtggctaactgtcttgctacctgtatgatttttagaatatttatctttaagtgcaatttgtttttgggcagaaaaaataagctcccctaagaaagttgttacatcaccaagaaaagttcctccaccatcaccaaaaagtagtggaccaaagcgagcacttcctcccaaaaccttggcaaattattttaaagtatctcccaaacctaaaaataatgaagaaataggaatgcttctggaaaataataaaggtaagacattaaattgacaaattttatattttttaataataatgacccttatacctaaaaatgtgagcacattttacgagttcctgttgctatttattaaatctcagctacactgaaggttctacatgtagaagtgttaatattttgtttccttttttttttttttttttttttttttttgagacagagtcttgctctattgccaggccaagctggagtgcagtggcacaattttggctcactgcaacctcttcctcctgggttcaagcaattcttctgcctcagcctcccgagtagctgggattactggtgcacaccaccactcccagctaatttttgtatttttagtagagacggggttttgccatattgttcagactggttttgaactcctgacctcaagtgatccacccaccttagcatcccaaagtgctgggattacagatatgagccaccacgcccagcttgtttcagtttttgtttgtttgagacagtctcactctttcatccaggctggaatgcagtggcgcaatcttggctcactgcaacctccgcctcctgggttcaagtgatgctcctgcctcagcctcccgtgtagctgagattacaggtgtgtgccaccacacccagctaatttttgtatttttagtagagttgggatttcgccatgttggtctcgaaaccctgacctcaggtgatccacttgcctcggcctcccaaagtgctgggattacaggcatgagccaccgcgcccgtcctgtttcagttttgataatggatttcagtttgagcttattctgtggacatatccaatgtcttagcaaaagttgattttacctaaaatattaatattgtatttatgcaggaataaaaaattcttttgaacagaaacaaattactcagactaaatctacaaatgcaactaattcaaatgtcaaagacgttggagctgaagaacccagcagaaaaaatgcaacatctcttattctttttgaggaggtaggcttatagaagtatacatttgtgagagctcatgataaagacttactttaaagaatactgtatgttttcttataaagaattgtaaaatagctaaggaggtcaggaatacgtgtatctatttgaaattaaagcaaattaaactgtccactctagaataatttttcaggaagatgattaatgtaattcacggctgctaattattgttaaatgattgtataaattattctgatccatatctgtctagttataggtggctgcgtttgtttttaacatttgatagttgataattttaaaattcattatagtgtatgacataaactttcaacatgagctgaattcacacttcataaattcataaattttgtctctaacagacatagaatatttactatgtatacataactgatattagtaagtgtattaatatattaatattctaataaactgtaggttgatgtaatttttgatgaagatgctgggtttttgaatgcaatcaaaacattcatggcaacaactaaacgacctgtaatccttactacaagtggtaggtaacaatgattttacttcagttaaacagttactcaaatctgtagttcatctgcagactggagtaattataattaactcacaaatagcaattacttttttaaaattgatactactttgggttactatgttgggtattagatatttaggaattggagaacaatctctagaatgcaaataagaaatctagtaatggtattttggtagggaaaatactagattcttctcctggtgtccttatcatacctataatcagatcactaaatctgatttagtggtcaggattttttatggaacccaacctttctgctgttccttaatcctgaacttagccactcttttgcccctgataacactttcttatgaattattgtatatttagctatcatcagcctaatagaattgatccatcttctaaagaattatcacagaatgtttcattttaaaaactcattcaatttctttttcaaaaaattggaaatactataataattttctaatatttttccaattataaatattcatgaggctagtctctacttacaaattaatgcccatttggtagtgattgtactcttaaaatattgagaaaaatcttattaatcagaagttaggtggtgttttttttttttttttttttttttttttttggagacagagtctcactctgttgcccaggctggagtgcaatggtaccatcttggctcactgcaacctctgcctcctgagttcaagtgattctcctgtctcagcctcctgagtagctgggactacaggcacacaccaccacgcccagctaatttttgtatttttagtagagacagggtttcaccatattggtcaggctggtctcgaactcctgacctcatgtgatccacctgcctcggcctcccaaagtgctgggatcataggcatgaggcactgtgcccagctggtagttttattagaagatcatagttggccaggtgtggtggctcatgcctttaattccagcactttgggaggctaaggtgggcacttgaacctgggagttttgagatcagcctgggcactatagtgagacccccatctctacaaaaaaacttaaaaattatctgggcatggcagcttgagcttataatcctagctgcttgggaagctgaggcagaggatcacttgagcccaggagtttgaggctgcagtgagctatgactgcaccacagcactaggcagtggtggggaggcgggtgctgaatattttcatagaaaagtataacttgaaaaagttatttattggtcttagtgtttaagaattttttttttttgtgtgtgtgtgtgtgtgtagacccaacatttagtttaatgtttgatggctgctttgaagaaatcaagttcagtactccttccctggtaagttttaaattttgatagccacaaattacatatcaccatcatgtaaaagtagtttattattaaatacagctataatttttttttttttttgagacggagtcttgctctgtcgcccaggctggagtgcagtggcgcgatcttggctcactgcaagctccgcttcccgggttcacgccattctcctgcctcagcctccgaagtagctgggactacaggcgcctgccaccacgcccggctaattttttgtatttttagtagagacggagtttcaccattttagccaggatggtcttgatttcctgaccttgtgatctgcccgcctcggcctcccaaagtgctgggattacaggcgtgagccactgcgcccggtccaatacagctataatttagccaggtgtggtatcacgcctgtactcccagctacttgggaggctgaggcaggaagatcacttgagcccaggaggtggaggttacagtgagctgaaattgtgccactgtactctagcctggtcaatcaatcaatcaataaggccaggcacagttgctcatgcctgtaatcccagcactttgggaggctgaggagggcagattgcttgagctctggagttcgagactagcttgggcaacatggcaaaaccctgtctctacacaaaaatacaaaaaattagccaggtgtggtggcacatgcctgtagtcctacctactcaggaggctgaggtgggacaattgcttgagcccaggaggtcgaggccatggctgcagtgagctgtgattgtaccactgcattccagcctgggtgacagagcaagattctgtctcaaaaaaaataaatacctggccgggcgtagtggctcacgcctgtaatcccagcactttgggaggccaggtagggtgggtcacctgaggtcgggagtttgagaccagcctgaccaacatggtaaaaccccatctctattaaaaatacaaaattagctgggcgtggtggcgcatgcctgtaatcccagctacttgggaggctgtggcaggagaatcgcttgaatttgggagatggaggttgtggtgagcctagatcgtgctattgcactccagcctgggcaacaagagtgaaactacatctcaaaaaaaaaaaaaaagaaaaaagagctataatttaaatgtggtttctaaggaatatgttaaaatttttaagttttaggaaacttctgattatttctcttttttttgctttaaaaatgtgttttcttaaatttaaaataatttttactaggcttcaatgttcactaggttttttgcctagtaaaagtgcttttctgaggtaaaatttaaatggagttaaaatgcccttacatgaataacttaatgaatatattttgtacatataacatatgtaaaaatcagtgtcatcattatgcagatcagaatatagagcatttccattacctcctaaagttctcatggaccctttctagtaagaatccccttttccaccagaaatagccaccttttttttttcttacgatgatgaacaaggcacttttttaacctttaaaaagatagtgtttttgtgtatatgtctttttttcttattttttcctttttcttttttttcattcttctaaaaaaaaaaagtttttaaaattaacattgagttgctgggcatggtggctcatacttgtaatcccagcactttgggaggctgaggttagaggattgcttgaggccaacagttccaggctgcagtgagataattgtggtcaggtcaattttactgtatgggttattttatttttttaggtgaggtctcactctgttacccaagctggagtgtagtggcacaattgtcctgttgcccaggctggagtacggtggcacgatcttggttcactacaacctccaactcctgggttcaagcaattctcccacctcagcctccctagtaattgggattggagacgcacaccaccacgcctggcttattttttttgtatttttagtagagacgggatttcgccatgttggccaggctggctttgaactcttgacctcaagtaatccacccaccttggcctcttaaagagctgggattacaggcgtgagccaccgcgcccgaccctgttcttacttttaaattgtgtttcttagctggaggcagtggctcacacctgtaatcccagcactttgggaggcagaggcaggcggatcacttgagtccaggagtttgagaccagcctgggaaatgtggtgaaaccctgtctctacaaaaaattaaaaaaattagctggatgtggtagcgcacacctgtagtcccagctacttgggagattgaggtgggaggatcacttgagtatgggaggcagaggttgcagtgagccaagatcataccactgcactccagcttggtgacagagcaagaccctgtcccccccccaaaaaaataattgtttcttttaaataacacataattgaatatttttaaaaatttgtctaggccgggcgcagtggctcacgcctgtaatcccagcactttgggaggctgaggtgggcggatcacctgaggtcaggagtttgagatgagcctcaacattgagaaaccccgtgtctactaaaaatacaaaattagctgggcgtggtggtgcatgcctgtaatcccagctactcgggaggctgaggcaggagaattgctcgaacctgggaggcagaggttgtggtgagccaagatcgcgccattgcactccagcctgggcaacaagagcgaaactccatctgaaaaaaaaaaaaattgtctaaacaggctgggggctgtggcttatgcctataatcctagcacttttggaggccaaggtgggtggatcccttgagcccagaagttcaagaccagcctgggcaacattggcgaaatcctgtctctacaaaaagcacaaaaattagctggatgtaaaaagaaaaaaaattaactgggtgcagtggcatgtgcctgtagtcccagctacttgggaggctaaggcaagaggattgcttgagcctgggaggcagaggttgcaggaagccaagattgtgccacagcactccagcttgggcaacagagtgagactctggaagaaaaagaaaaaaaaaacaatttgtctagacaattcttcattcttccttttctgcagtcttttggattaaccaagtatattatttcatttcaccttcactgttggctttcagctatatgctaatatggtctccactacccaaatgaagctattgagcttttaaaatgtggctagtctacagttaataaaagatcacattttgtatgataataattgtatgaaatgtccagaataggcacatttatagagacagaaagtggattcatagctgcctaaggctagaggagctaggtagaaatagggagtgactgctgattggtctggggtttcttttggggatgatgaaaatgctctgtaattagatagtggtaatgggtgcaaaactctataaatatactaaaaccattgaattttacatgttaagtgggtgaattgtatagtatatgaattatatctaaatacggcttattatctatttttaaaatgtggctagaccccatctctactttgtgctaaagtgtaatataaacaccagattttttttttttttttttgagatacggtctcactctatctcctaggctggagtgtagtggctcagtctcagctcactgcaacctctacctcctgggctcaagcagtcctcccctctcagcctcctgagtagctaggaccataggcatgtgccaccacgcccagctaattaaaaaaatttttttgtagagatgaggtctcactatattgcccagactggtcctgaattcctgagctcaagtaatactcctgcctcagcctcccgaagtgctggtattacatgcgtgagccacagtgcctggctaacaccagattttgaggactcagtgcaaaaaataggaatgtaacacatctcactaatttttatattggttacattttgcaatatttggatatattgttgtaaaagaaatgtagtaaaattaattattattattttttgagatggagtctcgctctgttgcccaggctggagtgcactggcgcaatcactggctcactgcaagctccacctcccaggttcatgctattctcctgcctcagcctcccgagtagctgggactacaggcgcctgccaccatgcccggctaatattttttgtattttttagtagagatggggtttcaccatgttagccagaatggtttcgatctcctgacctcgtgatccgcccgtctcggcctcccaaagtgctgggattagaggtgtgagcccccgcatctggccctaaaattaattttacttgtttctttaattttttaatgtgactcctagacaatttaaattacatatatggcttggtttttaaaatttttgtattaaaaaatttgcttttggtaaagaacacgtaacagtgtacagttgaatagtgttaagtatattcacattgctcttgcaaaactgaaattctacgcttgttaaatgaaactccctgtttcctcctgtccagtagttgctggcaactaccattctactttgtttatatgaatttgactatgctagatataaatggaatcatactgatttggcttgttgtgaccggcttttttttttttgagatggagtctccctctgttgccaggctggagtgcagtggcacgatcttagtcatgcaacctctgcctttggtttcaagcaattctcctgcctcagcctcccaaagtgctgggattacaggcatgagccatcgcgccaggctgtgactggcttatttcacttagcataacatcctcaaggttcatctaagtcgtagtatgtatatagcttacagtgttttacttgcattatatttcttttcttttcttttttttttttttttttttttgagatgtagtcttgctctgtcacctgggctggagtgcagtggcacgatctcagctcactgcaacctctgcctcccggtttcaagcaattctcttgcctcagcctcccgagtagctgggactacaggcacgtgccaccatgccctgctaatttttgtatttttagtagatatggggtttcaccatgttggccaggcttgtctcgaactcctgacctcaagtgatctgcccgcctcggcctcccaaaatgctgggattacagacgtgagccaccgcacctgcccctttccttatatttctttttcttttttttttttttttgagacagagtcttgctgtgtcgcccaggctggagtgcagtggtgcaatctcggctcactgcaagctccgcctcctgggttcacgccattctcctgcctcagcctcccgagtagctgggactacaggcgcccaccaccacgcctggctaattttttgtatttttagtagagacggggtttcactgtgttagccaggatggtctggatctcctgaccttgtgatccacccgcctttgcctcccagagtgctgggattacaggcgtgagccaccgtgcccagctgcctttgccttatatttctaatggacagtactgctgtagattctagatgttcttttcctttgtcgttgctaaattctcttattagttatagtagttattttgttggtttcttaggtttttctttgctttttttctattttttaaatttttattagaaacagggtctctctgtcacctaggttggagggcagtggtgtgatcataactcactgtaacttcaaactcctagcttcaggtgatcccccaaccttggcctcccaaagtgctgggattacaagcatgagccaccacaactgtcagtttcttaggtttttctgtgtactcaatcatgttatctgcgaacagagatagttttctttcctttgttttttctgccttttatttctttttgttgccttatttcattgggtaggaccttcaatatgttaagtagaagtggtaacaatggatatccttagcttgtacttgatcttagatggaaagtgtttactattttactgttgaatacaaagttagctataggcttttcataccttctttttatcagattaaggaaatttcttttattccaactttcttttttttttttttttttttttttggttgagatggagttcgctcttgtcgcccaggctggagtgcagtggggcaatttcggctcactgcaacctccacctcccgggtttgagtgattctcctgtctcagcctcccgagtagctgggattataggcaagtgccaccatgcctggctaattttttgtatttttagtagagatggggttttgccatgttggtcaggctggtcttgaactcccgcctcgccctctcaaagtgctgggattacatgcgtgagccttggcccccaggctattccaattttcttagaatttttatcaagagtaggtgttggattttatcaacagcttcttttgcatgtgttgaaatcatatttttctacttttatctatctctatggtgaattatactgactgattttctaatgataaaccccccttggtcatgatgtattatccactttatatattgatggattagatttgtgattaatttattaaggatttatatgtttattttcttgaggaatactactttgtaacttttttcttttttttttttaagaattgtctttgttagctttaagtattaaggttaagctgccctcaaaaagagttgagaaatgtttccttctcttttttctaagagtttgtatagggttgatattctttattttttggtatttgatatacttcatcagtgaatttatgagttttctttgtgggaaaatctttgataaattgaattattttatttatttatttatttatttatttatttatttatttattttcgagacagagtcttgctccatcgccgaggctggagtgcaatggtgtgatcttggttcactgtaacctccacctcccaggttcaagcgattctcctgcttcagcctcccgagtagctgggattagagatggggtatcaccatgttgggcaggctggtctcaaactcctgacctcaggtgatccccttgcctcagcctctctcaatttcttggccaggcacagtgggtcatgcctataatcctagcactttggaaggctaaggcaggaagactgcttgatgccaggagtttgagaccagcctgggcaatatagtgagaccctgatctctaccaaaaaaaaaaaaattaattagctttatgcactaattagtgcaatttctaacctggtttttaaaaaattgtgtatttttcagtgttatagtattcatatttataattttgttgtaagatattctatcaagctatactgttacttaatcctaaggggttttatcaaggtttataaaactgccttcagtgttcaggttggagaatctcctataaaagtttccttgctgtcttgcacaatatacagttaataaaagaaatacatgtaaatgcttttaatttaatggtatattcccttatatttttaaagcagtttcatcctcaagaagagcatttaagataatgtgaattttagcaaaatttgtctcacttttagatactatttgtatgtattattgctgtatctatttgaactcagcagttaaccacatttctctctctgttttgaagctaaatgttgccagctacctacaaatgatttgcttaactgagaattttagaactgatgtaaaagactttgtaaccttgttaactgcaaatacttgtgatatcagaaaaagtatcctttacttacaattctggattagaagtggaggtggagttttagaagaacgaccattaaccctttatcgtaagttgatttgttattaaagaaatttctattatgggaccctatttaaaaatctgtgctatggctgggtgcagtggctcatgcctgtaatcccagcactttgggggagtgaggtgggaggatctcttgaggccaggaggtccagatcagtctgctgaacatagtgagacccctgtctctacaagaaaatttatgggaggccaaggtgggaggatcacttgaagccaggagttcaaaaccagcctgcgcaagaaagcgagacccctgtctctacaaaaaaaatttgcaaaaattagctgcgcagggtggcatgtgcctgtaatactggctacccgggaggctgaggtaggaggatcacatgatccccgaagagtttgaggctgcagtgagctatgattatgccactgcactccggcccagacaatagagcaataccctatctctaaaaaaagaaaaaattatttatttatattttttgagatggagtctcgcactgttgcctgggctagagtgcagtggtgcgatctcggctcattgcaacctctgtctcccaggttcaagcaattctcctgcctcagcctcccgagtagctgggattacaggcccccaccatcacgcccagctaattttttttgtctttttagtagagatggggtttcattatgttggctaggctggtctcgaactcctgacctcatgatccacttgcctcggcctcccaaagtactgggattagaggcgtgagccaccgtacttggcccaaaaaaaaattttttttaattaaaaaaactctgtgctatgctagaatagttgaaagattataaaaattttaagcaacttgttatattaatcttcaaaataaatatgcacatgtcaactttgttcataaaacattttggcctggcacagtgtctcacaactgtaatctcagcactttgggaggccaaggggcatggattccttgagctcaggagtttgagaccagcctgggcaacatggcgaaaccccatctctacaaaaaattggctgggcatggtggtgcgtgtctgtggtcctagctacttgggaggcagagatatgaggatcactagaatctgggagatcgaggctgcagtgagccaagatcacgccactgcactccagcctgggtgacagagtgagactctgactaaaaaaaaatttttgcagtcaatgtgagtaaatagaattaaactggatctagaaagttggatttttttcctggctatgctactctttacaattaatatataagctccaaaattcactttacctttttgagcctgttttttcacctaaaaaaggagagatctgaactaatctataagttacttattcttttgtagttgagcttttaagatgatctcattgtttaattttaaaaaaacacacacaggctgggtgcagtggctcacgcctgtaatcccagcactttggaaggccgaggcggttagatcatgaggtcaggagatcaagaccttcctggccaacatggtgaaaccccatctctactaaaaatacagacattagccgggtgtggcggcacatgcctgtagctactcgggaggctgaggcaggagaattgcttgaacccaggaggcggaggctgcagtgagccaagatcgcaccactgcattccaacctgggcgacagagtgagactctgtctcaaaaaaaaaaaaaaaaattaaaaaacacacacacaaattaaaaaacaaacacaaaaaacctcccaccctgttccccctttcctcttcaaaagtttttcttttctttcttttttttttttttttgaggtagggtctcgctatattgcccaggctggagtatagtgactcttcatgggcaggatcataatgcacagccctgaactcctgggctcaagcgatactcctgtcctagcctcctgagaaggccactgtgttcagcttcctccccagaaatttgactcttaaattttcaaactgttacttatacatgtattaacatatataagtacttataacatagtacttataaacaaatgatactataattattatttaacaactttttcacttactaaaaacattaatttttctatatgagtatatatatatataggtatatagtattcttatgtaactataacgtacaatcacttttagcttcaggagtctttaaattctgtctttcctaaatactttattatttcagaaatgcttttatttcttattttttttcagtcatcattgttacctaattcaagtgagtaccttctccatgccaggtcttgtgtttacatggttaagacatggttccttgcctgaagaagttttagtttggtttccatgctccatagtcacggttttgtagttacagatcctattctggtaaatacacaaatatttcaaggaaaccaaggtgaaattatgtaatatttatccttatcagttttttcttctaatgagtttaacattttaacgtattctttttcttttttcttttcttttctttctttttttttttttttttttttgagacagtgtctcattctgttgcccaggctggagtgcagtggcagtgcagcatggctcactccagcttaatctcctggactcgagccgtcttccgccctgagcctcctgagtagctggaaccacaggcgtgcaccaccacagctaacttttttaattttttgtagagacggggatctcactatgttgcccagcctggtattgaactcctgggctcaagtgatccgcccctcttgggctcccaaagtgctgggattataggcatgagccacctcacccagcttcatattattctttttcaaagtagatatgcctatatattctattcagtgtaagcccatagctttaaccatttctcaaaagtaaatataatacataacacatggaaaatatcctggtgtaacaaattagttaataactttttgatataccactagatataaattgttacagcaagaaactttagaagacacaaaataacaaaataagtacagcataatttctcttcttttctttttttttttttttttttttgagatggaatctggctctgtcacccaggctggagtgcagtggcacgatctcggtttgctgcaacctctgcctcctgggttcaagggattctcctgcctcagcctcccaagtaattgggtctacaggcgtgtaccaccacacccagctaattttttgcatttttagtagagacagggtttcactgagttagccaggatggtcccgatctcctgaccttgtgatccgcctgcctcagcctcccaaagtgctgggattacaggcatgagccacagcacttggctggggccagtttctcttcttaaaaatctttttttatatacatttcatccctgcccttaaaaaaaaaacagatacataaaacaatattcccctacttcttgaaagtagccacagttagacctttatgcatgtaacataaagatacatacttatttagcaaaattaaccagtattatatatgttgttatttttaagtttattgttagcacatacgatcctatcccactgtctttcacagctgcatgcttttctatagaatagaatggatgtaccgtaatttaaccgttacttacagacatttacattatcttcaatttgtcattaaaatacagtgaatatctttatacatatatccttgaaaatgtctgtaatattgatggagagaattctagaagtatgactgctgggtcacaaacggtgtatatactttacattttgatagttgttgtcagactgccctctgatgataattgtaccaacttatgctcccatgaatagtatatgatggtttttttatgtgtactgctgacagaactacattataattcttttaattttgccaatttaaaaagtgaaacatgtacagtatcttattttaaaattacatttccatgcttagtggtgaaattgcatatctttttattaggtctttgaaattattattattatttgagacggagcctcactcagtcgcccaggccagagtacagtggcgtgatcttagttcactgcagcctctgcctcccgggttcaagtgattctcctgcctcagcctcccaagtagctgggattacaggcacgcaccactatgcccagctaattttttatatttttagtagagatggggttttgccatattggccaggctggtctcgaactcctgacctcaggtgatccacccgcctcggcctcccaaagtgctgggattacaggtgtgagccactgcacccggctgaaattactgtttcttttttcttccccctttgagttggagtctcgctctgttgccgaggctggagtgcagtggcgtgatctcggctcactgcaacctccgcctcccaggttcaagctattctcctgcttcagcctccctaatagcgggggctacaggcatgcgtcaccacgcctggctaatttttgtattttgaatagagacaaggtttcaccatgttgcccaggatggtctcgaacttgcccaggatggtctcgaactcctgaactcaagtgatccacctgcctcagcctcccaaagtgctgggattacaggcgtgagccacctcacctggcctgaaattaatattaggtatttatttttcttctgtgacttgcctgctcacagtccttgcactttttctgttggatggctttgaaagtcccccaccatcacctcacttaatttatctcttggtagaaataatgcttatggccaggcgcagtggctcacgcatgtaatcccagcactttgggaggtcgaggggggtggatcactcgaggtcaagagttcgagatcagcctggccaacatggtgaaaccctgtctctactaaaaatacaaaaagtagccgggtgtggtagcgcgtgcctgtaatcccggctactcgggaggctgaggcaggaaaatcgcttgaacccaggaggtggaggtttcagtgagctgaaattgcaccactgcaattcagcctgggtgatagagtgatactctgtctttaaaaaaaaaaaaaaaaaaagaataatgcttatattgtactcttaatgaattaaacacatatgtagagaactaaatgggggtatttgtccagaagatgtcaaaggatctcaggctttaaataattgtttgatacaatttgtttaatacatatatagagctaagattttcttttattttgtaggtggaaatagcagaaatgtacaactagtttgctctgaacatggccttgataacaaaatttaccctaaaaatactaaaaagaaacgtgtagaccttccaaaatgtgacagtggctgtgctgagaccttgtttggccttaagaacattttttccccatctgaagacttattttcatttttaaaggtattttcaatgtctgttttgcaatgttgaatttatattccttttcatattcccaacattagcctcctatcttttgaatcttaagtttaacttaaatgtgcctataatttgtataagccttaggtctctgattttaacacatcctaccactttgacaaatggtgcataggcattgctctgaatgcatattataggatttagaatagcatttagaaaatttttcagatagactatttcagaaaagtggttttaaataaatgagcttctaataatattggagtatatactaaatacatagagaatttaattctccaaattaatcgtctaaatttaatttttagacatagtactattttgatatattaaatatagataaataaaattatgaggggtagtgactcagtactttgaatttagaatagggataacactatattcatacaggtagaaaagtattcaaactatgtactgctgtaacatttctttactcaaaattgtttttcagcacaaaatcacaatgaaggaagaatggcataaattcatccagcttcttacagaattccaaatgcggaatgtagattttttatatagtaatcttgagtttattctaccattaccagttgataccattccagaaactaaaaacttttgtggcccatcagtaactgtggatgccagtgcagcaacaaaaagtatgaattgtcttgctaggaaacactctgaaagagaacagccattgaaaaagtcccagaaaaagaaacaaaagaaaacattggtaatattagatgatagtgatctatttgacactgacttggactttcctgatcaatctattagcctgtcctctgtatcatcttcctcaaatgcagaagaaagcaaaaccggagacgaagaaagcaaagccagagacaaaggaaacaatccagagacaaagaaatctattccttgtcctcctaaaacaactgcaggaaaaaaatgttctgcccttgtttctcattgtttaaattctctctctgagttcatggataacatgtccttcttagatgcacttttaactgatgtaagggaacaaaacaaatacggtagaaatgactttagttggacaaatggaaaggttacaagtggactttgtgatgagtttagtcttgagagtaatgatggatggacttctcaaagctctggagaattaaaggcagctgcagaagctctcagctttactaaatgttcttctgctatttcaaaagcattggaaaccttgaattcttgcaagaaattaggaagagatccaaccaacgatcttactttttatgtttcacaaaagcgcaataatgtatactttagtcagtcagcagctaatttagagtaagtcttacttcctttactttttattttttggtaataaatcgtaaaggggaaatcaatagagttttttcttaatttaaaaatgctgtactattgatcatggtaagcccttaacattaataatgtagcttctaatgagatagctaaagagaccagcttgatcgctgggaagagaaataatgagtgattggggtggatttaggtaatgcttgaatgacccaggaaggagtttggtcttgctgtatagttattgagattttttcagtatgggagtgattgatgtgttgacaggaaattaatctggaaatgtcatctggtctagaccagaggcaaggaaactaaactggttgtgattgggattactgcatttttcttgggcattaaaaattaaaaacaatgcattacttttacagcaatgcttggaagaggatatcagtcattaaaagtgtattttcgagtcgatctcttctctatgtgggtaatagacaagctagtataattgaatacctgccaacccttcgaaacatctgtaagactgagaagctaaaagaacaaggaaaaagtaaaagaaggtaaaggctttattaaaaacaacattttagatagctttttcaagattaatacatattttcataagatgaaaatgttaatattaaattgtatttttctttgtaattttgacagattcctgcactattttgaaggaattcatcttgacattccaaaagagactgtgaatactttggcagctgacttcccttaatgttccatactaacaatgctttgtatagattatcatgtggtccttaagatacatttttatattatgtggatcttcatggaaaagtatatttctcgatgtacattttaaacaaacaatttgtatatttttttattggcgggtaaatatttaaaatatttgagttacaaattttatatatgattgtaattttttttctgaattttttgtattatctgatttagctttgttggagtattttttgtatgtgagtgaactgtttctggaaggtagagttcattaagatgaactccctatttcaagtgtttatattatatattagcttaatattcagatacattatcttggctgctaacattagtgtcac

SEQ ID NO: 1698 - DNA, 132534 bp, Homo sapiens
catagttgctatgaatttctcctcacaaggatgggcctgtttactcaccctgggcatcgttggtagagcgctagtgtaaacagcctgaggaacccggtgggccggggaagtgggcgcgctctgttctccgcggccagctgggacgccgggccaggtggggccgcctgcgtttagcaactgctttctcaccccctggatttgcgatgtttgccacagcagcgagaagcgccattgtaatggggatgggaggggtggagcctccaagtcctgtctcaatttagatctctcactctgctgttaggcgcgcccatttcagattactaaactcgaattaagagggaaaaaaaatcagggaggaggtggcaagccacaccccacggtgcccgcgaacttccccggcagcggactgtagcccaggcagacgccgtcgagatgcagggcccaccgctcctgaccgccgcccacctcctctgcgtgtgcaccgccgcgctggccgtggctcccgggtaggaacgtgggcgcgcggggggcgcgcgggcgcgcgggcctgggccgctctgcggctctgggccagggcttcggggaggtggcggctgctgtgcagcagcgggtgggaaatgccctcgcggctgcagtccccagcctggtactggcctggaggtttgaccatatgtagcttcagcgtggctctccatgggacagttaactttctccactcatgaagttgtttaagcgtctccccggccataacaactttctgaagagagtcattttatttttagtccacattgcctctgccttttgcttctcaactttttgctcccagattgcgattcttctctcaaagacatgatatattttttctaaccaagatgtctcaaccttagcattgccaaagtgtggcggaggggactgatgtatgggttcaggggcagacattataggaagaaaacaacagcacccaataatggcaagccccattcattcctaaagatttctgtagttgagccctaacccctagttatagcagagaaagtgctgctttagtgacttcttttatgattcgctatacctggaattttcaccagttgtagtttattttcaaatggtatatttcaatcaatggtattggttaaataattttttaccctcgttgggcagctactcaaggataaaggtttgaataagaaacaggcaaaatcttagttaaaaaataacaacaacaacaagaaaataatcacgctgggataaggtcctctgtaaaggagaagcttagagacttttgctttgccaataactccattatgccccggtgcaagccatttacatcatggttccttctgtgcggttcgtggtttataaaatggaaataataacacaggccttcctctagtagtgatgcatgaattactgcattaaaattgatttatgggaattattgttgtttcagtagcatttcaattcagttgccaaatagagcagtgggcaatgttaacggaaacaactgcaattggcgcagtatggagtgcctatcgcactaggaaatctgagggtcacaaaagaaaggagatgtgaggataagaaactttgtttttcccttgttgggaactctttaggcctcggtttctggtgacagccccagggatcatcaggcccggaggaaatgtgactattggggtggagcttctggaacactgcccttcacaggtgactgtgaaggcggagctgctcaagacagcatcaaacctcactgtctctgtcctggaagcagaaggagtctttgaaaaaggtaagataaacagcataaagtcttacccttctgcagtaataactggaatatgttaataaggtcatgtgttaggtagtatagcagagaaaccccaaatttgcagtatcttacctaatatacttttaattctcact[450 bp omitted]tttgtagcagaaccaagtttggttcttgtttcaagtttgggttctgacatggcccaagattaaattgggccaatgaatgtcttctttttcagtgctaagggaaaaataattttgggaggaagaggtaaatacttaaatacttaaaacatttttcattaaaatgaacttttattgcatttttttctttttttagattcttataattatttttagagacaagctctcaccatgttgcccaggctggtctcgaactcctaagttcaagtgatccacccaccttggcctcccaaagtgctgggattacagtcctaagctactgctcctggccgagacatacatttttataatgttaagagttatttaaaaaaaaaaatttaaggcacgtaatgaagggtggttggtattcattacataagtgtttattctctacaagcgtagagaaatgaacaccatcatgaaatgaaataaaagtaaaagtttatctgcatctgtggttctttccccactggaagttcactgggtaggtatatttggaataggagtcaggaagagatggtgtgtgtaggggcaagtcacttttgtccctcatagaagcaatgtcagggaagtgggaggtcttatttccctggaggggaagtataggttagcccttaagatctgagtttgaatcctggtactactttgctactagttgtatgatcttaggtaggttacttaactgctttgagccacagtttccttgtctataaaatggaaataatgaaactgatttcccagggcagttataaagttaaaatctgtatatagtacctcttaggcatgcaataaacaacaattgctaatattattagtgtaataatactgcagaagaggatgcagaaagtccatttcctttttacatgggggcagacttcaactttcgttattggactatcatttctgaaaatgaatgacccctgatcttatgatagtcgctaaagaaaatattgaaatattaaatcacaggacataatacttaaggtagttccacattcattatttattcattaagaatttatgagtgggaagagggagggtattaaaaaaccacctattgggtaccacacttatcacctggatgatgaaataacatgtacactaaagccctatgacaggcattttacctatataacaaacctgcacgtgtatccctgaaactaaaataaaagttaaaaaaaaaagaatttataatattggctccactagtgtggcagttttcctgcaatgcagagatccagaatatatatggatgtttttgataaatatttgagctttgcttggacatttacatactctaattctagaatttcacctgttaggtcttttctgtgatctctgttatcagtctctctttttttttgcaacaaatagtacctacattggggtgcatgttgttgtggcttggttttcagctttattcttagatcttcttttgggagaagggttccttgtatgcccataggaaagttcaagtactcaagactggggcgggcaaagctgtcctgggagcagaatggatctgtgggaaggaaggagggaaaacgctgcttctttcatgggctgtttttgactctattgacatagagtttcattgaaaatgccattgctaggagcactctcctgtttcaaaggagaatgttactgtattatcagaggctgggagttattgttctcagagcagatgcttcctgtaatgtgaggacttgaggatcaagacacttctccctgcttgtcttcacatcctttgctttatctggcttctccagttgtaacaatatgtagataaaccaggacttctaaatcaggggtctggatcttcaagtatctggatgtggattcatgttttgttttttctccatcacataaacaccaaacaccaacaaataaataccttttatttttaagggacagagtctcactctgttgcccaggccagagtgcagtggtgaaatcatagctcactgcaacttggaattcttgggctcaagtgatcctgctgtctcagcctcctgaatcagctgggactacaggcaagtgccagcatgctaggtttaaaattttttttttttttgtagagatggggtcttgctatgttgcccagactggtcttgaactcctgggctcaagcgatcttcctgcctcagcctcccgaagtgctgggattatgggtatgagcctgattgtttcattttcctatgagccacccccagccccccaacagaaggttggttttaataaagatttatcttctagtaaagttgggtaaggcagtagactgtgtcttagtagcttatttccagcagttttggatttcttagaaatcctcaggatagggaggtgttttacccaaaccacaatagatttctggctcaatttgtgttggaaatagtaataactaaattgttcaaatggagaatgtatttaataaaggtgaaaaagtatggcatttcttcagggaagagttcatttgtttgtttgacagatatgggggagattttatttacatttccacttttatggccaggagtgtaggttatattactgttattcatttaaaaatacattaattctacatttattggggattgattgtagtttttttttttttttttttttttttttttgagacacagtctcactctgtcacccaggctggagtgcagtggtgcgatctcggctcactgcaacctctgcctccctggttcaagcgattctcctgcctcagccttccgagtaactgggactacaggcatgtgccaccatgcctggctaattttttgtatttttagtagagacgaggtttcactgtgttagccaggttggtcttgaactcctgacctcgtgacctgcctgcctcggcctcccaaagtgctaggattataggcgtgagccaccgtgcccagcgattatgggctttttttttttttttggtgaataatagacctttagaaaaagtatttctgctacactttgcagagttctgggaaggtgtatcaatgcctttctagtagtgagattcaaaagattgcttgtcactgttaccactgtcactgcctctaccactatcagcatcattgccatcagctccatagtgattagaactatgttcctaatcttatcttcctttgcataaagagttagttaaataaacataactggcaaaacgtagtaaaagttcagcaggtaataattaccagaggaaagaagatggcacagctattggcatttaaaatcaagtcagattactgttttgggtggagagtgagtctgtccctttgtctcttcccatattttttttctctttccttactgtgaaaggagttccttgccaaatcaagaaaaaagaaattaagaacattttgagaactgtcctctcatctgttaaggcatataaaataatttaattttcgtgatgtccttgaaaccataatttctgttttattttcccttctcttgctacaatttgacattttcatttgtaaactttcagtagttttcctgaacaagagtcacttcaagtaataaagaatataacctttctccctcattaatgaattcatcatcattagtttcatgtaaacctgatttaagaaaaaatgctagaggctgagtgcagtggctcacaaccgtaatcccagagcttgggaggctgaggtgggaggattgcttgagcccaggagtttgagaccagcctggacaacacagtgaaattctatctcaaaaacaaaaacaaaagaacccttaaaaccaaaaactcccaaaaacctaaactgaaaatgcctactgaaattttgggaactctgcatgggcgtctccaggtgagtgcctgctggtttgggggcaccattttttaaatgctgccaatcctacttccatcttcccattgagttactggggtggaatgtgctctataaatgtgtctgtaactcgctttttctttttgccctaaaatcctggagagttaatggagtgttaacctttttttaaagattttttaaaaaatctattttttcctttgttgtctttctcacattgactatgatatattttattttccatcttggctcagtaagggtgggaaatttttaaaaattgagatattagctgaaaaacttaaaaaatcatccaatttggtttggatggttttctggtggaaacaaagctcctgaacatgcatttcatgcctcgtagataaaaatcagtcccatggtctttatgaaagtagattaattagtgtagtgtgtgggcagatctcccagagcaggttttcacaggcagctttgccaacataactcagtctgaacctgcagttatgttagaattatttttaaagggtgtaggcttttcattcacacatcgtctttgttcttgtgtgtgatgtatattaacaggtaggtggtacctgagaataaaggaccacagcataatcacgatgtgcctgggctctggagcctggctacctgggcacaggtgctggccattccacttagtggttgtgtggctgtgggcagtcatgatctcactaggcttcagtttcatcatctgaaaaatagtggtttctgccttatacaattatatggatattgtgaggattaaatgaggtaacatattcaaggcacttaacacaaaggaattattcaagaaaatggtagctattgttactagaagagagtagcaacagtttatgtcaaaggcaattattaatcacctattgtgacaatcttgaaccgggaactctataaaagacacatccctaggaggggattggaagggatttaacatattaaatatccagtttcctcatagtgccaaggactttatgcactatatttaattttaacaacttgatgaagtagatactcttgtcttcattttggaggtgaggaaattgaggcaaagagagaagaattagtttttctgagttaacccagttagtaaatggtgaagcctgaatttgaagttagttgtatctgaggtccagagaccataaggttttctattgctgggaagagagtgaagtatttttatttccttgattttgggatattgatgcaatgttgcagttgtcttccactaaaatcattttcacatttgcttgcagtagatagacctggatctaatgaaatctaatttgaatcgaaagaattacaaaatgaaatgccagctctcctcttaatttactttcagcctcatagagttttggagctggaggggacctcaaagataagcaaattcaatagcctaatatatggctgggagactgaggtgaggcatgggatctggggattttcccaaggtcaaatcacttattggtggcagagctggaaacagattgcagtttcccaaatttgcagtccagtgctatttccagtatactctacgaaagtttcctaacatatggagagctgagcttaagacctaagatatatttacaaatgctgattcttctgatatggaagaaaataaggctaactaaggagtttaaaaatgcttacttgcatactgtgaaagtttcttattttagctcaaggtggagttgctctttatgcactatttgttctgtataaggggtgggggctgggttagaagcttcatagaccttttaaaaactaaattctgttgctttgtttctcagagtccaaattgtatttattaaaaaggctgattcatggcctccctcaagacatgggtaagaatcaagaatctcagctgggtgtggtggctcacgcctataatcccagcactttgggaagccaaggtaggtggatcacttgaggccagaagttcgagaccagcctggccaacatggtgaaaccccgtctctaccaaaaacacaaaaattagccaggtgtggtggtgggcgcctatagtcccagttacttgggaggctgaggcaggagaatcgcttgaacccaggaggcagaggctgcagtgagattgtaccagtgcactccagcctgggtgacagagcaagactccatctcaaaaaaaaaaaaaaaaagagaatctaacctttatgttccaccatgaccacaggtgattcttagtcacattagaatgagaacaactgccctttggtatctcacaaattgtactcgaccaaatactggaaagctcgagggtgagtagcatgcccctgcaagcctgtgatgattcatggcggcggagggaaggctcctcgtggactttcatgtttgcttttaagcaaccctcaaccctaagcgctggtgttcattttcagccgcagagaaacatgacttggggtttgattgtgaatcaacgattgggtgaagttaaaagtgaacacactgattctttaaactccaagttaaacatgtgctgctcctcttctagcactggatgagtcactgtcctagtgactcactgaaggattgtggtggaaatagaaaacagatcccataagaatttgggctgggttactgttgatcctttatgtcctgtgaagagggctttataatgctgaaactagttgtttccccacagacatttcttctcattaatgtattatttattgattatttgctgtatgtgaaacatgaatgaatggggagtggggaataagagaaaggaaggcactggaggacattcagaggtcccagaaggataatataatattaaaagtgcagaaggctagaggagtttttattttttgtataaaaaatacaatgcggtttgtaaatagtgcttcttgtatgtgagcctgtgcctggtactattatcttttacttccagagctatacagatgtccattcataaatgtcccacctctgctgacatatttggcctttggagggaacagttacttcacgtactagagacgggaagggtgtgccggaggaaagagctgctggctggtgtggcagttatgaaaaggagataggggtttgtgtatatattttctaaaaagatgtttcattctgctttggatatgagtttggggagacatccaggtggagatgtccagcagatagttttgaaattgcagctggggagagagatttaggcattattttcatagaggcagacaatattttgaagtcctggaaatacataagatgcacaagagagacagagctcatggaaagaacaagtcttttgagagaagcttggaaagaggaaaataagttaatgaagggaaaaagaccagacacagtggctcatgcctgtaatcccagcaacttgggaggctgaggtgagcagatcgcttgagctcaagagtttgaaatcagcctggacaacatattggaacctcatctctactaaaaataaaaaaaaggtagctggacgtggtgacatgtgcttgtagtcccagctactcaggaggctcaggcaggaggatttcttgagctacagttatagtgccgttgtactctagcctgggtaacaaagcatggccctgtctcaagaaaaagaaaagaaaagaaaagaaaagaaaagaatagaatagacaacgagcaatcagagaagggtaaattgaaaatgtctcagaagccaagggaagaagaagttccaagaaggaaggtttaatagttaataatcaattctctcaggtcagagaagaggaggacagaggaaagaacattggtgacgcttaagtaaatggctttaagttgaatgttggaagcaaaagcaaatttgagggaataaatggatggtgaaaaatataatcaaaatttattctttccagaagtttggtagttgaaaggagagaggtggacggtctctcaaaaggcacattagaaaggtgaaagtggttaaggcaaaggagagggtggataattcctgggttagaagtggtgagatcagtattggggcagaggcaagtggattatccttaaaaaaccctcatactttcttctttgaagaaagaaagaaatagaagagaatcattaaggaaagaaatattttgaggtatgaaattgagatgaagaataaaattgaaatacagttttaggaaaacttatttaccgacttgtaaattgcacagatctggccaccactttataggaaatgggggtaaaagttaaaagtagtggcagaccagaatgagaaacacaggactggagatcttccctggtggtgccctaaactgggtcaccgctggattgtaggaaattagaatacaggggcaggaagtcatatttgtatctgggagagctaacacagggaggagagagaagaggaaagggctgtttacgatgaagatatgcctcagttgaagctcgagaggactgggtggagttactttattactgccatggttgtcagtgaatttgtaattcactcttagtgtgggccaagatgaccaaggtgcaatgataaaacttgtctaggaggattaaagtggatcttggtcttgctctatctctttcactcttcacttacctcggagaattctatgaggagactttcttccgttgcaaggctcagggtgaaattggtcaaagatttggtggagggggtagcagtaggtaggtagatgacaggtctataggttgttagttctgaagaaacgattcataaattaaaatccgaaaaccagactggtaaagagcttggaaataaatgaagaggaaaatttttaaagaacacctagtagctcccttttggcagggctgtgttaggaatttacatttatgaaaatatagctggcagaaatgatttagtattacaaacttaagtttcactgcaatatatgttaaagctcctcaggaatatagataagacagggaatttattattctgagcaattcaaatttattcagcaccaaattgcctatggcacaatgctgggtgacataaatatttggtgaccacatgaggttcctgtgcctgtgctcttcgcagggaagcagagtaggcttcatttgatgtgtcctcccacgttgattatagaggcttgttcgggtgccgtgttgacagtttcaaagtcaagcgtgggtttactggactagagaactggatgaattagctgtgtctgccatggccatgggagttggggagtgtggtatgaatgctgcgaaggattctgtagcccatccataaactttatttatggatcagttgaagaggaatggtctaagaggaacggttatctacgtagctacataggggcttgaggtagtaacaacatggataagagagaacagacgaaagagtgggtgtatccaaatagtaaatgagagtggagtaagctacagaggaggaacaaggagggaagggatatgaggttatgtttgcactactgttttggaaggaatagctgggtctgtcctgcactgtttgggaggcacagtgggttagaatgggtgctcaggaaccacactgaaattgaaccctagcatcacctaatagtagtacccacctcgtagcattgttgagaggattaaatgagataatacttaagagctgtatcatccaatatggtagctactaaccacatgtggtttttgagcacttgaaatgtggctcatacaaattgagatgtgccaggagtataaaatacataatggattttgaatacttagttccaagaaatgcaataaaacttatgattttaaaataatgatttcatgttcaatgttaatattttggacatattgagttaaataaaatatgttattaaaagtaatgtcacccaattttttctttttttggcacataaaagacacctaatttaataaatattagttattattttctcttttattatgcagttaagaactttgatttaaaattgttatctttatatatatatatatatatatatatatatatatatatatatatatatttattatactttatgtcctagggtacatgtgcacaacatgcaggtttgttacatatgtatacatgtgccatgttggtgtgctgcacccattaacgcgtcacttacattaggtgtatctcctaatactatcccttcccccttcccccatcccacgacaggccccggtgtgtgatgttccccgtcctgtgtccaagtgttctcattgttcaattcccacctatgagtgagaacatgcggtgtttggttttttgtccttgcgatagtttgctgagaatgatggtttccagcttcatccatgtccctacaaaggacatgaactcatcattttttatggctgcattgtattccatggtgtatatgtgccacaatttcttaatccagtctgttgttgttggacatttgggttggttccaagtctttgctattgtgaataatgcctcaataaacatacgtgtgcatgtgtctttatagcagcatgatttatagtcctttgggtatatacccagtaatgggatggctgggtcaaatggtatttctagttatagatccctgaggaatcaccaccctgtcttccacaatggttgaactagtttacagtcccaccaacagtgtaaaagtgttcctatttctccacatcctctccagtacctgttgtttcctgactttttaatgatcgccattctaactggtgtgagatggtatctcattgtggttttgatttgcatttctctgatggccagtgatgatgagcatttttccatgtgttttttggctgcacaaatgtcttcttttgagaagtgtgtgttcatatcctttgcccacttgttgatggggttgtttgttttttttcttgtaaatttgtttgacttctttgtagattctggatattagccctttgtcagatgagtaggttgcaaaaatgttctcccattctgtaggctgcctgttcactctgatggtagtttcttttgctgtgcagaagctctttagtttaattagatcccatttgtcaattttggcttttgttgctattgcttttggtgttttagacatgaagtccttccccatgcctgtgtcctgaatggtattgcctaggttttcttctagggtttttatggttttaggtctaacatttaagtctttaatccatcttgaattaatttttgtataaggtgtaaggaagggatccagtttcagctttctacatatggctagccagttttcccagcaccatttattaaatagggaatcctttccccatttcttgtttgtgtcaggtttgtcaaagatcagatagttgtagatgtgtggcattatttctgagggctctattgtgttccattggtctatatctctgttttggtaccagtaccatgctgttttggttactgtagcctcgtagtatagtttgaagtcaggtagcatgatgcctccagctttgttcttttggcttaggattgacttggcaatgtgagttgttttttggttccgtatgaactttaaagtagttttttccagttctgtgaagaaagtcattggtagcttgatggggatggcattgaatctataaattaccttgggcagtatggccattttcctgataccaaagcctggcagagacacaacaaaaaaagagaattttaggccaatatccctgatgaacatcgatgcaaaaatcttcaataaaataccggcaaaccaaatccagcagcacatcaaaaagcttatccaccatgatcaagtgggcttcatccctgggatgcaaggctggttcaacatatgaaaatcaataaacgtaatccagcatataaacagaaccaaagacaaaaaccacatgattatctcaacagatgcagaaaaggcctttgacaaaattcaacagcgcttcatgctaaaaactctcaataaattaggtattgatgggacatatctaaaaataataagagctattcatgacaaacccacagccaatatcatactgaatgggcaaaaactggaagcattccctttgaaaactggcacaagacagggatgtcctctctcaccactcctattcaacatagtgttggaggttctggctagggcaatcaggcaggagaaagaaataaaaggtattcaattaggaaaagaggaagtcaaattgtccctgtttgtagatgacatgattgtatatctagaaaaccccattgtctcagcccaaaatctccttaagctgataagcaacttcagcaaagtctcaggatacaaaatcaatgtgcaaaaatcaccagcattcttatacaccaataacagacaaacagagagccaaatcatgagtgaactcccattcacaattgcttcaaagagaataaaatacctaggaatccaacttacaagggatgtgaaggacctcttcaaggagaactacaaaccactgctcaacgaaataaaggaggacacaaacaaatggaagaacattccatgctcatgggtaggaagaatcaatatcttgaaaatggccatactgcccaattttttctattttttttttagtgcacatctttaaaacatttatcacaatgcttggtacatagaagacaccgagggaatgttaactatgttgtacctggtgtttctcagtatcagatattaatactgatgcctgaccacaagcctgtggcatgagtccaagtctccctgctgatgactcattttggcttaggtagatcttcacccttatcccttatcccttgaggaagaagaaaatctccctaaagagagccacaggggtcggcaaaatttctgtaaagggccagatgttaagcatgtaggttttgccaaccttcaggtctttattacagctgctcaactctgcctttatagctcggaagcagctgtagacggttcataaacaaaagagcatggttgtgtaccagcagaactttatttatggatgctgaaattttgagttcatataatttttacttatcatgaaatattcttcttcttttgatattccccccagctatttagaaatgcaaacccattcttagttcatgaactgtacaaaaaacaggcgtgggccagactggatctgtaggctgtggattgctgaccctgccattaaaaatgccctgtacatttagcagccaagaaccttgcttgactctgggtttttcatttgtacttaacctaacatttgctttatagtgtaccattttatttattttacttttagtaggtttgtgtttgacctgcttttttttttactcaatgtttgtgtttaacctgcttttttttagacaatggaacaaaactttgtttatgaaactcaaatttattaagatatttgtaagcaaagggaaataagagagaaaaatataaaaggagtatgtaagggaccaaaggagattttttgtttggttttgttctgctcagaatacttgtgttttctgtgtagactgaatttacccaatagtttttttgccttaaagtgacattaaactgtgaagcagaaacattgtatttttaaaatcgtactttaagtttttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaattttttttttgtatttttagtagagacggggtttcaccgttttagccgggatggtctcgatctcttgacctcgtgatccgcccgcctcggcctcccaaagtgctgggattacaggcgtgagccaccgcgcccggcctaagtttttaaaatattttatttttatagatttagggggtacatgtgcagttttcttacatggatattttgggtagtggtggagtctgggcttttagtataaacatcagccaaatagtgtatgttgtatccattaagtcatttcttatcccttacctccctgccatatgaatctccaatgtctattatttcactctctaaaaaatattgtattttatacaaaaattagccgggtatggtggcgcatgcctctaatcccagctactggggggctgaggcaggaggattgcttgaacctggaaagcggaggttgtagtgagccgagatcatgccactgcactccagcctgggcaacgaagcgagactccgtctcaaaaaaaaaaaaattgtattttaaagttttgttttccatgaatttgtggggggaaaacccttatttcttaccttatctgttgatcaaagaaactgctgaagaatgaggaaaaaaatttagtaacttgataaagagatcaaaattttcagctaaaaaagtgataataaatttattattgcataagactgagtagcaaaaggctgccaaaaataattaagcagcaaacactaagtcaggcatatatatatatctagtggaaaatccactttttttttcatagagagtatttctgtacctagttggatttccggttacacactactccttcccttcaatgattttccaaagttatttggtgaggacagatgtcagaagaggcagcatataatggtattacagagtatgtttaaaaagttaaggaaaggttagtttttgtgtatgcttattacacaatttaaaaatagctttgactctatttgtaaatcaaatggccagttctcaggctgtgccaaatgcgaagccttcaaacaaggtttcttctgagttgcttaagcagccctgggaaggagaaagcatctgaaagggttttcagattgattgtctctggttatacacagaaatgattggagttttataaagttatctataaaaacactaagaagaaccttacataacagagtgtgtctttagttagtgatttaaaagagtgccatactgggtttcaagaggtggtgaccatttcccgtgtctgaatggagcctcgccaaaagggagaaaaatgttcacaacagtttgcaaatactatctatttaattctcaacctagcaacagcagagaaagagattattattcctctctcatctatgctgcccccactctcctccccgctgcccccgattttatgttttggttgtgtaaattattgctaaatgaatagaactttcaaataagtcctatgctaggacttcataagtgcctaggaaattccaagctgtatttgtaaatttaaagggaagatcagcagaaaaaaatgtcaagtacttaaaatcgactttttattaaggacgcatgagaccagtgagtaggccttagattggatgtgtccacatatcctctgagtcgctccctggatccagcaagaaataggggtgggtgggacatctttgtccctacaccatagcgttggggaagagtctttgtattttgtatttttattttttttttaatagagatggggtcacacgatgttgcccaggctggtcttgaactccttgcctcaagggatccttctgcctcagccctcccaaagtgctggtattataggcgtgagctgccacacctggcctgggtaggacttctgtttctagctctgtatctttcttgcatctgtgaacagataaggtcatgtgtctgagcagtaggacccaggcatgcagttgaactgctcgtccaacttctctctggtgagagaattcctcaaagatttgacttcattcagagctgcattaaaaacaaaagacaaaacaaaaaacacttctactatgaaatgagatttcctgcacttcaaatctgtttagcttgttttgaagtgccagaatgcttggcctccaattagtcaatctccgagagcctcatttggattgtagactcccaactgtttttttactttctccttgctgatgtcattggataaaaataaattaccacccctcccccgtcgttcttcatctttgtaaatttgctgccggtgggtggtagctggtatcagaccagggcaggaaggaagcacattgcttcctccagttatggagctagcataatagtcaacccctgatgatttatcttaatacaatgaaaaataagtaactctcaataatggagggtgctggtttgttggggcgaagctcactgcagtttgtttctattttattccaatgtgggacattgtggtggatgctgtgttttagggcccagatcgctctttagggatgaaggactttttcccgaaagctgctaggagtgttgtgcccgactgccttcagagccagttgtctctgatgatcgtatcagctagagaattgccttgcccatggtggcctccctcctggggatggcctgtattatgtgactgattgacgtggggtatgaaggtctggccctttcgccccagttcaggacaactctcactggccctgactgcttctgagctgccctggtggatgcctctttggagcctgcattgcagccccactgctctctcccctagtgcagtttccccctttcccttctgcaggtgctgatccaccgaatactccttagtaaacctcctgcattgtaattaccgtctcagagttggctactgtttaactttcctttgaagaggaatgtttcagatcttggaatcaacttcaaacatgtcaaaactgtgtagtgtgaagaattgacatgagttgggaaagtctttcgtttttatatccttttcagagttcttgtatgacacaaaatattttagagttagctccgctactgcagtgcttggagtataactctaagtttcttctaagagaaacttcatggaagaagaatccacaggttttggtgagtgataaacttagagttgaggagagaaaagagttcaagatgattgagattttgaacatccatgattgaggaagtggtgatagcaacatatacaaacaggctatacaggcagtggaacttttactataatcaaagatatgtataatgaaaacaatggtgaggcacaaggctgggtccagtggctcacgcctgtaatcccagcactttgggaggctgaggcgggcagatcacttgaggtcaggagttcgagaccagcctggccaacatggcacaaccctgtctctactaaaaacacaaaaaattagccagctgtgatggtgcttgcctgtagtcccagctacatgggaggctgaggcatgagaatctcttgaacccgggaggtggaggttgcagtgagctgagatcgtgccactgcactccagcctgggtgacagagcaagactctgtctcaaaaacaaacaaaaaaccagtgatgaggcacggtgactcacatctgtaatcctagggccttgggaagtcaaggtgggaggatcactcgagcctaggagtttgagagcagcctgggcaacataatgagcccccatttctacaaaaaagtaaaaaaaattagccaggcatggtggcctgtgcttgtagtcctagttactggggaggctgaggcaggaagatcgcttgagtccaggagtttggggtggcagtgagctatgattgcaccactgtactccagcctgggtgacagagtgagaccctgtctccaaaaaaaaaaaaaaaaaaggtatgtataataaaaccaactatacaactgattctttttttaatttttaattgttgtggatacatagaagatgtatatatttacagggtacatgagatactttgaaacaggcatgcaatgtcaacaaccacatcatagtaactggggtatccgttccctcaagcatttgtcctttgtgttacaaacaatccagttatactattttagttatttaaaaatgtacaatcaaattgttattgactacagtcctcctgttgtgctatcaaatactaggtcttattcatttttctaactattttttgtgcccattaaccatcctcacttgctccctaacccttcactactctccctagcctctggtaaccatccttctacactcttatctccattattagttaaattgttttaatttttagctaccacaaataagtgagaacatgcaaagtttgtctttctgtgtttgggttatttcacttaacataatgaccttcagttccatccatgttgttgcaaatgacaggatctcattcatttttatggctgagtagtacttaattgtgtacatgtaccacattttctttatccattcatttgttgatggacacttaggttgcttccaaatcttagctattatgaacagtggtgtaacaaacatgggagtgcagatagctctttgatatactgatttcctttcttttgggtatatactcagcagtgggattgctagattgtatggtagctctatttttagttttatgaggaacctccaaactgttctccatagtggttgtgctaattttcatttccatcaacagtgtatgagggttccctttcctccacatcctcatcagcatttgttactgcctgtcttttggataaaagccattttaactggggcgagatgatatctcattgtagttttgatttgcatttctctaatgatcaatggtgttgagagggccttttcatatacctgtttgccatttgtatgtcttctttcgagaaatgtctattcagatcgttttcccatttttaattggattattagattttttcctgtagagttatttgagttccttatgtgttttggttattaatcccttgtgagatgagtagttacaaagattttctctcattctgagttgtatcttcattttgttgattgtttcctttattgcgcagaagctttttaacttgacgtgatcccatttgtcgatttttgctttggttgcctgtgcttgtgggatattgctcaagaaatctttgcccagttcagtgtcctggagagtccctccaaagttttcttttagtagtttcacagttttaggttttaggtttaagtctttaatccattttgatttgattttagtgtatggtgagagacagggtctagtttcattcttctgcatatgtacatccagatttcctagcaccatttattgaagagactatcttttcctcaatatatgttcttggcacctttgtcaaaaatgagttcactgtaggtgtatggatttgtttctggcttctctattgtgttccattggtcgtgtgtctgtttttatgccaatatcatactgttttggttactatagctctgtagcataatttgaagtcaggtaatgtgattcctcctttttttttttctttctcagtatggctttggctattctgggtctttggtggttccataaaaattttaggattttttttctatttctgtgaagaatgccattggtattttgatagagattgcattaaatctatagattgctttaggcagcatggacattttaacaatattgataatttcaatccgtgaacatggaatatcttttcatttttttggtgtcatcttcaatttttttcatcagtgttttatacttttcattgtacagatttttcacttctttgatcaagttaatgcctgggtatttaactttatttgctgctattgtaaatgggattactttcttgatttctttttcagattgttcactgctggcatatagaaattctactgattcttttttttttttttttttttttttttgagatggagtctcgctctgtcacccaggctggagtgcagtggcgcaatctcggctcactgcaaactccgcctcccgggttcagggcattctcctacctcagacttccaagtagctgggactacaggcgcctgcaaccacgcccggctaattttttgtatttttagtagagacggggtttcaccgtgttaaccaggacggtctcgatctcctgacctcgtgatccgcccacctcggcctcccaaagtgctgggattacaggcgtgagccaccgcgcctggcttctactgattcttgtatgttgattttgtatcctgcaactagactgagtttatcagttctaatcgtgttttggtggcatctttaggtttttccaaatataagatcatattggctgggcgtggtgactcatgcctgtaatcccagcactttgggaggtggaggagggccagatcacttgagcctgggagtctgagaccagcctgggcaacatagggagaccctgtgtctatttatctttaaaaagtaaattaattaaaaatattatatcatctgcgaacaaaaataatttgacttcttcctttccaatttgcctgcccttcatttctttctcttgtctgattgccctagctaggacttccagtactatgttgagtaacagtggtgaaagtgggcattcttgtcgtcttcctgatcttagaggaaaggctttcagtttttccccatttagtatcatactagctgtgggtctgtcatatatggctttttttatgttgaggtgtgttccttctatatgcagtttttttgagggtttttatcatgaagaggtgctgaattttatcaaatttttttaaattatcaattgaaatgatcatgtagtttttgcccttcattctgttgatatgatgtatcacattgattgatgtgcatacaactttttttttttttatattcagagtcagtgcagagcagtggtttagagctcaggcccatgagtcaggtggttagggtcagaagcttggccccactactttttgtctgtgtgaccctgggaaagtcatttcacatgtctatgtctcagtgttctcatttgtaaaataagggtaataatacttaatagtattgttgtgagctttaaactcaatgtatgtaatgctttagaacactctgtaagtggtatgtactattattattattttattcatataactaaaaaattgtattctgtctgatctgttggttgtttcattgttgctaaacacaaatttaagtcttctatccccgtgaccagttctgtccaatacaagtataagtcaactacataagttattggcaattttctagtagccgcactaaaaaagaaagagaaacaggtgaaattaattgtaataatatattttatttaacccaataatttacaagtattattagttcagcatttaatcactataaaattattgacatgacattttacatttttttggttgtaagtctcagaaatatggggtgtattttacacttgctgcttatttcagtggctcaatagccacatgtatttagaggctcctgtatgtgactgagcagctttaaagagttgctagttaatcttgctcatttctgaagtgttccagtcaactgttgctgtgaaataagccgcccccagatttagtagattaaaacaacaatggtttattatttctcacaattctcatttagcctatacatgctagattgatgattattgccattatttttgtgatagttgtgaattccatgatagtttttgaattccacgattccttctacatttattagttggaattctgtggtaaggaataactctttcttctctttcactcagtcatatatttaattgtacatcagcatgaactcatagattcttgttgtattcagtaggttgtaacccattatttattttattattcaagtgatctgaccataatattttaaattaagaaaacaccctctccacacatgctcaggtacctgatgagatcagaacaaattctgctacatggatggtattctcaattccatcccccaacacccccgtattgcaatgtttaaatgtttcagcccaaatatttcacagggtctgcttgcagagccccatgcttctcttcaacaaatgtttttacaggacaaaatttgtccagtaaattgtctctatttatggttcctttgaaagttttaccaagtttacttgctgaaatatcctagggcttttcaatttcacttcaattcagtatagaatataataagtctttcccattaaaagtaagcttaatgaacagaagtttcttcctacaaggtaagatactcccaaagtataactggtgtatatccaaagatatgaaatcagtatgttgaagagatagctgcacccccacatccactgcagcattattcccaatatctaagatatggaatcgatgtcagtgtccatcaatggataaatggataaagaaagtgtggtatatatacgtaatggaacactattcagccattttttttaacaaaaaaaatgtaaaaagaaggaggtcttgtcattttcagtgacatggatgaacttggaggacattatgttaagtgaaataagccaagcacagaaaaacaaatattgcatgatctcacttatatgtggaaggtaaaaaaagatgaactcatagaaacaaagggtaaaatggcagttaccagaagtgaaaggaatggggagatgttggtcaatagacacaaaatttcagttatacgggaggaataatttcaagagatctagtgtacagcatggtgactatggttaatatcaacatattgtatacttaaaaattgcttagagtagattttaattgttcctttccacaagtagttatgtgaggtaaggcacatgttaaatagtgtggtttagccattccataagttatacctcattccataaggtatacatctatcatctatatgtcgcataccataaatatattcaattattacttgtcaattaaaaaaagaataaaacattttcagagttaatttatgtgcacattaaacccatcctagaataatattttgctaaccaaaaaaagatccaggacaaatgctaaatcaggatgctggaataacagcgtcaactgggataatcctggtgaggcctcatcttgtccaaagacccccttttgattgggccaggcctcctggctactgctgtctttctggctgtggtctttgctcacccagctctttggtttggtagactcaggttgatctccactgctttgcatttgctgctcttttgcctgtaacattgtacccctccttgctcatatggctaatttctccatatcctacaaccttagacactggcatcgttttctctaggtgccttcccttcatccctccaatgtgctccttgtcctacctgtactatgtatatctgttccacgatacttccttcttcacctttttgaaacaccatgttcaatatcctgttatttaagagtcttgctctttgcttcctatgataacagttattagaggaactgatctgtgctaggtggtaagtgatggtgatgaattacttatctgttcctgaaaacatacttgtatttcatggaggcccactggggtggtagtcttcaaagtgagtgtgcacacgtctaagagtatatgagaccatttataaggatggaagtagaaaatgtagtaatttttatttcttttttttttttttttgagacagtatctccctctgtagcccaggctggagtgcagtggcacgatcttggctcgctgcaagctctgcctcctgggttcacaccattctcctgcctcagcctcccgagtagctaggactacaggcgcctgccaccacacccggctaatttttggtatttttagtagagatggggtttcaccatgttagccaggatggtctcaatctcctgacctcatgatccacccgcctcggcctcccaaagtgctgggattacaggcatgagccacccacgcccggccagtaatttttatttctattattttattaagcaaagctaagaagttaaagtgtttctctttttctttttattgatttatttatttatttttgagacagagtcttgctctgttgcccaggctgtagtgcagtgatgtgatctcagctcactgcaacctccacctcctgggttcaagcaatcctccttcctcagcttcccaagtagctgggactacaggcgtgccactatgcctggctaatttttgtagtttttagtggagatggggttttgccatgttggccaggctggtctctaactcctgacttcaggtgttctgtctgcctcagtctcccaaagtgctgggattataggtgtgagccactgtgcctggctataaagtttttctaatgtttaatattttggttgagaaaatacatgtatataattttataaatctaatttgacattggtaaggtatactaagtatttttattgatggagtactctatcataaaaatttgaagactacgtctataggggcatatgacatcctcaatggaaaactcttcaagctttttgacactataatagctaacatatttcaagtgttttctatgtgtcacgcactgttctatatgctttacaggtatcaacatacgtattccttataaccacctcatgagattgatatgattattagcatcctcatcttatggatgaaaaaaattgagctagagaatcaggtaatttgttcaaggacagggccagtacatatcaaattcttgatgtggtctgattccagatgctgctagcttaacccctgctgtgtactgtgctgtgctctggtgcctctgctctcacatgatagacccatttggcttcctggaggagagggaccacatctgtcttgcacattgtgctagtttttacggggcctattatttccttctctctctttaaaatcatcttttgctccattttatttcccaagggcctgccatcttcgataggaactttggacaagttctcttttatttttaacatgaaaccatttttccccttgaaataaatggatctgatgagaaattggcatgagtttaattagcagtcctatgtatagaaactttacacgaaaaaagtctgcatcaccccagtactcacgagtcagttatgagtcccagctcacccctgacatgactaatgccttcctttcttcctttatcacgagggtatgaggacaagaaataaacctcagactacttctgtacagcgtgtgaagtgtcccgcaagcacgtataaccttaaaatagcaacaagggcagcagcaacaacgacaacaaaaatgataatggcaaagagaagcagaacctaatgttttttgggtttgcccactgatacccttttaatcctgatttttaattgtttggcacaaagatatgtaataatttcttgggtcttctgggcatttaaatgtcattttggtttcaccaaatgtatttatgattccacctacacatgtaagagtattgggagagttttggaaggtttgtattctatcatcatattcaaattgtgctaactctgttttctttcctgttttccttgtaggctcttttaagacacttactcttccatcagtaagtatccatttaaaaaatttggtttcagaaatatattgtatcagtgaactaaataaattaatattttattggattttatgtcaattcacacatttcacgtttcatgtaagtttggcttgagtttagttcagccttcagattatttatgaataatattatttcaaggagattgattatgaggctcttcaaactcttggcagagattttcctcttgtaaaatagaagacttcactgaaggaaactggcctggactattagcacagaaatctggactggtcataaaaaggaacgagaccatgtcctttgcaggaacatggatggagctggaggccattatctttagcaaactaaaataggaacagaaaactaaacaccacatgttctcacttataagtgggagctgaatgatgagaacacatggacacatagaggggaacaacacacactggggcctactggagggtagagggagggaggagggagaggagcaggaaaaatagctaatgggttctaggtttagcaactgggtgatgaaataatctgtgcgacaacccccatgacacaagtttacctatgtaacaaacctgcacttgtacccctgaacttaaaataaaagttaaaaaaaaacaaggcatctgggctggtttgctcctgcttctgtcgtaatgagccttctagtgtggaactctgctcctcagtttccttgtgcttgaaaagagcagtgccatgctgagacatactagaacttgaggcaaaaggaaaaatcagtaatattgaccctgtctttgtttaaaacttcgacttctttgtttataattttttgcattaattttgatattttaaaatattgtattaaaatattattttcttgattgctaaattttttggtacccccttaaattttgcaccttagacaagtgcctcactcacctcaccatagccctggccttggaaaagagaatgaagataccatctttatctcacagcatgtcctggagtgaaatgagatgtggaagtgttgtagcacttgctatagaaatggaaaggagttattattttgttgagagattcataaaaccttattattaaatgtttgtggatgaatcttcctatagctttgatttggaagtttatactttcattactatgctttgttttggggctttacatgcttaatgtacagtatagtaaaccacagcatccaacatcaggtgcagtttgatatatgtacttttctgagaacagaggactaatgacttaggccctgacacactgtatacctgattagtatcagcattacctcataagccaggttcgctcattaccttaaatttttttttttttttttttgagacaggtcttggtctgttgcccgggctggagttcagtggcacaatcatggctcactgcagcctcaatctcccaggttcaagcaatcttctcacctcagcctcccgactactggcatgtgccaccatgcctggctgattttttattttttgtagaaacaggtttccctatgttgcccaggcttgtctcaaactcctgggcccaagcatccctcctgccttggtcccccaaagtgctgggattacaggagtgaaccaccatgcctggcccacttagtaccttttgaaagttacttgtcaagtacattcagaaaccacatttattttggggggttcatagagaatattatactctcaaacaatactttataaaaattacttagtatgctatatctattctgtttgttacatattatatttgtactttctttcctaagaaatatactgctgctaataatagaaagtggaagaaaaaaggcataagcaggcagaagtgggggaaaaaaaccctgcaatctttgtggcaataaaacattagattgcattaaaataacctaaaacattagatactggccccagtgcctgggcgcagaactttgttgaaagggtattccagtggtaagatgaaaataaatcctgtgtcgtatatttgccctatagcagaaggagggtggggtttaagctcaggaatcacagcctaaagcacaataattgtctggtttcctcaaaggagtttgcagtttcacataccggaagtgtagaaaggctgaaaggagaaggcggggcaagggcatgagagtttctttcaatgatactagtataaactgtacgtgtctgagctaatattaactagaaatttgtctactacacttctttttttttttttttttttttgagacagagtttctctcttgttgcccaggctggagagcagtggcgcgatctcggctcactgcaacctccgtttcccggattcaagagattctcctgcctcagcctcccgagtagctgggattacaggcatgcaccaccatgcccagctaatttttttttgtatttttagtagggacagagtttcgccatgttggtctggctggtcttgaacttccaacctcaagtaatccgcctgcctcggcctcccaaagtcctgggattacaggcgcaagccactgcgcccagcctactatacttcttttaagtcttaagtatatgaaatactaactctgacatccagtatttgtctttaatattatgtcatttcaattgtatataaatatagctattatctattgaaagctttattagagattatattttggagtgtatctctttttagtaaagcacagtatgaaagacttagaaataaagtgtatggacaaatttgataatgcttgacaaaaaaagaaggctctgcattttaatgagttttcaattaaagcagaaccaactttctttttccccagtgagaacatacctgtgaatagaaccaccttttaaagtgcacttgcattctgacacttgtaagtgtaatattttaaattatttttcaggtctttatggctttttagtgtaaaatataaatatttcaagaatgtgttaacacaaatgtgttttttatttctgatttactcattgtacttcaagacactaaaataacccccaatatgaagtaaataaaaaacataaattgagacaatataaatattgttttgtacacaatatggcagaaaaacttcttttgttctctttgtcaaatgaaggagtggttttatttgattagaaatgtttttaatgtgtaagtataattactaatatatttttaatggaaactatcatcttagatttctcaattttattttgaaaaattgtctccgttatgtttggtaactggcattattcctgaagtatatgaggataaatactattgtgttgtctcagtttccttacagcagtgaatctttcagagaaggtgaaatggctttagacagcccagattagaataagtaatccttatttattgtctagcaagaatgtttttgaatgtgcttaccttatgtatcctaggcagagagctatcatctcctcagagagtttgcatttatgtatacacgaaatagatgtgcctaagtgagagtcaacatagccaatccagaggctgattgatattctgttggtcaaagctttgggatattgtcaattcccagactcttgtcctgctttcagacagcctctcactgtgggaactgcaccttcctccagccctgtgccctctggtcaaggagtccaaaatctctgtgggtaaataattgactcctgtttaagagccatggaagtcacttatcaaggaacagctttttttccccctttcccccaccaatttcgggaacctttttcagtaactgtggccccaagacggcagaaggcaatttaccagtaaagatgcaggagcttctgttacctcatagtgtccactctgctgtgggcaggttataacccactccagatctggcacagagagagaaacttttataaaaattgcttaaagtcaataatcttttcttcagtctcattatgcgcccccattgttaaccatggagcaccgaggtctgcattgacaccacaagactctggagcaccacccagagtacgtggtgacaccccgagacatgtggtgatgccccatgcttcatacaggcacccaggtctaatgattcaccaaggcccatattgtcatctctgggtggcttgccctgggactaacactgagtctttgaggatcccaaattacctaaattttatatatggcaaggtggggtttttaacggggaaaagttaaaaaagcaaattagttaaggtaacccaaaggaacaggaagatagtcagtaatgtttcccctgagtcagtgtcagctccctgaaggaggatagagtaggaggtagaataaaatgttttcgggcatatttgcatttattttaattctctgaccctttaggctgcttgtggttaataggcttctttagctctaggcctctgtgtcattaatttgacatcagtcttcaatctagcatctgttctggggcctctgtgccactaaaaatgataaacatatcaaatcaggaagagcaatcccatcaaatatatttttaaacatgaaatatttagaaatcgatgccatttataagcatataatattctggttcctggtgtatatattttcttgtttatagtattaggaaatctgattcaaagagtctgaggactgaagtatcacttgagaaaatagaatttaagattgcaagttccaggctagactctgctctaccagggcacaggtctttggttcatgttgtatcccaagtacctagggcgtcctggtacacaaagggtgctcaataaatacttctttaggctgggcgcagtggctcacatgtataatcccatcactttgggaggccgaggtgggtggatcacttgagttcaggaattcgaaaccagcctggccaacatggtaaaaccttttctctactaaaaatacaaaaattagctaggcatggtggcgcacacctgtagtcccagctacttgggaggctgaggcaggagaatcgcttgaacccaagaggtggggttgagattgggccactgcactccagcctgggcaacagagcaagagttcgtctcaaaacaaaacaaaacaaaacaaaacacttctttattgaataaaagcaaaaattgacaccagaagtcatttgaaggtgacatactgattgtttttcctaacattttattattaacttttcaaatatacaaaaaacttgaaaatgtttcataatgaacactcctatacttgccacttagggtctaccattaacattttactatacttgctctatcatacatctatccatctacccatctttctatccatccattagttcatcttatttttaaatgtatttccaagtaaattgcagacatcaatactcttctccctaaatattgctgctgaccattttattgttgacagtggtttcttgcactttcttcatattcttaaccacattgatagcattctgatgtctgctattattggaaaatcccctttgagctatctgtagacaaaacttatttgcaaaaatgagtcaggatatagtttcgggacctcagttttaatatgaaaatcaactaaaagtcaagcatgctagttatctattgctaagtaactctaaaactttgcttcaaacaataataaattaaacttttattacttctcacagtctttgtgggtgaagaattgggaacaatatggttgggcatttctgatttggagtctcacgaggttgcaatcaagatatcagctagggctgcagtcatctgaaggcttcatcagggctaacacattctgtgaggcagctcattcactaggctgacacgtggttgttggtggttggtgggaggccctggttcctcccaatgtgggcctctccacagacttctttagtgtccttaccacaccactctggcttcctccagagtgagtgatccaagcgagaaagagagacaacagggaagaaggtattctttttctgacatagcctaattctaggatttggaaggaaatcactaagtctggggaattaggcttcaccttttgaagggactaaagtcagagaatttttggacatattttaaaattaccacatcaaagtgtgtgtgtgtgtgtgtgtgtgtagtgtgtgtgtctgaaatgattttaataagaatatccacctgagggattgttgtgaattaaaatgatatagtgcaggtaaactgctcagtatggctctggtctgctaatgctagaaggtaggacttctattgttattattattattattattattattattattattattattattttgagacaaattctcgctctgttgcccaggctggagtgcagtggcacgatctcggctcactgcaacctccatgttcaagcgattctcctgcctcagcctcccggagtagctgggactacaggcgcatgccaccacacctgggtgatttttgtagttttagtagagatggggtttcaccatgttggccaggctggtctcaaactcctgacctcaggtgatctgcctgccttggtctcccaaagtgctgggattacaggtgtgagttaacgtgcctgggaaggatttctgttattaatagtagtagtagaagtagcagcatcatcatccctaccaagactatgacacatatgcgcaagatgcattaggagaatgcatctcagaaaacaggttgagagaatatagcaagaaacaaattttgtgcagaagagcctttcatcagctgactgcctcaaatagggtgagcgtggaaaagaaggttgaaggatgttagatattctgacctgcaataactgttagggaggatgaatttgcacttggaataggaaatggcaaggtgactcctgctgagggagagcagtgggctatgtgtcccccattccaggagccctgtgatgtaactggagagcaaactgcaggaagttaaaagagggaaaacaaattaactctgatgcctgggaggggcaaattttcaacatcgcagttacttttgataatactgtgtatttactttttttattctaacttgcaattaaaacatttttgaggtaaaataatgagaccttgatgtgtgatctctttttccccccagctacctctgaacagtgcagatgagatttatgagctacgtgtaaccggacgtacccaggatgagattttattctctaatagtacccgcttatcatttgagaccaagagaatatctgtcttcattcaaacagacaaggccttatacaagccaaagcaagaagtgaagtttcgcattgttacactcttctcagattttaagccttacaaaacctctttaaacattctcattaaggtaagtgccagacagaaatgaagcaaggaattctagccatcttactaaacccctctgggaagttctgcttgtgttactgacactggaatattttagaattcacctaagataagcttccctcccaacatggaactcctctaataggaaagaaggtggtgcatgcactgggttaagagctcagcctctagagtcaacctgcttgagttccaggcctggggtcttcattgatttatacagttgtcaaacatttattaaacttctgtgttccaggcacagcgatagggcagtgaacagaagagattaagtccctgctgacactgagtttatttttcagtgggtagtaggagacagacataataaataaacatacaaatatatatttataaagggacagatatgtatgtatttgtgtgtgtgtatgagagagaaaaagggagtgagagacagagagtttgtgtttgctattttctttctttcttttttttttttgagatggagtttcactcttgttgcccaggctggagtgcaatggcacgatcttggctcactgcaacctccgcctccttggttcaagcgattctcctgcctcagcctcctgagtagctgggattataggcatgtgccaccacgtctgcctaaatttgaatttttagtagagacggggtttcaccatgttggtcaggctgacctcgtgatccacccacctcagcctcccaaagatgctgggattataggcgtgagccactgcgcccagcatgtttgttgctttctctagggttgtctgggaagactgatttgagcagagagccaaaggcagtaaaagaaaataagcccatacagagggggaagcacatggaaaggccctgagggggagcttgtttggcgcattggaggaacaacaagctggcagtgtgctggagccccggggcgaggggacaggtgctaggacatgaggtcctatacaagtaggtgggttagggtggggctcatgcagggccttattggccatgatagggactttgaaacttatgctaagtgaagtgagaattcactggagaattctgaggcaagacttgatgtaatctaacttaacatcttaaaaggatcactgtcagctctaagaagaatagatgctagatgctagctgtgtgatcctgggtaaatttattaaccttctagaacctcagtttccttatctagaaaatatgtaataataaaacctcaaaaggtttttatgaggcttaagtgagataattcaagtaaaccatttagaactgtgtctggcacatagtacatgctcactaaacgttagccattattattattttaggaaccccttttgaaaggtagtagttttgtctctgctgcttaatactctgatgatttggaggcactgtggttagcacactgagtgctttcctgtgagaatcaagttgaagacaactgagatccagctgggcctggttttctgtatttaaacggagaagaacactggacatttgatcattacttggaaatagggtgactaacatcccagtctgcctgggatgcctctgattttaaaactgaaaagtctctggtcctgggaacctccttagtctcaggacattggttactccagatattctaatgaataacatagtgtggaaggtaaagtaggccttttagtttggtatcttcctattcttagtttatttgttgttataaattaaaacaacaaaacccaatcaaataaacatgtatacatttaactttgagccaagatatatttgtagccagtatcacatttgttgccatggtgttcaatgcatattgcttgaattgaactagcattatttcagagtttgcctttggtatgtaatggaatgtttataaagcaggttgacatagtgaatagtatttctaaattcatgtcacccccctgagcagagttgaactgactccattcataccatctttcatcatttatccacatatatggagagcttactgtatgtcagaaaggatgtgtacaatagatggtttaataaatgtctggctatctctgggtgtttacattcaatgcttccttctactgcaggcaaataaaagttagcactgcataaattgcctgttctagacatcaacccagaactaaccctgctggttctggataattagtctgtgcattttcatagttctgcctgtctactctgctctagtatcttcctttgaatctttgatttgcagattctttgggctcttctgtgcagtttgggacttagcagaccacgtttggctttctggaaagggctcagagagactttcctcttattagctctggtactgatatgactctcttggccaggggaggggagtttaaactaaaattctacctggaacccaaagtgttttggaactatgagtgaggggtggccatgctcctgtctctgtacctgggaagtgatgctcaaatgtggacttaggtctagctgccttcctccttgtaacttgcagaggccaggtgggagcagtaatgtgaactctttcagctgaaaacagacatttgggccaggtttacaagtctatgatattttctacatctttcagtgtggaataattggtgtcttggcaaaacttttcagaacaaattgggacttagcctgaactggagcccctgactgagacagttgtactccttggcacagcaccacctgcaggctgatgtggagaagtgcacctgagagttaacggggcccatcttgcccagctagaaatggctgcaggatgtagctaagatactgactgtcacagcaccttcagggtgttcattgttgttcttggggactgcaggccatctttgggtgttattcattttgcatgccccaataactggtcttctcaggagggaaaggagcttcgaggccttttggcagtagaaaaaacataacctatgtctcccacgcttctggcctcctctagccaatttggcctgacacaatggaattgagtgcctctgacactgcgatggcagctggcatggctggcttctgctctgacctctccatccagaagttgttggtgctagtacgggtgaatgatcttgtaggggaacaggtgttattggcttgggggtatatcctgttattgtgccctgacactcagttttggagcagtggtggctaactcagaacctgaccgctggccaggtgaagaagctaccttatttgagtgatttgaattctctaattctacaggctggacagacatgttattcacacataatccagaaatagtcctcacagacatattctccagccagggagcttactgcttgagacaatcaggtactgtgtgctgtgttgaggcatctcagagatccagagcgatctaaaggtgactcgaagggcatgtggggccactattccaggatctctggcctgcagcttttctggctgtgacgggggtattgctcatactgtacatggctgtgtcgtagcagcagatggccgcatgcaaatgctgggctccgctgtgacatcaccatgcttggctggttcaaatcctgatgtgtcttgtagacttctggtgtttctgcattctctccctctgccttattggtaacagttagacctaggtccaagacaggcttgggaaagcagaggaattatctcattctcccccaaccctccagatcccccaggtacaaagccatcaatgaggtcagttcagacttcattgtccaggagaaatgtatgccctcactaccataatgtttcagtagaatatggacattccattttcctacacttcaggtaacaccaagaattattgttattattatttttatctttgtcagactgacagaagaaacacaatattgttttcatttgtatttccttaattactagacagcatatatttattggctatttgtatttcttcctttgttcctgagcctttgaacttcatagccctcccatgcgtcatgctgtggcaggcacagtagggccaactgcccattacaatgcctggcccaggagtttaccaaggatacagtgacctgcttgttcttgacttgcttttggtctctggttttcacaattggtttctggcttattagactgctttctgcacagttctcagcattgtacttacccctaactgtcatatctccactctgggagagaggtttcttctgttctaataactggccccactcactacttctaggcaaagtttagaggataagtctaagggaaaatattcaacccctgctctcagtcacagtctagttgggaataataaaatatagatttttggcaaaataaaatatgtaaaataaacatattttactgcctttaacaaaaatatgtattcaagagagataaactccagatatactagggactttccaggaagaagtcacctctgcctattggaggcatgtataggaggcaagaaactgaaactgatttcaccagtggacaaggaagggagggatttccatgcagcagttgcagagacctacatgcatgggctttttgggaataaactgcaaacaaatccgtatgtttggaggaagatgagcctagaaatgtagatggagtagtattagtaagggccttgtaaactaggcaaaggagtgtagacttcctgtaggcaaacaaaagccatgggtacctagtggtctagtataatcatcatatactataattagggactataaaaagtgtatagccactgctttttatatgccagggactgtgccaagtatttcaaccactgtaactcattctcagatttgcgtttcagatggatcacactgttggcagtggggaagatgtattgtagagggcaagactagagggggaagattagttgcattagttagaaaataggacatggtggctggatgtgaggatggaaagaaggagacaaattagagatatattaacctaacaaagttaaaatgtcaggaaatgtgagagaggaatctaggatgactgctggaatggcttggataaatgttgcatgaagggattgttgtttgggaggttataggaagaatgaagtgttttccatgtatatccgtgattaaacatctctctaatatgcttttgttgagttaaaaggcagacatgagtttggattctgaatttcatcatgcactggtgctgtaatattgagtcatgccagtcacttgaatgcgtacctccctctccaggcatcagttttctcaactataaagtgaggataaccatgtcctaaaggagaattgtaatgattagagataaggcagagtgcctgacacatattgggcctttaataaatggggcctgttatctctacagttaaattttcttttaacactactaccaccaccgccgccaccaggggtttggtgacgtacatgttgtagtgtttcatgtagaaggaaatagggtgccaggaattaaaaggtggagcagaatcaagatgaacttgggagaaatatgagaaaagaataaactttgatttgtcttctttagaaatatagagcctacgttttccaaaatgttcatgcagcattcatccaagccattccagcagtcatcctagattcctctctcacatttccagaccttttaactttgttaggttaatatatctctaatgtgtctccttctttccatcctcacatcctgccatccagccatatttgtgccgtattttggagtaaagttctggacctgggtgggaatgctgcaaggcattattcctaacctgataggatacacatgcacatgggcagcctctacatacttacatgtctggttttcattttaggaccccaaatcaaatttgatccaacagtggttgtcacaacaaagtgatcttggagtcatttccaaaacttttcagctatcttcccatccaatacttggtgactggtctattcaagttcaagtgaatgtgagtataaatatattttttggggggaatgttaaagtgatttaattaggtcaggtgggggaaaatctccaaagtcatttatacaatgaagagaaaaaaattaatgtgaacatttagacaatttaaacggtttatttttaatttatgatgtttatcaagggtttatttagctttcattctaacatattagaattttcataactgttgtctttttctatgatatgatgtttaaaggttaaaacattttgacattttagtacacaatgtttacttatttgtttcatgcattattttaaaactaagtaatgaacacatagctattatttggcaaattttatgccttagaataatgactcctaatgagtgattagattaacctacttttatctttgttttaagaaacagtgacttaaatagctacaccgactgctattccccaatcctttttccctagcttctacacctattgcctttacttgctgccaacttgtatagctctgaaatctaaatggagggcattaaatggcatataaatctaaatggggggcattcattggaatgaatgagacataaacacaatgggatggaaacaattttaaaaagcaatgagacttaactgttttatgtgatataaattggtcatttagtatataacatgtaaacctttatatttttctatatttatgtgacatataaacatataagatataatcaactttttctgtatctaaaggggaagatatgtaatatgaaatgcatgaaattgtagcttattctaagcattgttgctgagccttgagtaggtgggactcgtgtgtgaattgacctgtatgaatgagaacagtgctggaggcacaatggactctcaatatttgcttcatggccaccctgcatctttatgggtgtttgtatgatgtgtttaccaatattattctttttaaggtagcagaagctctaccgaatgaatgtatgatgtggttttaaagaacatttgaggcaatattatgaaaggggctcatactgttagagaacaatgtaatgcataaccattaaagtcatggacaattttcagtgaggtctttgcttatttccttacttataacagtgtaataataaccactgttataaatggcagcctagagcaggatgtgatgagttctaggggaagtggaattctttatatctgagcttgtagagaaagtggaaagagtaggcatttgtgaaacttagaaaatagggaaaaatttgtgtgggagtagggaaaatggaagagaacgttatgtgtctggggatttgggagaagttgatgttactggagcatgtggagaatgatggcggtgtagattaggaagcacgttgtgagtttaaagtagtttgaatattattttcagttcccacttaaattcttaagaatcactttttttggtccatccatccatcgatccttctatccacccacccacccaccaacccagtatgtgttaaggactttatggctgtgatgaatacaaagaaggtaaacatatgacctccattttcaaaggtcattgtcatggtgacatgaacaatatgataaaaattaaatgacataagggggacagacaaacacagggcagtgcaatagcagaggaattgtaaggtgttcagtccagcttggtgataaagagggtttattgttagcacaagcactgatgttttggggccagctgctccttctgtctcccatggtctgctctgttctcctttcactcttctgccaacctttgaggtgttcttcagttcttctgattccattagcttagctaaataaccatcatgcccagaatctttaaagcaagcctctgcacaggtggctggcagcctgtgggtgggccgccctgggtcaaggtgtccatttttggtccattcagatgccacctatgcacaatgaccagcaagagcagttttagctggataacaggcgctgagggattaatttgttcattgaatggtggacagaataagtaccagaagagagggggatagaatagcagagggagactttgcagaagatgtgagattatactttgaaagatttataggatttatcatgttgtggtttgtggacttggcttgtcatattgcttttatagaaaacaaatgctcttaaggaaatttaggtgcttaaaaaatgaaaagcatttgcaggatctggcccttgcccaacttttcagtcttgtaaagtgccgcccttcctcttgaactctatgctttagacatcttatgtcccttaagtttcttaaactcaccgatctgtctcattctagagcctttcatcatgctgttccctctgctgagaatgttttttcttccttattctcgctacttgcttttaacctgcagccattctctaaagtggcctggctgttccagacattcccatagtactgtgtgcttcccttaattcattcatctcacttttaattagtggtccatgatagacagtagcctttgtaaagctggtgaccttctggtcttgctcacctctctattcctgggaccaagttcagtgcttttgcatgtaagtagaaagcagtattttcttaaaacgaatgtgtgaaaactatatagcaataatttgtcttgaaccaaatgcaattttcccttttgtatattctataaagcatctttatctttttgaagacaagtatactgatcaggtacttgtcatttgaggtatgttaatttgaggcattcagctaagaaaaaataagccccttaaaaaaaagagcccttttagaaccaccaggggtcagtataaccaaggaaatgttatgagaagcaactgtggccttggtctctggcttttgtttttctttgactactgcgcagcattaaaggactgtatatttcttgttattaaaccccttttcttttagtagtgaataataacatagaggaaatgtatttattatttaaatagcccaccattagagactatatttttacttttcggtggcagtcaccattctcaatataaaactcagggaaggaaaatatttattttcaagaaagtattggctgggcgtggtggctcacacctgtaatcccagcactttgggaagccgaggcgggcggatcacgaggtcaggagaccgagaccatcttggctaatacagtgaaaccccgtctctactaaaaatacgaaaaattagctgggtgtggtggcgggcgcctgtagtcccagctactcgggaggctgaggcaggagaatggcgtgaacctgggaggcggagcttgcagtgagccaagatcatgccaccgctctccagcctgggcgacagagtgatactctggctaaaaaaaaaggaagtattttttaaattttttaatttgtaagagacagggttgtcgtctgtcactcaggctagagtgaagtggcacaatcatagttcactgcagcctcgaactcctgggctcaagtgatcctcctgcctcagcctcctgagtagcagggactacaggtatgtgccactacgcctgcctagttaaaaaatttttttttccttttcatagagacagggtcttgttatgttgcccaggctgatcttgagctcctggactcaagcaatccttctgccttggcctcacaaagtgctgggattacatgtgtgagccatcatacacagcctttgggagagttttgaaattccattttgtctgtagaaaaaatatggaatgatatgagtattcccactgatggacaatctctttaagaattaccggagttatcagagctttgatttgtaatgactatacaggtaatcagaaagtggtattcttcagttaccctttgtcctaggtcaggaaaaggatcctttaagtaaaacatacttgacggctccttggcatttctccacttgtattaataacatgtttgtttgtagagtaagagtgaataagtcctttatgataccgtgttaacctttctggattaatctaaattgtttgcccttcaagtattgtattgcttttcaccttcaaggttttttatgatagtaatggtgagtaattattttggtctagtatgatttctagttttcttttctttctttcttttttttttttttcgagacagagtctcgctcttttgcccaggccgtggtgtgatctcggctcactgaaacctccacatcccaggttcaagcgattctcctgcctcagcctcctgagtagctgggattacaggcatgcaccaccatgcccagctaatttttgtatttttagtagagacggtttcatcatgttggccagggtggtcttgaactccagacctcaagtgatgcaccctactcggcctcccaaagtgctgggattacaggcatgagccactgtgcctggccaagaaaggaaacaaatgttttgggggattagttaagtgatttgcccaatgtcccacaacttaccaaactaggattagaactcaggccttttgacaccaaatccaaggttctctctaccctgccaccttggttttccatcttatgttttatctctgtcattgttcagcatatgatggtgggacatcataagttctcaatatatacatagactttttttttttttacaatgctagtttaatcaaattgcaaagaaactcttgatgattataatgtttaagacctcttaaaatcagtaaagtttagtaagagccctggctctttttgtgctacttatacgtgtgcttaattgacacacatattctagtgtgaatagttctttgctactttggggattgtacttcttctcttgagaatgtgaccaagtcttctacttctgccatactttgattgccctgctctttttcatcatttctttgtctagagcaccaagccctcctctcagagggcagaggtatattttagctgtaacatcttttcatagaagtgtgttttatagggccgttatactttaggtacattataagttgagtgtgggaatatgttctgatttaataattgacttgaaaatacaccttaggaagataatgtgttttaaaagttagacattcctttattttcatttctttgcaatatagttctctaggtaccttatctctaggtatgttatctcttgattggtgttgacagttttctcaaataattgcacatggtttttttgttttgttttgttttgttttttgagaaagagtctcactctgttgaccagtctggagtgcagtgtgcaatctcagctcattgcaacctccacctcccaggttgaagtgattttcctgcctcagcctcctgagtagctgggattacaggtgtgcaccatcatgttcagctaatttttgtatttttagtagagatggggtttcaccatgttggtcaggctgggctcgaactcctgacctcaggtgattcacttgccttgggtttccaaagtgctaggattacaggcatgagccactgtgcctggcctgcaaatggtttttccctccattttttattttctgtagtaaaatacacataacgtaaaatttgccattgtaaccatttttaagtgtacagttcagtggtattaagtacattaatattgttgtgcattcatcaccaccatccatctctgtaactcttttcatcttgcaaaactgaaaatctacacctattaaacaataactctccattccctcccaccccccagcccctggcagccactgtacattctatctctgtggtgttgattagtcttatatcagcagaatcatacaggatctctttttgagactggcttttttctcttagcataatgttattatggctcacccatgttgtagcatatatcagaattttctctcttttaaaggctgaataatattccattgtgtgaatataccacatttggttgcgaatgtttttgcatctatgatttaaaaattatattcgaggttattagaaggtgattttaggggttctttaaaagaaaggctaatgttggtgtctgagaaccaggcttctgggagccaggaggcatctggccagagcagtgcagcctgcagcccagagctccaggtctttgcgtgacccacgcactggtgctcatgttcctccaagagcccgaaagaagagcctgagtcactgagagattcctggtcatttgatgacggcagccctgtgctgtctttcctcattgtcagatggaagtctcttcttctttctagagtggcttaggcatttgagtttaccataatggccacctgaggctgcagctggttctgaaacatcagtgtgccacagaatcaatggactgggagcttgtttaaagatgcatagtccaggtcccacccccagatcacaatttactaattttggcatgggagctaggagtttgaattttaaataagcactcaaggaaattctactagttttttgaaccacattttgagaagtgctcataaatgcccgcagctaggcatctttagaatccatcttttccattgagaggcagtgttgggcagtgttgggcagtcaacaaggtatggaactggggacaggccatctgatttattctttgaattcctcagcagtgctactttctgctatttactttacctttttaggtaatcagctcagtagagctccccagcaccttagacatactaagtcagaatttctgggacaatgtatatcctttacaacagcttctctgatgcttcagatgcacagccagcttgggaaccactgaacttgataatcatcttttctatctgtcactaactacaatttcgtaaccgttgtctcaatcttaagccattgttagaggtggggaacaagaaatagcaagcagaaaactcaacagggttaaggcttgaagtcactcttctggagccctgtataatgaaacgggttatcaaattattatgtaactcagaagcaatctgcattgagttatttctttgcatctaacagttatatctagtttctcttgagttacttgttttttctagattaggtgagggttgccaacaccttactgctttttataacctttcaggatattccttattttttctggacttgttgtccagcctctgcctgggtcagcttgctgcttctgttaagtatctctggagccgtttttcttttgcaaaagagcacatctttgtttggacagttcttgtccctaaagcactctaccaggagcatctgcttaacccgcctggcttgtgacgacaacttaacagaaagcatggagcaaaactttgacaggtcagaaaacagtggcattctctctgaaatgtggttgtggcttccaaaatactttcactagtctttgcttataagaagaatgctttgtttgggaaggatctcaaactcttacttccttgttcagtgagaaagggagggaggagatggttttagaatattgatttcttagagcattatctggcagagctcagcactttctcctccattcttccaaaggccccgataaacacctctagaatagcatttattaatcagtgtagcgttattttcgttttttaaaaactgtggtaagatatatatgtaaaatttaccattttaacaatttaaaagttaagtagcatcaggtgcattcacattgtggtgcaaccatctgccaccatccatctccagaacctattattatcttcagatatttaaaaaaatgtctgcctcatttcttaaactgtgaactccttgaagacaggaattctattttattaattttcatatttgttctgtctaatataatatctgacctgttatgggaactcattcatgcttgtgggatgaaagaatgagtgaatagagcttcttctagatgattgctgttattatcctttgtgatgttctttgacttctagtctcactctgctatatcatcttgcaacttagtagaaatatctttgtatattttcattttgagaatatatatggttgctgtatttgatgaacctgtgagctaatggaaaacaggacttttggattaatgccctggactttctcattttgaaaattaaaaaaaatctcaggcaagagctgaatattctagtttgttataaagtctaaaatagacttataattttggtgccatattattcttgtgtctttattcagccatttgatctgctagtgccagtcctttggcagtgtgcattttaatttctaggccccatatgcaaattttcatgaggagttctttgttttgttctttctctacagaagccaccctaggaggacccctcctttcaaatgtgtcttctgtacccctctctgaagagacatgtttttggcatcagttagaaaactttggggccagactttaggatgttgtgttcatcaatgaaatggagggtctgagtatgtagcatcatcagtacataggatagggactcagtgctatagatgatcttagaggtcgcctagatccatctccccactttatggaggaagaatctgagataagtgacgtgacctggttaggctcacacagtgtgttgtgggagggtcaggactagcaactagtttactcatactttcagttctgtaaaattaaattatttaatatgtgcagcaattgctgttttatttatttatttatttttgagacagagtcttgctctgtcacccaggctggagtgcagtggtgctgtctcagcttactgcaacttctgcctcccaggttcaagtgattctcctgccttagcctcctgagtagctgggatttacaggcatgtgccaccatgggcctggctaatttttgtatttttagtagagacagggtttcaccatgttggccaggctggtcttgaactcttgacctcaggtgatccgcccgccctggcctcccaaagtgctgggattacaggcatgagtcatcatgcctggccagcaattgctgttttaatatggcctccttttaaggttgaatttagatgtcaacagggcttgctgtatgcattggtggagaagatacctacttcttttatatgacttgtggatgccacgggatcaccttgtttgcacgttggattgttcccaacgtgtcccagattctgaccacagcagccatgtgtttagattgaagatttgagtccagcatgtaggttacttggttcatctatttaatatccattaatatactattaaggattaggctgctgtcacctcacagcctctataaccttggtcatatgaggcttacaaagattaattttttgttgtttgtttttgagacagagtctcgctgtgtcacccaggctggagtgcagtggcacaatcttggcttactgtaacctccgcctcccaggttcaagcgattcacctgcctcagcctcccgagtaactgggattacaggcatccaccaccacgcctggctaaatttttgtatttttagtagagacaaggtttcgccacattggccaggctggtcttgaacttctgacctcaagtgatccgcctgcctctgccttccaaagggctgggattataggcataagccactgtgctcagccaagaagattaattttaaaaataactgtttacctttaggtagattcacagaaagttgcgaagatagcacaaagcggccctatattatcttaacgcagtgcacccagtggttatatcttatgttattatagtacaatataaaaagcaagaatttgacgtttgtgtggtatgtgtgtatggttctgtatgatgctttattttcagtggcatagagggagttttggaaaatgataactcactgggctctgaccagtggtggcagccctgggtgagggggaagggggcactgaaatgagtaccaagtccctgggtggagtgaggaaagggagaaagagcaagaaatggagttattttccctcaagggtaactttcctattcagtacaaacctgtagctatgctgctgcttttgctcccttgcttgagataggtgcccaagaaaggtggtcatgttacatgtctttaaaaaccatagttccttctactttgagtaggaacagagagggttaaatgggtgatttttgtttattgtttgtttttaaagagaatatgtttctagttagtactttttttttttcaacaccaaggaaacaagtttgtcccttgtactgcataatgtatttgtactgcagatggtaacactgttttaggagtatgaatgtgcttgtgatccctggatacctggccactattctgctaactggaggcttgtatggtctatgtcttggtcattggttagatccattattcccaagtcctgtcactatgagtgactgtcaggtatagaccagcttcagttcttcaggtgtttagttccagccttgataagaaccagaatatttgtaatcctttctaatgagagaagggatccaggaacaaaactgtctcctggggaggttctgattcctccctcctcacactcagtagattatcttcctttccacttcacagagaacacagtcatcagatgggaatttctttcactttttctgccagatttgcatgtgttgcctgtgcccatctcatgcttattctcttctttttagaggaaaggtcctattcttcacatctaagaccaatatcccgatttctgccttggcttctttcttcctctactttgtcagaaaacttgcagtgttgacagtctctttcttctcagtcttcaaactggatctctttctgtcttagatctttttataaaatctaatatgtttaattctttctcattgaaaaaacaaaaaatatagagaagtactgtactttaactctacttcctcttcagtgacttcacattcccattctagccagtcttctaaaaaaaaatgtctgatctctctgcctccattttcccaactcactccagtttgactgagatttctttctacttgtttggattcttcttcttggtcactttcgtcatttactctctattacatattggcacattgcaagtttggttttaagtttctttcatttctcactctagggaagttcacccgaaggcatggtttcagtttccatctatacaccaatgactctcaaattggcctctctgagagaacctatacctctgagttctagacctttaaaactatctacctttaaaactatcaacatctgtatttggatgtttcaaagcaccccaaactcttcatgtccagtatcattcttaacaatctttccccaccacacctggctcctctgcagcatttcctaccttatttaattctctatccattcggctgtgcaggctggtaaccttagagttcttgacacctcatgctgcctgaccacccatattcaggccttcatcaattcccacagctttttcccttaaataaatatatttctttctttcttttttttttttcctaccctgagacagagtcttgctctgtcacccaggcaatctcagctcactgcaacctccacctcccgagttcaagtgatcttcctgcctccatctcccgagtagctgggagtacaggcgtgtgccaccatgcccggctaatttttgtattttttgtagagatggggtttcaccatgttgcccaggctggtctctaactccttagctcaagtgatctgcctgcctcaaccttaaatatatttcaaatccacctacttctctatttccacctctccctcctttgtccaagccactattatattgttcctagatattacagtgtctcttaatctctctgcatttggtttttttcccctttgcaaccaattatctacacagcagtaaaaataatctcaacattagctggatcatgttattccccagcttaaaactgtccaaagactttccactggcctcagaacaaaattcagatgttttaccatggcctacacagggtcttacctgatctgactctgtttttcccatctcatctccagatttcataactctctgtaaatgttaattcacagcttttatcataatttgtaatacatactcacatatgtggttatttgataaatatccttctttccactagatcagaaggtccatgcggggttgtattcccattacacctgccactcaggcgcaatgaatatctcttgaaggaatggatgaatgaatgcatttgttgtgtttgggcctcagccctggtaattctgattcagtagctctggggtaggaactggacacctctatttattaaacccaccacagctgattctgatgctgagtttgggttgaaccccatagagaaatatgttgcaactacagtttagaccacaggtgtttagactctaaacaggaaagggaaggaaaggatgatgtaaatgttaataaacattttctctcattttgcaaaccctattgactctgtcattcctctaagtaggacagtgtacatcagctgacacttttacaggatgatatttccattgtgatttcttttttatttttaagctctcccaattttatggtaaaaataaaagaggggaaaaatagggtattacatgattgctattacgtaggcaataggtttaggcatagtcaggttagtagggatcggaataaagctaaaaatatgaagcttttgtgttgtatgcgagggtgggaagaaacaccagtcagtacacatctaaaggtgacaagacacagacctggctttcaaggagcttacaatcagaaaagcttcgtgtaacaaatgcaaagagcattagattaggagtcctaagacctgggtactgtgctctagttaagtgatggtgggcatggcatttcagctgtgggtctccgtttcctcagctgtaaaataaggggtttggatcaagggatttttaaggatcttcacaactttacaagtccaagatagggctggaggggactgtaggatttggatgggaagtggtgggctctgagctggctgacagggctgtggggctgggagcaggcactggctggcatggagggcttgtagagagtagtagttgaagagaaaggtggggaagtttgtgggccgagctgtggaggatattggctatcaggctgaaattttgtatttcattttgtagacaacaggcagctctaaaaacttttgtgtattttactttgaatttcaatcagtgatgcaaatttcaatataggacttctgaggacaaaggaaacaaaatgtgtgtgaatgggtctctcaaattataaaagttataggatcataccttcataattttcctctggttataaaagtaatgcatgagtaaggtaaaaacatccaaacatgatagtgtagaaagtatgacacccttatggtaaacttccaaacaaacaaaaatcatcagtatgtgttgtcttcttattgctttagtagaaagtttctatgtaaaagtatgacatgattaaagttgtattttaggaagatcactttggtggcagcatgtagggtgattagagggagagaaactaaagtccaggagactaccagggggttagtattattgtttaacaaatatacgaataccttcaatgttagcttataatcgaataccttcagtgttagtaagttcaaaggtaatgggggactgcggtaagagagcagaaaaaattaaagaggaatggatgaattcaagagacacttaaaggcagaatcattaggattagtgactggatttcgattggagcagagaagaaagaggagcaaaaggtacctgggaatttcaagttgggtctttgggagaatcacccatatcagttctagggaagttagggatggaagctcagtttgggtgagtggtatgagctagatgtatttggactgagccatcagaaatcacatttaggagcaaagcagagaagccatccaaagcaatagagaaagaacagccagttttgggaagagaaaagcaagcaagttcaggcacagagcagagggcaagagattcagagagagtggctttccaggtgctgcagaggcctcaaagggagtgaggcctgagaaaggtgacaggcggttagaggaaagcaacctggcataccgagcatcttctggggtcagtgaaatgggagaggcagaatcgagatttcaagagcaataaagcgcataaatagctatacataacatagctatgtaatgtagggtaatgtatataatagtctacaacttctgttcctaagaaggagagaattaatatgattatctggtggaggcagcagcaatataatttcatttatgttatggtattcctattcttacttaacatattcatgcccagttatttatgtgtaactgtgaggttgaacatttattacttgacaggtgaagtaaaaaagcacattatttttgtgccattttgtcctgttctttgggacgaattcttccctactccttggataaaatgtagggaaaatctcatcatttttatggttactctttggtaacaaaaggtcctgtcatgttcggttactttcatatacacagtctacattcagtaattaatatgtccagtctaataaaataaaatgctcccttctccagctcgggtcttctttggtctggatgcctgcctccaactcactaggctgcctttgactcctccagactgaattgggtggaggaaagagaagtgaggggtaacaaaattctcatctgatgtataaggatgagtcatgtgaacttgctaatatttgtcctgcaaaaatgtcaatttaatatggttcaatgtaatactgttgtcatctgcatgagacctgtctgggctaagacggcatttaaaactacatttttcctttttagaactcctttctgtattcctaggaggacccttaagattgtggggaggtctttcatccaaagtaccctggatgcttttgaatctgtctcctccaaatggcagctcataactccatctttagctgctgggcatctagatcacacacctcagcttccctcttctgagggcttgccttattcctactaaggctgttttgatcaggatagaaaacagttccatgctgacttgctcttttggcatatctagttgagggaaaatgctcatgctttctctgatcctgaacattcaggagatgcagaccactcctagcatagcacactcttagctccactgccagcacaaatattataccctttagagttttcaggtgtgtcaacagcctgctcactgacagcttgaggatgctcccagggacacatacctagttgtctgcattgtctatggaagcccgtttccctaggcttgaaatgagggccaagcaactctacctgatgccccagggtggggtgagtgccactcctagctcatcgaaagctctctcctgaaattcccttctagttttatttttatcttgacctttccaccttggtgatgggttaagagttacaaaaccagtttttggaaacctcctttacaggtcctgcatccttcacctgtggaaggtggacatagttgacatctattgtcttgggggctaaacgcaaaactgagtctgaaatagttcccttttaacctcccgttatgtgcagatttaacaaattcagtgcctttcttaaagtaaaaggtacatccagacactggagagtagtgctaaaacaaactattagggaattgaaatgaccataaaagaacataatgaacaaacagaaataatccaaccagcaccttagttttgattctggcattgctttttactccagaagcaagagttgaaagaaactgacctgcattttaaaatatattttttaatggtcatgtaatatgctatatttcttcaaatctgttaaaaatagaaactcaagagttggatggcatcatggttagggaagaaaaattctgtaactggaatagatggttgtagtaattcacatgtctcaatttgtattctagtcataacatacttcttaaaagggtggtaaaaataatgtgttttctctttcccacttcatttgtctaatttctgtaacatacaccctcacaatgaattattgactcagggacaagaggtagagaaattacagaggttgctaagaatacctgctgactcttattttctacttctgctttagaagttgtttagaaaatctaatcaaggccgtcttacatccagtagaaacagagagtttctactggatgtgctttggagcaggtttttaagagagagctttccccatggaagagtgaccatattggggaaagaagagctcaggagacatgagttatgcttctcttgcctggggaggtgtttgcttaaaagacatgctgcccaagtatttaagccttcaggttagggtcttttttccagttgttggcagagtgaatgagcatgaactgtatttgatgaactacagttaacacaaatactcattttgaagcagataaaattattttgaaagtgaaggaaaattgtttcataagagaaacttgtacttcctacgaaaagactgtgtttttttgctccatgtttttagtaaagtttagtcaaatttagtttagttcacctagaacgaacactgaacaatttggaaatacattttattcctttttttaaactagaggttagcaaaccctggcagaaaaaccaaatgtagcctgacacctgtttttgtgaataaagatttattggaacatagtcgtgctcgtttgtttacaaattgtgtctggctacatttgcattgcaacagcattgttaagtagttgggacagagaccatatggcctgcaaagcctaaaatatttactatcccactctttacaggaaaagtttgcagatccctgttctagattaatgaaagtactcagtatcagtgtttttgtggttatatatggcataaatggctattaattctctgaattattattaattttaaatatttcagtatcttttgtacttgattatatatctcattaaaataattgaattaattctgaaaattggtatggtctgtttgcctaatggacaatacactggacattacaaaactaatttctgcttttcaaatcccttggacagtaaaataatttatttcttgatttgcattttaccacatatgagcaccttgggaagacattgtgtagtagaaagcatactgtcagcacccacttccaaaatgttttctagatttattggaacaatttaaaatgtcagtgaaaagaagtacttttcttcctttgtgttcttcatttttctatgatggctggatgcattcactccttggggcattcatgttccttccttaaagggcagagttaaggttactctgtgggtcatttgcctcttcagggttgtttgatccttctcaagagaagattattttaatgtattgcaggagatgctgcctgataactgaggctgatctgttgagcactgtaggaaccagactggggacaagaattgactcatttattcatttatacttatgtttattcaacaaacgttgaaggcatgctttactaggttctgtgctctcaaggatttcatagtctcttacaggagatggacacaaagcaaatgattatcatatactgtgttaggcaagatgattgagttatagtcaggatattataggagagaaggggcatctaatccaccatggggagagggcaatcaagaaaagctatttgaaagaggctaaatccagatcaataaatccaggacattctgtcagaaattcagatggagatgtctggcaggtggatttgagtctcaatctgggatagagataaggatttaggtgtctttattctaggaatggcagttaaaaccctgagagctgatgagagcctgaagagtgggaagagggctcagcatgggaaaggccaacatttaaggatcagaaagagatgcataaaggaaacaaggaaggggtcagagagataattaggaataccaagagaacaaaagacaatggtgtttagagactgagtgaggggaaggagacggtcaatggaaagatggaaaatccaggattgatcagggactggcaatgtaggaggcagaggggagatggaattcatttcaaatattctaatgtaaactacttatgtgttaaacaaatgatgacctaaaacttagtttcaggctgttgtttaaagtaggctcaaataagtaagttgatttcctatatttgtaaaagctaataatttttatttaatcaaacacacatttattgagcacttattttgtactaggtgctataacaggttggcaccctaagggataaactatgcgggatataaaaatgatcaaaaagtgaagtagtaatatttaagctaagccctggaaaatggggagggatggaagtacatataagtcaagaataggcaagagttagagcaaaaacacagtgcatgaaaccccaggacactgtcagtcttgaattattgttcttgactatgtctgtctccaccactagactctctaatgctgaggactgtgatttatagagcctcacatggtgttttgcatgttgtatttactcaattaatgtttgctatatgaatgaaacttgagaaacagaaacatcataattgttacttattccatagtcttgtctgtgctggcctcagtaataaagcaaaaactaacttaaagactagcattcttatgttcattagtaaaacaggtaatagataaattaccttcttgatttgacttttgagaatgacgtgttagaacttataaatgaatcaaatacgtgtaatttataatgttactatatgatatgaaaacaatttgagatagaagtcataaatatgaagtttcttaagactttgatcaaaacaacaaaatttctttgagattttctttttttaaaacttttatttttcaacaacagctaaccaaagatgggatcttctttacatgacaatgttgaagccaattgatacacaatttatttgttagcgtgttagtggttctatttgttttatattttgaagtgaactatggccttcttttaggactgaaaaataacttcgtggtgtacagatattttagattaaccaagggtacttgttaacaaaagctattattttatagctgcatctccgtgtttgatttgataaatttgggaattaaatttacaatgcaaatttcattagtggaattacatagccaatttggagaggttctatttaatgtgctaccttgatttagaatgagcgatttagaaatatgaagagttgactgggcatggtgtctcatgcctgtaatcctaggactttgggaggctgaggtgtgattgcttgagctcaggagtttgagaccagcctgggcaacatggcaaaatcctgttctacttaaaaaaaaaaaaaattagctgggcatagtgacttgcccctgtggtcccagctagttggtgggctgaggcaggagaatcgcttgagtccaggaggttgaggcttcagtgagctgtgtttgtgccactatactccagcctgggtgacaaagtgagaccctgtctgaaaaaacaaaaacaaaaacaaaagcaacaaaaaaaggagaaatatgaagagttagataaatgatacgataatagcccacgttttcttgttgattgtggaaaaggaaataattaacagtatctattataaccacataggatgtattgatttaagaattacagtagaaaataattcaaggaattggaaaagtgaggcatgttgttctatgaagattttgcatccttaattatttataagtatttgagttatgtgtaacttcattttctccattaatttttgataatgatatccaaaacaaatctgcagttatttgttagtttgacctgtgttatctttgcttcataaattcctcaattatctagtttaatctagttcttatttcacaaatgatggaagtcagattaagcagtttgtttaaatgacccgcaatgaattatagagataggtcaccattttatgctaacgggttggcaagaaaaattcatgaaattttacaggcttcatgttgcagttgtctacaaatacacttccataaatgaaaataaacaagtttgttcattgcatcattataaatgtaatttaaaaattaattttctaaattgttttatgcaagtaagtaagcaagcaaaataaataagaactcatatactttcctgtcttttttttctcccctgcccaataggaccagacatactatcaatcatttcaggtttcagaatatggtaagagttcctcaatctattttggaagaaaaaaacatttgttactttcagcagagattagagaaatttttaagagatgtattatttgaagtaaaaatctcaatggagttaaaattctggtgttttttaaaggcctaaccatattttttttcctttgtaaaaattctaaaatctcattatacagaaaaaagtagaaaaaaatcacctatagttgcattgtgctagtctttttcttatccacaacatgatttttctatttttctactttgttgtgataaaaaaatatttaaagtgttgcacttaaaaatacttaacaaattctcttccatatttttcatttgattgacattggtaaagatggtctgtttctcaggtaaatcctcttcttgcaggtgccatacttacaatatctgttagaaacccatagataaaaacagtgggacccatctattttgttggtgaatggagaggaatgagagatgagactgaaagcataggatcttagtattagttataatttgaatagttattttgaggttgcacatgcagtttttcatttgatttgagcttcttttttgagattgggttttatttaggcagtagaaattataatatacaggtagtaatacctcaggctctgtgggccatatgtctctgttgttactactcaattttgccgtggtagcatgagagcagccaaagataatatgtacatgaatgttgctgtggttcaataaactttattttatgggcatgaaaatttgaatttcatataattttcatatgtcatgaaatattcttcttcttttgatttttttcaaccagttaaaaattgtaaaaaatgttcttggttcatgctggtcatagtttgctgaactctgatctgtaactgtgctctccagtagcggggccacttgccatgtgtggctgttgagcacttcaaatgtggctagtccagatggagacagcagatgtcaaagacttagtacaagaaaaatgaaagaaagaaaaatagttcattaataaccatttttaaatttttattatttgttgaaaagatactattttagatatatagggttaagtaaaatataaaaattaatttcacctgcttatttttactttaaaaatttgactactagaaatgaaaaattacacatatggctcccattttatgtcttttagacagccctgatctagaagaataagtcataggggaccaacatttttataggctatctttatatcccattgtgatggtatgctgggtggttgtatgttgttgaatgaggtatagtggaggtggggaattgattgcaaacctatgatgtttgaggaagaggcatttggattttcttggtggtgggggttgcgggggcggggtcatagttgactcacgtgactttttggtctccctgtcctagactgatctagagtctaggagtgtcttggtacattcagggccattagccttgattggagctgaaggtctgccctatattgttgactatttggcttttttgatacttctcttatgttaattgaatggtgaggtgccttgttatgagagtggcctgtttctttggtcagagaactatagaaaaaaagttttatcgactgtaaagaaacacacattttttactctggtggagtgctttatatcaattatagtattagtacttataaaatagtttataccttaattattattattatttttcgagacggagtctcactgtgtcactcaggctggagtgcagtggcatgatctcgggtcactgcaaccactgcctcctgggttcaagcgattctcctgcctcagcctcctgagtagctgggattacaggcatgcaccaccatgcccaacaatttttgtatttttagtagagataggattcaccatgctggccaggctggtcttgaactcctgacctcaggtgatccacctgcctctgcctcccgagttctagaattacaggcgtgagccactactcccagcctcataccttaattatataaagctgaccaaattagggatttctagttttgggtgaaacaaagggcttttcatctgtcttaatatgtatttggattctaataaatttaagttcaaatagtacaaattattaactccttcacaacaattttatttttcattttattcagtggaagatgatagtgaagtagattctttaaaagatttacccttgcttcttcgtctcaaaaagaaaaaaagatttacccttgcttttcttttccagtattaccaaaatttgaagtgactttgcagacaccattatattgttctatgaattctaagcatttaaatggtaccatcacggcaaagtaagtgtcatttttcttttgatatgactcaaaaccattataaaactgtgtgaccaaaagctgattgtatacttcagaatattagggcaatttttgcttattaaaataccttagtggacagtaaatgactatttataataaataattaagcatgggacagagctccacatttcactgcatctatcactctgcttgcaagccgacccagtcttaaaatatttcccatatttcttagacttattaagggatttatattatagatagcactgtttttttttcagatgacatggacttgaagccaccacgcctggctaattttttttcctttatagagatggggtcttgccattttctccaggctggtcttgaactcctggcctcacatgatactcctgccttggtctcctaaagtgctgagactacaggcatgttccaccactcctgggctgatttgctttttaaaaattagtcaagcttttattttctgagtgattaacttatcccaaatgcttcccggttctatttgggacaataattgtatctttgtttcacaattattataaccagcttggtgtttggaaaactaaatctgcttcacattaaagtcaaaattaaaaatttttatgtctgagagtactttaaattatatttggattttaaagatccttttactaccatgtgatataactctgttaaaatacaatatcctggcattctagttttgcttttatttaatctttagcacgatacaagtagagtcaggtttcgaagactcttgaatgagtgaatttgatgctcaggttgctaaccagggtttccactgactttactgtttttgtttggaagtgtggtgcatttgaacttggatttttttttttttcttcttagtttggaatatgctatattttaagatttgcttttgagttgagttgatccagatgaggggctgtttctgtgttcagttaatggattcaggaagccgccgtttactgctgtgatttatagactgcaaagcaaaattgacttccatgtctggctcagcatttcacaatagagatagaagcaacccaggaaatgtacttaaaaaaggctttctgggccgggcgcagtggctcacgcctgtaatcccagcactttgggaggccgaggcgggcgggtcacaaggtcaggagatcgagaccatcttggctaacacggtgaaaccccgtctctactgaaaatacaaaaaattagccgggcgcggtggcgggcgcctgtagtcccagctactcgggaggctgaggcaggagaatggcgtgaacctgggaggcggagcttgcagtgagccgagattgtgccactgcagtccggcctgggctaaagagcgggaccccgtctcaaaaaaaaaaaaaaaaaaaaaaaaaaaaaagcctttctggcagtaaaatgtattgcctcttcttcacatgaagagactttcctataatgagagaggataaaattaatacatagaaagaaaagtagcagagaatatttgacttacgaagctaagtttgggccaggtgaggtggctcgtgcctataatcccagcactttggggggccaaactgggtggatcacttgaggtcaggagtttgagaccagcctggccaatatggtgaaactccatttctactgaaaatacaaaaattagctgggtgtagtggcagacgcctataatcccagctattcgggaggctgaagcagagaattgattgaacctgggaggcagaggttgcagtgaccctagatcgcaccactgcactccagcctgggtgacagagcgagactctgtctcaaaaaataaaataaaataaaattcgctggacgtggtggtgtgcgcttgtcatcccagctactcaggaggctgaggcaggagaatctcttgaacccctgaggtggaggttgcagtgagccgagatcatgccactgcatccagcctgggtgacagagtgagactgtgtctaaacacacacacacacacacacacacacacacacacacacacacacacacacacacacaaacccagaaactaagtttggtactacagattttaaaaattattcttattttaaattttttggcaaaaaatcaatttttgacagccatgagcacatttggtgcttcagaatctatggtgtaataaaccttcctcgctaatattggaacatgtagcaatagaccatggtgattgcactatcagctgacatttaaaaatcttctaaagctgcgaagtttcgtgggcattcagttaatgggccagtccagatttctaggagtgaaagatttatgtaatctttaaaaaatctttggacaggaaactgtcacttccaattatgatcaggtattttctggagtctttcagatggtcagaggttgggcagagtgtgtgttaagaactgttttaagctactatagttaaaagtcttcccattttggaaacttaatttcaaggatcaccatttattttttatttatttatttattttttgagttggagtctcactctgttgcccaggctggagtgcagtggcacgatcttggctcactgcagcctccacctcctgggttcaaacagttctctgcctcagcctccaagtagctgggattacaggcacccaccaccacgcctggctaatttttttgcatttttagtagagatggggtttcaccatcttggccaggctggtcttgaactcctgacctcgtgatccaccagcctcggcctcccaaagtgctgggattacaggcatgagccaccgtgcccatccaggatcaccgtttattaaagacatttttgttgggtttagtttaaaaaattatagtaggagtatgtttttaatgtaacttttttctttttaaaattttctctttttagtgttttgccatcccataatgtatttttttttaatttatttattttgagacagagtcttgctgtcttgctgtgttgtccaggctggagtgcagtgatgcgatctcggctcactgcaacctccacttcctgggttcaagcagttctcctgcctcagcctccaaagtagctgggagtacaggtgcctgccaccatgcccagctgatttttgtatttttagtagagacagggtttcactatgttggccaggctggtcttgcactcctgacctcgtgatccacccgcctcggcctcccaaagtgctgggattacaggcgtgagccaccgctcccagcccaatgtaattttttaaaatgttagattgctaattgctaatgtatgctattgaaagtagtatttttattgtgttctgacaatatcaagttgatacataaaaagactatgtttataattattcaggtatacatatgggaagccagtgaaaggagacgtaacgcttacatttttacctttatccttttggggaaagaagaaaaatattacaaaaacatttaaggtaacttttgcagacactttataacttgtgatgggtaaaatatgtgtatttttctagaaataagatttagtactgaattaacaaaaagttaagtgtaagaaaatcaagagctttccagcattgaacaaatgagaatttatgcaattatagcgattaaaatggtaccagagctatcatattgttgtgacttagtttgagttttatttctaaaatttgaattgctaaaatggtaaataatactgaacttttaaacaaaacagataaatggatctgcaaacttctcttttaatgatgaagagatgaaaaatgtaatggattcttcaaatggactttctgaatacctggatctatcttcccctggaccagtagaaattttaaccacagtgacagaatcagttacaggtttgtagactttaaagtggaggtaaaactattcatgtgacactgctttatcatctttcttattataactggcactttcatttgggagcatcattgactttctaaagatgctatttaatgttgaaattgttatgactgttagtctaagttgcaggatgattttataagggggaccttattttctatgaaagtcactacttcaaccacatgtgatagctcttcttaatttttttttccatttctactctttccccctgaaaactacatggaaaggcttacattttcagctggtaaccttcttctttttaaaatcactgaaatctcagctgttcctagacagttttcacttttaataagaaaataaagttgagtttcttggacctttctgttactatttcaacaactttagccaatccctgaaagagcaaaagactattctttcattggccttaatttgctgctgttgtacatgtcactgcggtagaatggcagcaatggtgcttagaggggatccatagagaacataatagaactgtgtggtgcttgtagtgtcaaagtcaatatgggaatgaggcttatgtgccctgatatttttaaccctttttgcaataggttagatggagagatttggtggatagaagctttgggtgaaacattacttttgctttctaaattgtgcaatttccaaaaaaggtatttcaagaaatgtaagcactaatgtgttcttcaagcaacatgattacatcattgagttttttgattatactactgtcttgaagccatctctcaacttcacagccactgtaagttggtatatttatttccagtccatagcagtaagttcagcttaatgaaatagaatgggaaataatattttcaatgcttttctaaaaatttaagccaaaaagtatataactttgtctctttagacatgtggggcatgtagatttgtttccaaatgacctttgtctattttttctaaaaaagtagttttcaacaacagtaaaaatattttttgaaaatgtatttttttttacaagcaatttaagttagatgtggattgctacactgaagcttttattaattaattgaaataattacatggtagtcaaaaatttcaatttcaatttggtttttataatgattaattgtagttctaacaaagatgttacattaaaaaattatcaacaaatctcattttttggagataatgttgaattaacacattaattgtgtgaatgttgacaatgagcaaggcatggtgttgggcagggctatagagccaagaagggctcagtccctaccctcaggttcacagtttttgtgatggtgacaggaaaatatatacttaactataactcatggcagattaagattagtgttacaaattaatttctgtagggatttaaagcaggggttgccaaactttttctgcaaagggctagagagtaaatattttcagctttgtggccatgtggtctttgtcacagctactcagccctgccattgtagtgtgaaagcagccatagccaatttataaataagtgagagtggaatgtgttccagtaaaactttgtttacaaacatactggattggcctatcagcttgcagtagttggctgatctctgatttaaagaaaggaggagtcaggcctggcgtggtggctcatgcctgtaatcccagcactttgggaggccgaggcaggcggatcacctgaggttaggagttcgagaccagcctgaccaacatggagaaaccccatctccactaaaaacacaaaaaattaggcgggcgtggtggcacatgcctgtaattccaactactcgggaggctgaggcagaagaatcgcttgaacccgggaggcggaggttgtggtgagtggagattgcgccattgcactccagcctgggcaacaaaagtggaactccatttcaaaaaaaaaaaaaaaaacaactaaaacgacaaagaaagaatggaggggtcacttgttgaatgggtcggtagacgtttcaggtagtttctgatttcaatgatcttaatttaggcagtttgaaaaggtcagtttaaaaaattgaggctgcaaatggtaatttctgaatgagtagagtgaaaccatgggcgttcagagggggagagttggctgtgggataggcatgggggttactatgggatgctttatggaagaggatggtctaaactgttttttaaaagattagttgtgttttaaatgcttgggcatgggagtgggaggtggggagcaagataagaagtgagacaagaaggagaggtctggctggcaatttcggggtgcactcaggtagtgtttgagggagactgctcaggctgtgtgcaggaggatggctgtagcccaggagtgaggggatgggcagccttgtggtggtagctgtgggagtggagaggatggaagagagaagcataggactttggtgttcattggatttggggggtggggagagggagggaaaattcagaaatgtaaagtcttgcaaaatcctgatgttagcgaaaataggaaaatgacatggttgctcattttagatatgtgaattcaaggtgtccaggatatccaagtagaaatttcctgcaggtaactggaggtgttgggcatgaactccagagaagggcaaggatgggaattttggctttagggtacaatcacagagatgacaagctaagcaataggattgctgagaccttggaggaagggagaagaacagatgtccaaaattcccacatttagggagaggaaagaggaactgaaaaggacactgagaggatgcagaaagagaggtaggaagtgaagggggttattttggagccgcggaagttaagggaatccataatattaacaagggagtaatcagtgatgttggatgcctcctagagagaggccactgaatctggatattatagtgctaccaataatttttgagagttcaatttcatgagaatactacagacggaaactgtatttaatcgtacttaaatcctttgtgtttttaagatgttttgttttgaccattaggtgaaggtaactcgtgctgatggcaaccaactgactcttgaagaaagaagaaataatgtagtcataacagtgacacagagaaactatactgagtactggagcggatctaacagtggaaatcagaaaatggaagctgttcagaaaataaattatactgtcccccaaagtggaacttttaagattgaattcccaatcctggaggattccagtgagctacagttgaaggtgccgtctgtttcccatcattgtgtcactgcaacaacaccattacagttgtaatcttgtggtaggcactcaacctgtcagaactgaaagtacataggaagtggacacatgtttctgtttcacaaaatggaggagagtggtaaaagtaatttaatgacagtggctgaaggttagactaaatttttccttgtaagttcattttgaagagcacagtaaaatatagcaatgtgaagatatgatggagaatttcctcaaatccccagtctagtgtttgaggtcagtcatttgaaattttattttggcaggaattgaaatgaaagataaatatatatacatatatatatatacacacatatatatgtatatgtatatgtgtgtgtgtatatatatatatatatattcctttcctgtgttttaaagctatcagtttctttacagtataagctataaaatgatgaaaatccaatgtctggtgaatgtatttttcttgcattaaaaaaaagtgaagatgaatttggtctttaataattgttcagcaggtaacatcttttctcaaggtgttactaaagatgaacatttacagctcctttttcttttattataggcctatttccttggtagtaaaagtagcatggcagttcatagtctgtttaagtctcctagtaagacatacatccaactaaaaacaagagatgaaaatataaaggtaatgcttacaattcacttgagaattacaatataattggactatcttgcttttgatatgtacatattaattaaggtttttttctaggtgggatcgccttttgagttggtggttagtggcaacaaacgattgaaggagttaagctatatggtaatctcttatagaatctaaatttatgatctattatagaatcatctttttattcacttttaagttctggggtacatgtgcaggtttgttatatagctaaactcatgtcatgggggtttgttgtacagattatttcatcacccaggtattaatcctagtacccattagttatttttcctgatcctctccctcctcctaccctccaccctcccataggacccagtgtcggttgttcccctctatgtgtccatgtgttctcatcatttagtgtgcacttataagtgagaatatgtggtatttggttttctgttcctgcattagtttgctaaggatagtggcctccagctccatccatcttcctgcaaaggacatgattttattcttttttatagctgcatagtattccgtagtatatgtgcaccacgttttctttatccagtccacctttgatgggcatttaggttgagaatcatcttaaatggtgtctaccttatatctacactaaacttattaatttttataactcagcctcatacctttttagcctgtcgttttaacattgcaatcaaataaaaaaccttttttatttcttcacctatgtttgcatttccaatttaaaatagataactaaaccttgttttatgtttaaaatttaaatttctatttgataagcaatatatattcattatagaaaattatacaatgtaagaaaaatgaaaaagaaaataaaaagtgctatccatgaccatgtaattttgctaattcagctttcccaatggtgccctgtattccttgcaatcaaaaatagattcttgactatgaagctactgttgctccaatcagtattactttaatcttaccattttctttttctcagtgtatgctctctgtgtttgtcagagaggttttcctgcattccaaaagactttgaagctggtttaattcaagaatttgtgtgtatgcatacaattatgattaatgtagcttcagatgagatcctactaggtttggcaataaattaaacccatctactgttcttttcaggtagtatccaggggacagttggtggctgtaggaaaacaaaattcaacaatgttctctttaacaccagaaaattcttggactccaaaagcctgtgtaattgtgtattatattgaagatgatggggaaattataagtgatgttctaaaaattcctgttcagcttgtttttaaaaataaggtaagatttaaggtaatgatgtttaaaagaaaactttatattagtgaagtctgagaaatgtaatatttctttagaaaagtatcattaagccaaactggttagaaatttatattattctatttctagaactatggttaaacttttcaatatttagcattacatatatattttcacttgtggagttattggggattgatagtctatttgtaaactatggttctggtctttaagactttaactcagatcatgaagctgtttcagaatttttcaaatggttgaattaatattgctcaggagtgaaattccagtggtaacatagaattcgtgtggtgttgatattgcagtgatataaagggtgtgggaaggagtgaggccatctaggataatacgtagaagcagagctgggctttcattaatctatttaattagctggaaactagcccagggcaacttttcaatgagcttgattaccctgcatgtgaggatctgtgtggagtctggtctccaagtgcaccagtgccttttatagcctaatgtgaccagcttgagtaggaaatccctttggaccccagctctgaaaagaaacctgattgcatcatctcatgtatataagaatgagccattgctgtcactaacaactgctgccctctccatcctcttatgtaaaaaattattcctttaaatagtgatttgcagagtatggttcttctatttctttttcctttatttgttaaaatatttgagaagtaacagtagtgatctgtactttcttttttaaaatttgtatttatttattttttgagactaggttataagactggctaatttttgtattttcggtagagagagggttttgccatgttgctcaggttggtctctaactcctgggctcaggagatccacctgcctcagcctctcaaggtgccgggattacagacatgagccactgcgccaggcctgtactttagttttgttgagaattattactctcactttgattgttaaaatataatacaaacttctatttttttagcttatgaaaagagttcttaaaaagataacactgtgttttgttagtggtagagcacaatttttgacttctagtgatcctagtaattgcctgacaaaggtgaattttaaagtagaagttatggaggcttaaacatctcagaaagcaagaccaggttctaaagctggttacagtgtaaaagatcacggactttgaggaagcagagtatatgaatagcatactttcaagtaatttcttagctataagagaaaggaattagtttcagttccatttgcaactatatatctttctcttatttttatgtgataatcatcacatttataaagaaacaacataattagaaatggaatatgtctaagcaagagaaagttagtgaatgtttattaatgttcagtaatgactatggaataaataaatgagctgtaggagcggcaagagatttaggtttagaaatcatccacacagaagtgcaagttgaagccatggggctctgaggtacagagtatagagtgagaagtacaaggtctaagactgagtcttgaacatgctgctccctctcccccatgctttagtgtgtaggtggagaaagtaacctacatacagtggtttgagaggcatgtcagaaaaaaattgcactggacaagttaaacaggtaaggaaggctttattcaagactattgcaatggaagagagagatgataaactcaactctgctgaaacaaaaggcagaagagtttttaagcactggggtgaactcatatgaaagtgctggaggacattgttgggaggttggtcaatgtgattaggtagtctgtgtttgctaattagtacttactgaagttaggtttccaccctcccacagagaatgagatcaattgggactctgtctttcttgatgattatacttcaaagggatggctctgaggaccttgagaaagacatgcctgggttgtaaaactggccagaggctgggaaaagatttacatctcagagagttggagaaagaatttataattgcatgttttctaaaataaatgctctaagaaaagggagctcaggggcttatagttaggaagaagcctgtctttgtaaagtcgagtcaacttgaggggaatgttaaggccctctttgtcaggcattataatcattggcacagcagaatgttgagatagagctagatgaaatgaaaattcccagcaggggccaggcactgtggctcacgcctgtaatcccagcactttgggaggccgaggcaggcggatcacctgtggtcaggagttggagaccagcctggccaacatggtgaaaccctgtctctactaaaaaagttacaaaaattagccgggcatggtggtgggcgcctgtaatcccagctacttgggaggctgaggcaggagaatcacttgaacccaggaggcaaaggttgcagtgagccgagattgtgccattgtactctagcctgggcaacaagagggaaactccatctcaaaaacaaaaaaagaaaatgcccagtaggcaggggcctcatgacaaggccatttggttcagcggtgatgcgatgactgatgctctttataaagtattagtaggtccaggaccatgctttcctgagggtaatggtgaggaagtttagaaggccatggagacagagcatgagggcctggactagtgtttgctctaaccacccactcccttggaaaggccacccctcaccctcagtccaggtggttctatgagtccccgaggagctctccttgccttcacttctgagctcacgtcaccaacatgtaggcatctgcagtttctttcctctttcgtgtttctcctttgtatactggccttccccaggtatgctagacactgctgtcttctactcagcactggctgggatctgaggggtgggagatggagaaagggaagaaaaaagatacagaattaaagaataattcagatttataccactgtgagaagttctatgacttgcaaacactctgggcgtagtttttttattcctttccctagagaagggttatgcatggttttagaattatccctgagccaaggcaaatgtagaatctttgctatattttgggccagtggtctgctattggcaagaatatgctttaaaaaagtgaaataagttaatcctcctttctctcttttttagataaagctatattggagtaaagtgaaagctgaaccatctgagaaagtctctcttaggatctctgtgacacagcctgactccatagttgggattgtagctgttgacaaaagtgtgaatctgatgaatgcctctaatgatattacaatggaaaatgtgagtttagctattttttcattatgaaaatatgtattacaagagaaagaggaaactttattgtactactttaaatatttaaagaaaatttcattagttcctttgcatgtgtaagtcaataattagtaaagcttccaaataaaaagtaatctgtatcgtaatggttatgttggaaagaagcttatgtggttaagtgtccttgctctctttcatcagaattatcacctaaagttagatgggaggaataaattctggaggtctgtggtacaacatggtgactgtagttaatgataatgtaccatatacttgaaaattgctaaaagagtagatttgaaatgttctcaccacaaaaaatgatcagtatgtagtatgcaaggtgatagatatgttaattagcttaatcattccacagtatatacaaatatcaatatatcacattgtactccataaatatatacaataaaaaatgccacctatagttttccttcattttcatactacattttaagacactcaagaaagtactaggaaattgacttgcattattctgggttacgttggataagagagctttagataatttttgaagtgtgttctattttggttatacgtaatggttataaataattacagcacccattgtgccgggcatggtggctcatgcctgtaatctcagcactttgggaggccgaggtgggtggatcacgaggtcaggagatcgagaccatcttggctaacatggtgaaaccccatctctactaaaaatacaaaaaattagccgggcgcggtggcgggcgcctgtagtcccagctactcgggaggctgaggcaggagaatggcatgaatcccaggaggcggagcttgcagcgagcagaaatcgtgccactgcactccagcctgggtgacagagcaagactctgtctcaaaaaaaaaaaaaaaaaaaaaaaaaattacagttcccattgaatcaggaatttgcagtatattgagggggtgaaatcatgttactctgcagaaaacttacaaaccaagaagtatatgaacatctagcattgcataaatgaatcccatattcattagtcatttgatttttatttatatgtccttgatatattcttgtgtaccattgtcagttgtaaactagattgtataatttttgtctattaatggattcagtagagtgattaacaatacatcagaaagaaaactatatatagttgggttgatttggtcattatattgtaaaatttagtttacttcagaaaaattgtacattttcttcagtctacacaactatttttttcaatcttttcttttttttgaaaactttttttttttttacaaccagttggtcatttttctctctttgacttttcctgagttcacattagttttatgtctgtagatcttgcatttgatttaactgaatataatagtatctgttattttatagctttctaaatatcttggtaaatatattatttcattttttcttccctacatatgtgtatgtttgtgtgtgtgtacgtgtgtgtatacatacacatacacacacaccccatctgatgtgctgcgcactctgtctctatttacatttatatatgtgtgttatatatatatttacaagtatatttatatatacatataatatatgcatatttacattaaattttttcagatattaagattgctttctcagctttcttttggttcatattttcctggtgtatttttacatttcttattttcaaccttttgtaaatttttaagtgtatcttttaaatagcatattattatattttgcttttgtttttcaatctaatctaatagtcaacatcttttaataagcttttatttaatccacttataagtatggtaattctttttctaatggggactttttctgcttttctatattttaaaatttagattctttttctgtgggctagattaaatttgttttggtgatttagaagttatgcgttctatttttgttactctgttagttacaaactgtacccatattaatttatccttgttggtttctaaaggttatcagtatttgaatcttctagtatgctcctattccttttggtctctacctctgtctcctccttctcctcctaccctggccagatcattttgctcgtgtacagattttagttccatgttaccatagattgcctttcaatctatgctgttctttcattttttaattgtggaaatctgtgttgattatttcttcctccccattttattttttctctccttctgggacttttgtttttcagaaattggcacttttacttcctccttcacatctcttagttttttgttttatgttttctatctctttgtcttttctgtgtttctctgggagagttcttcagtcaactcagcttagtgatcattcattagctgtattttaatctactttaatctctcatattgtgtcttttatgtcagctattatgtttttaatatctattatttttcctttgtttcttgtttttgttttatattctgatatttcccattatctccttgtgtatatttgctatgcgtattttaaattattgaattgaacttttcagtaattttgtgtcacatgctatatgttgtttagttggatgtcttacttctacagtatttatactctttggaagtctagctgatttggcagattctctgataatatctattggtgaaggctgagcataaggttccaatctgtgtaagtcctatgaccccttcctgaggggagaggactagcctcatggactagagaattactcttgatcctttctgctgcttgcctctattcagtgtttcactcttaaacccttggggaaaagagcaccagtaagagaaggtctcctgaggttatgattcaccagccctgagggtttggaggaggaggagaggaagagtgaatgcttgagggacatgggtctgtctgcatgttttcttcactttcccacactagaaaggcagaggtgctgacctggtattatcttttggatacttgcacaggccgtctgagctgctactgctgttgattttggcagtgaagttgccaggactgtgtgtcctgaggctaccccctggagggaaataagagcaaagtttaaaaacctctcctccagcctgttttctgactatgtctgctgctgtgtctagctgccttctgccttagactgaagcgatgcactttctcccaagaccaattcaagatgtccaccactcttcctggggttttctcactgtgcacgttaaagttttctgcttgcttttattgtttctccagttggttctggaggagggagtgaggatcctgtcatagtagactgttttggcttcttttttttttttgttaaatttatatgtgttgtcaatagcctcttgaatgccttggaataatttcagtatgtggatcttccaggaataatttttagacattagccttcttttcgttagcctatgctgcagctttgacagtgctttgtttattgagccagtgagaacaggaagatttctttatgagatagatgctgcttttgctttttttaaaataaattttattgtgtatatttgaggttatgtgtatatatatatatgtatatatgtatatatgaggttattgtgtatacatgaggttatggaatacatataggcagtatagtggttactgtagtgaagcaaatttacatatttatcattttgcatagctacatttttgtgacaaaagcagttaaaatcgatttaatgaaaactccaaatatcatacaattctattaactatatctctcatgttgtagattatataactgcattttttcatcccacatatctgctattttgtatcccttgacctctatattcccattttcttcttcctttccccctcgcccctgtaaccatcatttgtttatctatttatttatttaaacttttaagttcagggatacatgtgcaggtttgttacataggcaaccttgtgtcataggggtttgttgtacagattatttcattactcaggtatgaagtccagtacccattagttatttttcatgatcctctccctgctcccaccctccaccctctgacaatctctactgtgtgttgttcctctctatgtgtccatgtgttctcatcatttaactcccacttataagtgagaacatgtggtatttggttttctgttcctgagttagtttgctaaggataatgacctccagctccatccatgtacctgcaaaggagatgatcttgttctttatggctgcctagtattccatggtgtacatgtaccacattttctttatccagtctatcattgacggacatttagtttgattccatgtctttgcttttgtgaatagtgctgcaatgaacatatgcatgcatacatctttataatagaattatttatattcctttggatatatacccaataatgggattgctagtattgaaatggtgtttctgtcttaagtctttgaggaattgtcacattgtcttgtacaatggctgaattaattaacactcctaccgacagtgtataagtgttccttttctctacaacctctccagcatctgttatttttttgacttttaaatgatagctatccattctgactggtgtgagatggtatctcattgtgtgtttttattttattttatttttttgagacaaagtctcactctgttgctcaggctggagtgcggtggtgtgatctcggctcactgcaacctctgcctcccaggttcaagtaattctcctgcctcagcctcccgagtagctgggactacaggtgtcgcctccacgcctggctaatttttaaacttttttagtagagaaggggtttcaccatattggcctggctggtctcaaactcctgaccttgtgatccatctcccttggcctcctaaagtgctgggattgcaggcgtgagccaccacgcaagtggccttttttttttttttttttttttttgacagagccttgatctgtcacccaggctggagtgcagtgatgtgatcttggctcactgcaaccttcaccttctgggttcaagcgattctcctgcctcagcctcccaagtagctgggattacaggcgtgagccaccatacccagctgatttttgtattttaatagagacagggtttcaccatgttggacaggctggtttcaaactcctgatctcaagtgatcctcctgctttggcctcccaaagtgctggggttacagatgtgagcactgtgcctggtggcctccttatggttctgatttgcatttctctaatgatcagtgatgttgagctttttctcatatgattgtaggcctcatgtatgcatgtatgacttcttttgaaaagtgtctgttcatatcctttgcccattttttttttttttttttttgagatggagtttcccccttgttgcccacgctgcaacctccacctcccgggttcaagtgattctcctgcctcagcctcccaagtagctggaattacaggcatgtgccaccatgcttgctaattttgtattttttagtagagatggggtttcttcatgttggtcagcctggtcttgaaaactcttgatctcaggtgatctgcctaccttggcctcccaaagtgctgggattagaggcatgagccactgtgcctggcccctttgctggcttaaaaaaattttttttttcttgtaaatttgtttaagttccttatagatgctggatattagatctttgtcagatgcacagtttgcaaaaattttctcccattttgtaggttgtttactgtgttgatagtttctttcactgtgcagatctctttcatttaatttgatcccatttgtcaatttttgcttttgttgcaattgcttttgaaatctttggctgttcctatgtcctgaatggtattgcctaggttgtcttccagggtttttatagttttgggttttacatttaagtttttaatccatcttgcgttaatttttgtatatgatgtaaggaaggggtccagtttcagtcttctgcatatggctagccagctctcccagcaccatttattgaataggaaatcctttccccattgcttgtttttgtcagatttgttgaagatcagatagttgtagatgtgcagtcttatttctgggttctctattctgttccattggtctatgtgtctgtttttgtgtgagtaccatgctgttttggttactatagccttgtagtacagtttgaactctggtagcatgatgcctccagctttgttctttttgcttaggattgtcttggctatacgagctcttttttggttccatatgaattttaaaatagttttctctcgttctgtgaagaatgtagtagtttaataggaatagcattgaatacataaattgctttgggcagtatggccattttaacaatattgattcttcctatccatgagcatgggatgttttcccattggtttgttcatctatgatttctttgagcagtggtttgtagttctccttgtagagatcttttacctccctagttagctgtgttcttaagtattttatctttctgtggcagttgtgaatgggagtttatttctgatttggctctctgctgtgtgttgttggtgtataggaatgctagtgattttcacacatcgaggctttcctgaagttgtttatcggtttaagaaacttttgggctgagactatggggttttctagatataggattatgtcatctgcaaacagggatagtttgacttcctctcttcctatttggatgccctttgtttcattttttctttctttcttttgcctgattgccctggccagaacttctagtactatgttgaataggagcggtgagagagggcattcttgtcttgtgctgataaccactgtttagatgctgcttcttgaattggtgtctgagcaagagcggaagcaaatcttcatgtatttgtattttgtgacagagttggagtcatggaactctagccttttctctccaatatgcctggctctggctcccttgtctacttgccagcttcttgacacattatgaattttttttcttattttattgttttcttattggtgcctgttctagttgcttactgtggatgcagccatggttgttgttagcattgcagaaatagtggttgcaggtgtttaattttatgctggaatgtgtttttttcaacttagttttttttgtgatttttaattctgactttgtcttaatttgtctggttaatgtaaatttttagggagaagtatcaaaattattacctaaaaaggtataatacttgatttttattgaagttaaatatatataaaataaaatttgctatttttaccattttaagtgtttaattcagtgacattaattacttcacaatgttatatgaccatcaccaatatttccaaaacattttcatggctccagacagagactctgtaatcattaagcaataactactcatttccccttccccacagcccttgggaacctctagtctacttctgtctttatgaatttacctattctagatatttcacatttatataatatttgcccttttgtgtctggcttatttcacttagcacagtgttttcaagattattccatgttgtagcatgtatcagagcttcatttctttttttttttttgagacggagtcttgctctgttacccaggctggagtgcaatagcgcgatcttggctcactgcaacctccgcctcccgggttcaaaccattctccttcctcagcctcccgagtagttgggactacaggcgcccaccactacgcccagctaattttttgtatttttagtagagacggggtttcactatgttggccaggctggtctcaaactcctgacctcatgatccgcccgcctcggcctcccaaagtgctgggattacaggtgtgagccaccgcacctagcctcagagcttcatttctttttacggctgaataatattgtgttgtgtatatataccacattttgtttatccatttttctgctgatggacacaggttgtttccacctttttggctactgtaactattgctgcaatgaacggtggcatacaagtatctcttggagttactgttttcagtccttttgtgtatatacctaggagtggaattactgggtcatattctaattctatgttaattttttgaggatctgacagttttactcttttagcctgttttacccactcttgctagcaatgagtactattcttaaaaaaaaaagcattgctaatggggtacatgcaaatatctcatttttgaaaaaaccgtatctcatggatgttgtcatttgcattgctttgattatcagtgaggctgaatatttttctgcttattaataacttatatttctacttttgtaaattgcctcttcagtttttttttttttttgtaaatttaggtcactgacattttgcagagtttatattaatctccaacaaagttaacctgtttatctctgccaaaagtgtgggtcatttttaatgctgacctctgcctgttggtcttgtcaaacagtaacatctaagttctccctggcagaactcaagtccagacttcttaggaactctggattgctgaacagagtaaaagtaagtataagtaagaaatgtaattttggctgactgactgatgaacaaagcaattacatattcattactcctcaatttgtgtcattttcaaagttgataaacatgaaggctaagtcttatctaagttacttggaagaagtgtggaaagttgttatgaatccattcattccgtatattttatcttctccttaggtggtccatgagttggaactttataacacaggatattatttaggcatgttcatgaattcttttgcagtctttcaggtatgttttgcttgctatattgaaaagatattaatattttttactattgcaaaccctttcagaattagtgatcattttgagatgttaaccttttattaaatgtgtcactgaagcgcagtcttatgtaagtataatttgaaatgaaaagataatcatctttccagttttaaaagcaaatggaacaattcaccattggaaaagttaatggaattgacattaaacaaataatttttcctttatgtatatgtatttccatataaatatattttatgtatatatataatatataaatatattttatgtatatatataatatataaatatattttatgtatatatataatatataaatatattttatatatatttccttgactttgaaatggctcttatgcatgagtgtgtgtgtgtatgtgtgtgtgtgtaagactgatgtgtgtatgtgtgtttgagaaagatcaatgtgtatgtgcgtgtgtgtgtttgagagagatcgatatgtgtatgcgtgtgtgtgtgtgtttgagtgagaaagatcgatgggcatgtgcgtgtgtgtgtttgagtgagaaaggttgatgtgtgtgtgcgtgtgtgtgtgtgtttgagtgagagacagaaaggttgaatgtatgtgcatgtgtatacctaagctctcaaaaatgagcacaagtgagtcaggagtttgggagactgccttgataatttagtgagcatttaaacttgtgttttaaaagaaaataaaaattattctttttaggaatgtggactctgggtattgacagatgcaaacctcacgaaggattatattgatggtgtttgtaagtaatacatggcgacatgcttgtatttgtctttcacatgatattcaacattacttatataggtatggatattttttagatgaacatagagattgtgattttcatttttttgttctcttctcccaaaatgtttggagtttaatgtacttagaagtacatctgggccatgacatggaacgttcatctgagctcctgtctagatatttgaagtgaatgctttcctttttctctaggtaattctttgaggtagttatatttttggacatactggaagctgcttttcttctgatttgtatcacaaactgtcctattcttttggaattatttaaaaggagcaacatatttttgaaatatttttgtactccagctttttgatgttcacctagaaaatagcccagatgccatcatgccataaagtattctggtacacacacacacacacacacacagacacagacacacacacacacacagagacatagacacacacgcagacacacacacacacacacacccctcatcaatctgagttcttcctgggcaggattatatctgtacatcctagtttcttgaattgccaaatagagttggctgccaagtaataataagtgtgcttttagaaagacgtcataaaatgttttgactgaaggaaatgtataaatgtataaattagaatggttaaccttagaagggattctcttttctttcaggttaagttatactaacatcatcttgaaaggcttctagaactgtcacagtttctatccctgaattccctgtttctgtcaggtattctgttattccatgctaagcccccgggtctctttgggctggttcttgccccaacaggacacctgatcctctgtcctgaaacttaaaagataattttatagtcttgaagatgttatgaagtcattatgatctctctacattaaagacatgtggtacatttagctttcctcatataaccctctatcctagacaatcttccaagcatgtttttccatttttcagtctcagtttttacccatctttgttcttttttacatattgaatccttcttgatgcccactgtaatacccattctattgccagtaatacttactgtatcctttaccttttctgaaaaccttcttctaccttttcactgtaacagaaggaacctgatactctcactggcacattatgtctctggacacctcaagtgattgacattcattttgtatgtggagtttacaattcattctctccagtgactgtttttctaactactgtcaatgtttatttatagatgacaatgcagaatatgctgagaggtttatggaggaaaatgaaggacatattgtagatattcatgacttttctttgggtagcagtccacatgtccgaaagcattttccagagacttggatttggctagacaccaacatggggtaaaaatttataaagttctttgcccatacatattttgtttagtgtttgttttaaataagctttgcccgctttctaatgtttaagtacaaacatagtgtaactaagaactaagtagaccaaaaggattttttaggaaatgatatttattgaatctaaatacagtttttgataaagccacacataaattatggcaggaaggtctcatcaatgagaagataggcctttttttttttttttaactgaagggtgattttgacttccttgaagtctcatgattcttgttgaagaaaaattgctgggagtacatttgttgtcacaggatgggaagcactcatgattacctcctgtgacccctggcagtgctgctaactgaaccctgctcctcacaaagcattcccaggagtcacagggagaaggggcatgggtggtggaaagaattcagcttggctgataaaccccgtaccacctggcctgataattgagcaggtaaatcatgaaatccacatagtattttatagtcagctgtttaaagatacttgagttaacacatgagtgaaatctcaaggaaacaaataacagcattgacagggatacagagaaaaacttctgcaaatttagagaaaaaattggagttaagtttgaaaatgtgtatttattatctataaaaaatttgtgaaaaaataatgtttattctgaagatgtaaattttgcaggaagattttattagaatatggatcaatatgcagtattatgaccttatgatgacctattctttgaaaagttgggatttactgttttatacttaaaccttttaaatggttttaaattcagatatgtaaacaataggaaaaattgaaattcttccaaaaatagtttagattattttggcttatttcaaaatgtatcagttcttggttttgtgatgtttatatttattatcttgacttcagttacaggatttaccaagaatttgaagtaactgtacctgattctatcacttcttgggtggctactggttttgtgatctctgaggacctgggtcttggactaacaactactccagtggaggtattgtattaaagagctgcttatcagtattacggtgacattaagctaatacagcgtcagctcctcaattttttttttaaatgactgcttataatgtttatcacagtttagagattccttggctttgtcttttggtttttatctgttttatatttaagaatgtgagctatatatagctatataaactgctaaatgtgcaaagtccgtattaagatttgggtagaaaagtttattattgacctgaactaaccatctccaaaggccagaagagagagaaagaaaaagagagagagagaaagaggagaggagagagagagtgagtctttctatttgtcctcttcaagaatgaacagaacttctcaagatgttccctagccaatattccatcatgtcttttggtcaaattgcatcatatattgtttcctaagccagtcactggcaggaggaatataatgaccatgagtggcctgaattttctcatttgaaattgaaatgtaattttgatttacaaaataatcgtattcatgaaaaatacagtgtagattgaaaaatgctttgggtttatatagaaattggaattagattgtaagctcaggccactataaacagacaattcagcaacatgaatgtctgaagggacattcaagaatcattaggaacatggggcaatttttcattgtctggggctgtcctgagtattgcagactgtcacccactaactacctatagcaccttcgagtcatggtgacaatctaagacaccttcacaaatgtgcagataaactctagagggagttactgctgccagcaaaaccactggcctaaactaacccaggtttagctttagatgcaggtgtggggcttggccttttctgtaggacttggccaacaatatcagaattgggtcactgaggaggaagcacatgtattcagatgtcccacacattttctcatctgtatgtaaaaataaatcatatatatgttttagaaataatttccaatttcctctttaaatttagtcaggaagcacatgtattcagatgtcccacactagaacaggggctgttggatttggcagggcttttaaagcagattggtggagtcaatacagcatgaaagaagagcaaattgcttcgggattagacaggctgggttctagttctggctcctctacttgccagcaatatgaatttgtactagttacaaaaatctcaaaaatttaattttcttttctataaactaggagactaacagtaaccttatggggttgtaataaccaaacaaaataatttatgtgaagtgtttggttgctataaggcacttaataaagtatagcaattattatgttaagtaacataaatcaagtcaatttgccgtcattcatttgtgataagttgctgtttgctttctgttgatagcaagttgacatttctagctgaagttaaaagcttcacaggttttataaagattgcatttaattgcataaaatgtgaagaattttgacctgaataaaaatatgtactcgttgtgttctttccagctccaagccttccaaccatttttcatttttttgaatcttccctactctgttatcagaggtgaagaatttgctttggaaataactatattcaattatttgaaagatgccactgaggtaatgtattcaagcttttgttgatcatttacactacaggagaaaatcgaggtagcatgaagggattgggttgtgtagtatctgggcatttgggattctaagcactttatacatttctgggaggctgaaaatagacatgtcttgtcagtgatttcttctgctaattaatgtctaaggatatcattagcatgtctacacattacctccttgaattttcagcataggttttcctcttttgccatgtaagttccttattgtctctgaagcatgcctttctctttcctgcctccctgcattttcccctggttttccccacatctagaatgtgtggccacttctcactgccactctgtgcccactgcagttttgttttttttttttttttgagacatggtcttgctctgttgcccaggctggagtgcagtggcgtgatctcggctcactgcaacttccacctcacaggttcaagtgattctcctgcctcagcctccgagtagctgggattacaagggtgcaccaccacgcccagctaatttttgtgtttttcatagagacagagtgttgccatgttggccaggcgggtcttgatcaagtgatctgcctgccttggcctcccaaagtactggcattacaggcatgagccactgcacccgactgccattctgttatgtttgtagcccccatgtttatattttcaaggattcactattggattcacgtaccttgtatctccttagctagtcatttccctgggaggcaggaattaggttcactgtttgtgttgtgcccacagtatgttaaccaagtgactgatttttcttcccccagaataagtagagatacgtaattaactttattacatggatgaaaatgacatgatatctttaggcactttatatataattttttttaatttaaattttaattttttaagctttttattggcatatttggctgacaaagtgggaagtaaatttttttaattttttaattttactttttaacccagttatcatggtaccatgtaacaagcaaaagatctagagtctaaaggcctggattcaatgtttaatctaccacttaccagcaaatgacttaattgtagtttcctcatctgtaaaatggaaatgataattattacacccacaaaagataccttgagaagcagatgaaaacatcaatgggaaaataattcgtaaaatttaaggcctagataaatgctattattgatgagacttgcaactttgggataatttacaaaagtttacaaccaagatatgcttcaggactaatatctgagttgtactttccttggaataattttttacagagacttcaataaattcaataacatttcatgctgttttcttcaaatttttctaatgagaccagtatgttccaggatgacatagttaaatcaagctagtagtaatatcaatatatgaaatagcctttctgtgcacatccttaccatctaatggcttcagatagtgagagaatttaaagttagtgggaggactagaaatggggctgaagatcgccctttccccatgtatcttgaggttgaggggaaagcatagaaaagaaatgaagtttttcctgatactctttgatactctccttggtcgaatctttgtctcatcttttcgctagtcttgagcctcacagatttgacagtacttaaactggtgataaaagagcactttactgaagagcatctattatacaaaagctttgatttatttttttctttcaggttaaggtaatcattgagaaaagtgacaaatttgatattctaatgacttcaaatgaaataaatgccacaggccaccagcagacccttctggttcccagtgaggatggggcaactgttctttttcccatcaggccaacacatctgggagaaattcctatcacagtcacagctctttcacccactgcttctgatgctgtcacccagatgattttagtaaaggtaaatatttgatgtctgaaagaagtgaaatggaaatacgtaattaaaaaggaagcagaaggttttttctcttggttaaatttgttggcatatctagtaggtcatcttctttacccttctggtaatgcctaatcactttctaatctgtatgtaaaaataaatcatttagaaataattgccaatttcctctttaaatttagtcaggaatgtgactataaagactaacgtctcttttgcagtcatttacatctacagactgtgttacgttgggatcctattaaaacacggccaagtcgatttgtagatttggaattttggaatttttcagtgaaggtaaaagagattttgtagatttttttcagagaagacattctagacagaaagataatgagcatagtggataaacacttgtattctggggtgaggcaaccctgtgtttgaatctcagctctgccaagtgtgattttgaacaaggcatttaatctccccctctttggataataataggaactacctcaaagggtttttttccttacattttcatcttcttctttgtcattttcaaggccagtccatgagatgccttatctaatttaactagaacttactaacagatttgaagtaagaataacaaaatggtacgcgctgtgtcatcagatttaattcatttccatggaaatggtgcctattaagtgtaaatcctgtgaaaaacacgtttcagttaatgaagggtactgtacttagtgagaaaatctaaaaggaaaaattaatcaaagttatggtaattttttgtaatacagactaacaagaaaaactcattctgtgaaatgaatgtattacttgtttaaataaaatatctaatttaaagaaaacaaaataagaaatgataggtgcctatttagccacacacaaacctcagacacaacaggtcagatgtttgtgctcatatctgcgtatagttctctgtaaacatgtgagtagagaccatgttaattgtgttcatttttttcaacaggctgaaggaatagaaaaatcatattcacaatccatcttattagacttgactgacaataggctacagagtaccctgaaaactttgagtttctcatttcctcctaatacagtgactggcagtgaaagagttcagatcactgcaattggtaagaatagagtatatcaccatctattggtttaattgtatatgatcatatatgttgttcttgtaattatagatgtattttcttattgagtcctaataagaagagatggcaaaagtttttaattgggcccaacaactcattataatatgaaggctagcaaattatgtatcctaaaactgttctcaatcttcaatgtgcataagaatcacctgggagtcttgtttaaaagcaaattctggtttagtaggtctggagtggggcctgggaatctgcttttctaacaagctcctaggtgttggtgatactctggcttgtagaccacactttgagtagcaaggcctcactatactgtggctggagggagggttcattcctaagagcagagcttctggcttctgtggctctccaccactggtgaatatcagaatcttctaaggagctctgtaaatacagaaacatctgggttctactctaaacctactaagtcagaatcacttgggctatggcttggtcatgtatatcttaaaaaactttcacaagtgattctgataaccaaaggttgagtactcctccctagggcagttctctgtgcaggatatgagtaacctttacagtaggaagttactcactgacttcggtcgcctctcctagttactttccataacataatagtacttttcaaaaattggcaatttataattgtataaatttatgggatacaaagtgatattatggcttatgaatgcaatgtggaataactaaatcaagctggttgacgtagtcatcacctcaaatacttaactgtttttttttgtgggaagaacatttgaaatttgctgtctgagcattttttttttttgaggcggagtctcgctctgtcgcccaggctggagtgcagtggcgcgaacttggctcactgcaagctctgcttcccaggttcacgccattctcctgccacagcctcccgagtagttgggactacaggcacccgccaccatgcctggctaattttttttttttgtattttttagtagagatggggtttcaccatgttagccaggatggtctccatctcctgacttcatgatccacccgcctcggcctcccaaagtgctgggattacaggcgtgagccaccgcgcccggccttttttttttttttttcctttgatggagtcttgctctgtctcccaggctagagtgcagtggcaggatcttggctcactgcaacctctgcctcttggggttcaagcgagtctcctgcctcagcctcctgagtagctggaattacaggcacgtgccaccacacccagctagtttttgtagttttagtagagatgggcttttgcagtgttggccaggctggtctcgaacccctgacccaaagtgctgggattacaggtgtgagccatggcactcagcctttcttagcaatttggaaatttacaatactcttgttattaactatatttaccatgctaaaagtcctttttttttttttgagatggagtctttctctgtagcccaggctggagtgcagtggtgtgatctcggtttactgcaaccaccgcctactgggtttaagcagttcttataccttggcctcctatgaagatgggactacaggtgtgtgccaccatgcccggctaattttttatattttcattagagacgggatttcaccatgttggccaggctggtctcaaacccctcacctcaggtgatccacccacctcagcctcccaaagtgccaggattacaggcatgagccattgcgcccagcctaaaagtactttttaattagacatagtgtctacacaaatggtgttattaatcagggttctccagagaaacagaaccaataggagatacttacatataaaaggaggtttattatgaggaattggctcatgcaattatggaggctgagaagtcccatgatctgcttttgcaagctggagacccaggaaggctggtagtactcactctgagtccaaaggcctgtgaagcagaggagctgatgatgtaaatcccagtcctaggagaagatgagatgagatgtctgagctcaagtagtgaggcaggaaaaaaagggtgaattcctccttcctcaagcttttgtctattcaggctgtcagtggattggatggtgcccacacacactggggaggacaatctgctggacccagtccaccaattcaaatgctaatgtcatctagaaacaccctcacagacactcagaagcaatgcttaatctaggcaccccttggctcacttaagttgacacacaaaattaaccctcacaaatggtttgtttatatagttgtgctttacaaataactgaagaaaacattttaattaatgacgtctaatagtttgttaggtctttaaggtgttaggacctaaaacacttttttacagttcttttatatttcactggcagatgtaatgcttttttattataacccaaacaaccaatccataggcagaggactttatttggaggcatatatatacatacatacatatatatatatatatatatatatatatatatatatatatacacacacacacatacatatatatatatatatatatatatatataatttttttttggaagaggcagggtttagctatgtttgccccaggctggacttgaacttcttgaacttctgagctcatgtagtcctcctgcatcagccccttgcataactgggactacaggcatgcaccactgtgcctggccaattcttaaaaggaattaaataagctctctatttaggggaataaattctgcttaagcatctcccacagtgttgggatgctgggacatgcactacacatacatacacacacacacacgcacacatatacacagagggaaggagcctggctttttaaatatgtaccatcactccttacacaggaacgattctgtctgtcgtcatggaaataccccgaggcttaatttttatgcttgatgtaaagaacggattttcaagttttatttttacatgttgttttaaagacctattttgtatcccagaatgtacgaattttagcttgcttctttgaactttgatagtctatgttcactttgaatattaaacacatagcctgcagtggtaataatataacctctatttttttctttgtattcacatctaaaatttaagctatactggcacagcttcagtctattcatatgaaacaggttcttttcccttttttttcatattcattttttaggatcacattttcactaggtatttggacttggcttggtataagttttcaaaataaactacatagaaagatactcttatctatacagcttaacaatggcagggccaaaattagaactcagccttcatatttctgaatttttgctactttccctgagttgtggtgttaggatgtgggtagagggtttttaaagcatgtgttttgtttaattttagattactaactttgaatccttttccgaatccttttgatcctgagattaattgaaatacttatatttgttgttactaaacagaacacattggaaaacactacaatcctcattgtttttttaaaaaattatttctcaagttcttgtggtgtattagtaagaaataagaataaaattttgtttgcgtgaagaatactactaataaaatgtttctttcctgtatgagtgatggtgtcttactgatcaattctgtacatttttttaaagatttttaaaaaaattattttttgcctaatttatgccacatgcttaactgagctaaaaatgtcctctttcatcacatgacctacaagttcagtaccagagcattgttatttttttgaccagtcttcctaaaagcttggtgtaaagttccaactctgttccaagcagtggaataatgatattgcttcaatgacagaggtcttctgtactcagtggaagtctctttgccaccagcaggtcgttgttactgagtatttactgaatgaactgcatgtcttgtgcttccaggagatgttcttggtccttccatcaatggcttagcctcattgattcggatgccttatggctgtggtgaacagaacatgataaattttgctccaaatatttacattttggattatctgactaaaaagaaacaactgacagataatttgaaagaaaaagctctttcatttatgaggcaaggtaagcattttagagacctacatttgttcgtagaaaaaaatttgtttttttcaggtagggttcattctagaccatatttcaaaatagatggattttgtcttaggtaagtgatgggctacacggtgttgacatgtgcaggaagtgcaaacaatggaaagctgttacaattcttcctttagctaactattcactcactgctgctaagatgtttgttagtaatggcttaagagttagtttctggtgggagggcttgtattatactaagggatctgaaatttaaaactctttaaaaatctagaggaatactcattcattttattacacatttgtggagtgtttcttagtgccaggatcagttttcgtgccaagaaaacagagggagccagggcctctcttcttaaagaattcgctgctcaatggagaagatggtttgtatgtaaacagacgcagtgccgtgtggtggggaccttctcagtgcatttaaaatgatgaggaggacctgctggaccctgaggaaatgtcatgctagtgaagactgtatcttgacaccttgaaaggtggaaactgttcacaggcaccagatcctttgttttggcaacttgttaataacagcagctaacatgagttgagtgtgcactgtgtggcaggcagtgttctaaacactttacatctcatacctcattggaggctcaccattagtattagcatgatcctgtttttttgcagatgaggaagctgaggtgcagaaaagttagctaacttgcccagggtcatatagtcatacagagcttggatttggactctgagcctatgctcttgacatccatacctaggaggaaacaaagagatgtgagacacgtttgatgttaatagtaaagtaaatttgattttctgaaatactccaaaagcttaccaaagttacagtctcagttttgtatttccttattagtggacctctagcacaaactctctgtggctgagtttttctctctgcacaatttgtatgatatatcccgtccatcaaattcatgaggattagaagggttcacacaaactgattaaaaatgaggattcactataatctaagagaaatatagttcaacgctttccaactcctaatttttttagtttttgtttttttataacaaatggattaaatgaaaagtaggggcaagctattaattgattgctaatttctccataggagaattagaaaactcagtaaagacgccattgtaatgtgagcttttcttccaggttccattattgtgtagagacctttttattctaaaataattctatgtaatgacagtaataacaactaaatctgtttaaatgttttatgcatgtttcatttaattctcacaaaaactctaggagcaggtgtcctattattatttccattttatagatgaggaaattgaggcacagagaggttaaagaatttacccatggtggtctggttccaccgtccaccttgttcctcagaacactatgggataattctgatttgcagtgttctctggtttttagaagcaatgggatatgatggaaaggaccaggaatcgggacgggatgcttgagtatcaccaccgtgtaagaagtctcactggaggttttgataaaatattaagggaggaacatggggtcctgtagagaaggaggcaccaaaggttagaatatggggtgtcagattagactgaagtaagctgtaaggtgttgggtttaagtagatgagctggagtcagtgtctgaagatctccctgggataggatggcacagacaaaggctgaatgggagtcaaggggttgcgggtcaggaacaatgcagtgtatgagatcacaaaccaagggagaccagcgtttagaatcagggctgagtgtggcctgagttctgatgtggggaaggacatagtggtatattttcccttagattagggccagaccatgcagacactatgaccggccctgaaatgcaccaggtggttaggtcctctgggatatttgtagagatccagcagttggaatttcctgtatagagttgcccatgtaaaattatccctgtttatacacatttgtggattggtcgtgttttaaatatatacgtacaagaataacctttgtcaaattttattataattaaatttaagtggtaccaagtggtctctgtggtatattgtgtgccatgctaaacacaaatgagatctttacacattggcataatggctgtaattaaggagataagtaaaaattatttgggattgtcatgaatgaacgttgtaccttttgaaaacaagattccaatttgtattcaagatttagtttttctggtttgaagtagaaactacataggaattagactggtgctttataatttggcatacattctttgggatagtttaatacaataaggtaaaatatttcagaaaatgccacatataactccatatttacatatgctttatgaactgtaactctggctaatcaaatattaatgctttaaacagaaagcataaattttacatagcttgaaacatgtaagcagtgaaaactcattccttaaaaataatttcagtgtgtgtcctagatacttttgctgtggatcagcagccatcctacaaaatgaatggtccaaatcctcagtatctgttgttttcccaaagcagtgctagtccctcaggtcagtcctggccaggtaggtggccaaactgtagtttttcaaagtaacccagaaagggtctctactgattgcctgagatccctcctcacatctgttggttgttagaaggtacagtggccagagtgcaaaaaaagcatcgttctctaaatgccaagcagtcctcccaagtgttaagaatgccgagcgctacagctgtaagtaggcgagtttccccttgggaggaagtagatcaggggcatagcactggctgtggaggcagtcacacctgggcttgagtcctggctcccaccttggaacaggttcttagtgtctccaaggcttggtttttttacctggaagacagggataataaaagaacccacttagtagggttgtttttaggagtcagtgagaataaaagaacccacgtggtagggttgttttgaggagtcagtgagatatgtcagcattttattcaacacgtagtaagtgcacaacaaatatcagctatagtagaattagttgcctctaactagggagttagaggttaatgtcagtgaataaatcctgtccattctccctctaaaaacctgtatgaaattcttctatttctctccatcccactgctaattgttccattcaagcatgattgctcactggactactccaatggcttcctgactagtctttttctgtgttccctccccttcagtacattctccatataatgtaaaagggatcttagaaaatgtcaagatcctgtcacttgcttgcttatgatcctgcagtgggctcccggcttcagcctacagggtcctgggtgatctggcttggcctccctccttagcctcatctggagctggctgtatctggaacactctgagctccatgctgcttcagggacatgatgctttcccttccttctcctggcatgctttctccctaggtctttccatggctgctccttttcatcattcagttgatgtttgcctcagagtggccttccctgaccacttagtaactccaatttgtactactccattttatttcttcacttaacattatttaaaattatcctgtccatcatctgtcctggcatttagagggggagctctgtgacagtggggaccatgtttgaccttcattgtatagctatgtgggcatctcaataaatccagaatgggcgaataacttattaccaatattaacttttttggactttaggtccatcatcctaatgtggatattgggtccagaagatctctgaagcgcccccacagtgtagcatgatgatctctgggcactaatgggtcgacctggccttggcattctcttagcagctaagaaatgtgaccagtgatttccatgtgctactctttttgctggtgaagtggctggtgaaagtcagcacagtggagctccccaaaaatacatcatctcacatgctgaactaaattatatttcaaagtagtggacgaaagcttcttggtataatgcttttcattatgaaatcagtgtctcatttcagagactctcttttttcttttgccatcacatttgccaaagtcctttaaatatactgtagttgtttttattttttaagaaattaaagtggcttcagcgtgagtcatgattatattatttaaatgtcatttatgaacagcgcattgttttacttaaatcatgcttggcccaggagttctgtaacctaacccattattttgttggtcgaaacaacagctacatcattgaatgaagtgtctttgctgtcaaaaaggaaaatggaaccataacatgaaaactgtttttgataaggactggaaatccagaacctgttaattgaagatttaaaccatttgttttcctcagatatttaaatcacagtgcctgcagttcaactttttaaagtgagactcaaaccaagtctaattgaaaacactatatttcctccattgaaataaaaataagagaaagaaagcttcagaattcggatgttgccattggtcacaagtatggctagtggccatagcttaaaaaactgtgatgttctcactttccatttcatgtcatagaaagtaaacaaattcataatgatttcttttaatacagagaattttttttatcagcttattaccagagaaaattcttgaaatagtcacaaatagccgactttacttcctttatttacatgtaattttgacacgaggtaaatcaagtcaaactatgtttagaatgttactttttcattgtttgtgagcagtatttttatctttattataataaattttgaaattttacattcatggttatcccaaagaaaattcataacccagaacaggatgtgtcttatctggccctttatgaagggctcatgggtttttatcttaagagcctctggacttcttctgcatttcaattttcagaagtctatgaaagttctgagcatatgattacttttcaaactcaagagccattcctaaaatgattaacttaaaggtgatactcttatttcttcataaacttttggagagagctatgtttttgcttttctcgtctgttgtgatgcagagtctccaacttagatgactgcactggaaggctgagttgttgtattaacaacaaacattatagacgagtcatcagtgtcctgtttttttttttttcttttttttgtgatggagtcttgctctgtcatccagtctggagtacagtggtacgatcttggctcactgcaacctccgcctcccaggttcaagcgattctcctgcttcagcctcccgagtagctgggactacaggtgtgtgccaccacacctggctaatttttgtatttttagtagagacgggactttgccgtattagccaggctggtttcaaactcctgtcctcaggtaatccacccgccttggcctcccaaagtgctgggattataggcatgagccactgtgcctggacctgttttgtttatgggatggaaattaggcctgatacactgggacgatttggaggacagtcgagggatccacaatgatgcatgctggtttaagatgaggaaggaaacctcacaggacactcccacaaggagacatacaagttctctccaggttgtgaatttctcccttacttttccatgggagcagagctggtggtttggattctcggtgttatctaagcctgctcaagaaattcactgcaaaactggtgattgtctgtggcctcttctctgggctggctgcctctagtggaagaatggtgctagttgttgatattaatggggaatgttggaggtcagccacctgaggggtaatttccataagcactgatctcatctccatgatctcatctctgaccagtttcacaatatctcatacttggaactgccgttgttgatgtgatctgggggtgtggaggcacatggtcctctccttgaggttggtctttctgtcacaaaagtacctcaaacttttgtgtagggattgagggcctcaaacctattttcttttttcttcttccctctcctctccttctcctctcttctttccttttcctcttttttcttaggttgaattcatagttaaactctggctatctggagaatttagtccttaattaaaaattgagggagaatgtcctggactctcttgctgatttcttttgtgaacattaattattttgcttctctgtgatccctggctgcctctgaaaaatgagataatatactgcatttttaaaggttatgtgaaaactaaaacatgataaaatgaactagagtagtgataatgcctatcatttaattttttccacttttgtttatgttttgaacatgtagaacattaacatgcttccaaaagacaaacttattttgagacatatattcaaaagagtgtctcttcttccccttttctttctccctacctctcattggtaactatatcaggcggttcttgcattactataaagaaatacccgagtctgggtaatttataaggaaagaggtttaattggctcatgattctgcaggctgtgcaggaagcatagcgccggcatttccccctaggaaggtctcaggaagcttacagttgtggcagaaggtgaactgggaacaggcacatcacatggtgaaaacaaggacaagagagacagtgttgtggggaggtgccacacacttttaaatgaccagatcttacagtaactcactcactatctcaaggacagcaccaagatccagtcacctcccactgggccttacctccaacattgaggattataattgaacatgagatttgtgtggggacaaatataccagtaacctacttcattagtttctagactatcttttctctctctccttttgcgaaaataaatgtatacatatatgttttctcatttccccccgcaattttttttttttttttaaagacagggtgtctccctttgcccaggctgaagtgcagtggcacaatcatggttcactgcagccttgacttactgggctcaggtgattctcccacttcagccttctgaacaggtgggactacaggcacatgccaccatgctaattttttttttgtatttttgtagagacaggcttttgtcatattgcccaggctggtctcaaactcctaggctcaagtgatccactcgccttggcctcccaaagtgctgaaccttggcaataggtgaaccttggcgcctcgcctcatttcccctttttattacacagaagatagtatatctatatgtactattttacactttgcctttttcacttaacagtgtatccaggaaattactctgcatcagttgaccgagatattcctcattctttttttcacagctgcatagtactctgtcatgtgtgtgtaccatagtttattcaatcagtctccagttttggggcactaagattgtttccattatgttacaattacagatgatgctgtaatgaataatcttctgcgtatatatttttgtattgttggaggtgtgtcttcagggtagattcctagaactgggattactgggtcagagggtaaagacattcccctacatggtagttgtaaccttctgaattccctctagcagtggatcagtgctggtttccatacagctcacccaacagaaggagtggtcagacttttgaatcttaatgctaatctgatgggagagaaatggtatctcagtgtaggtttaatttgagtttctcctgttatgaagttgaatgtgttttctatattaagatttgtttttatatttttgtcttttgtgacttatctgttttgccttttattcacttatttttatagggctttttatcctttaccctaatttttaaaaagttctttatatatgtatatacatgtaagtaataacatataaacatacataaaaattacataatattgatattagctatttatccatcttatatgttgcaaatatggtcttaatttatttgttaagccttgcttatagtgtgttttgccttggaatagtttaaaaactttaaaaaaatagtcaaatgcatcaatttttttattttattgcatctggtgcttagagagccttcctctacacctatattagagagtaatgcctattgtttgttgagagctttccatgtaaaaggtacttactgaagtcttttcttcttttatcatgtttaataattggaagagctctgtgatttactaggagacagtggccttggagccagtgagaagttggctaatgcccaacttcactccctgttagctgtgtgaccatgcacatggtatctgtatccgctgagtttcagtctcattatctgtgaaaaagggaataataatagcatctatgtcagagggtccttgtgagaattacctgagttaatcctgcaaaggactttgaacagttcctgacatctaatgagtgctgaatgaaagttggctaattactgcaccgtaataattcaattagaaacataaaggtataatctaatgttcccttcttcaaattaagcaaagttttgtcatcactttaaatgtttatatttcttttaccataagtcttaaatatcaccatgaaacagagtatcttgttttctttttttctttatgcattttgttttattgtaacttaaatcagatacttaaatctagggtttcttttggaaagactcagggagaagtttgggacttgaaggtgagaacacattaactgtaatttcaaaccattaatgcttatgtttagttagtcaaatatgaattttacttatagttctggatgcttctaaaatatggtatttataaagtcaaatttgtttattactgcagtttactggggaaggatttcaacatttcacaaatgagtatggttgccaagctttgccatgtctgtgctgcaaagctcaggctgtgtgcccttacctgctaatagtggaattgtgtaatttttagaaggatttttggctatcagagagtcattgataatgccttgagctggaaatgttcctgctaatggttgcttttttagtgataagttattgctatcttaactttatttttagcaagttagtttattgtgggttgtttggtgaatcctttagagtttggcctatgttttctcacactggactttgagatctgtatgcattgctttgcaaatatgaaacatctgctttttatttgcaatcatttatttgtaactatttgcaaatatgacacatttgcttttattaatgcagatacgtgagccttaaccccctacctaatttacttctgtaatgatacttcattgccaccactgagcatgtgtatatgtgtgtgtgtgtgtgtgtgtgtgtgtgtgtgtatatatatatatatatttttttttttttttttttttttagtggaaacatggaattggtgggtaggcaggcaagttggttttttggtttacctcagttggccatggccccaaaatttaagagccaccgttttagattattttgcatttcctcctctgtattgctggtctaagaatagaaaatacttttattttctactttggccttaaacttaaattaatgataccctacatagtatttttcttctgtagcaaacagtgctagatgactaagcattgaaacaattttgatgaacactagacagttaaataaaagtctgcctttaatttgcttgcttttgaatggctagaagcatcatctatgccatagtgatcttttaatttactttaatttgggatatcacaggcttttttttttttttttgagatggaattttatttgctcttgttgcctaggctggagtgcaatgacgcaaatctcggctcactgcaacctctgcttcctgggttcaagcgattctcctgcctcagcctcccgagtagctgggattacaggcatgtgccaccatgcccggctactttttgtatttttaatagagatggggtttcaccatgttggtcaagctggtctcgaagtcctgacttcaggcaatccacctgcttcggcctcccaaagcgctgggattataggtgtgagccactgcacccggctgggatatcacagtttttattttatgcattctgcttgaaaagtcctggcattttaaatttccaacagcacttaaaatagaaagtactcaatattagctcttggtttgatttcttctttccccctctctgcccatatttcctcaatatgaagtcataattagaaactttcatccattgcaagttaatgattactttgactatctgtctatttttgtgtctaggttaccagagagaacttctctatcagagggaagatggctctttcagtgcttttgggaattatgacccttctgggagcacttggtaagtgtttttgccaactgaacaaatccgtgtcatggaatgggctttcactaggtcacaatagccacgaaattgacagatatatctctatatattatagactgggaggttgctttttccttagtctggctttaaaaagagattttctttttaaagtattattttcaaacattaacaaatcaaatgtttttatttagaaaagataagttataaatcctcttttttgtgtgtgtgtgtgtgtggaagaaacagaaataaaaatactttatgatgatggtgcagctgataaaatcagttagaaatgccgggtgattgtgacacagcttttttcttaatcttccatgactaatacaagtgttgtgttactgcggtcaatgtagtttaagtttgtgtgtgtgtgtgtgtgtgtgtaaaaaacaaacactgatggaattaagtatgaacagccagtttcctccagactggaatctctatgtggctgattttggatgattaatctctcttcttgtacttatcttcaatttcctattttactcagaaaaagattgactcactgtatcaatcaggatagactaggagtgctgtggtaacaaccaacctactcaatctaagcaattaacaatgaagggatttcttgttcatgctgcctttccattgtggtcagcagggggctctgcagctgccaacgtgtccacgtctccaaaaggaggctccaggtttgccacagcccggaaagaggaggctggagtctatagcactggcaattagagacttcatcctgagtgtatcatttctactcattttatccttctcagagctggtcacatggctatgcctaacctcactggggcaggaaagtgaattcctctgtgtaaccaaagtaaaagagaactgtatattattgaatatcagtaatgtttaccacatgaaactttatataacatgaaacagatctgcttcaaattttctcttggccttggcctgactcaggatatagaaccataaatagaaagctttcagtgttgtattgcttgatgttctttttacctcagtatagtgttttgtagcagggactggcaaacttttctgtaaagggtcagattgtaagtatttcaggcattttgggccacgtagagtctccgttgcatgctcttccctcttcctccctctcctccctctttctttcctgtctttgtctttttcttttccttcttttaaaacccgctcttaggtggtggtgttggcaggtgggggctgggttggtgcacacataaacaggccctgggctgtatttggcttgagggccagatttgggccaggcagatttggcccacaggctgcagttggctaactcccattctataggagagaaaaatatcattttccccacctgaagtactacagtttgcttgtgaactatgtatgcattcttcacccacagctttggggctgactgaagcgtgttggagctcttctttggtaaatatctagaacagtccaaagatgaataaccttggacaatttatttaactctcttggactgtcagattctcagtctacaaaataatggagctggattcaacagacacattaaaaaatgctcatcatcactggccatcagagaaatgtaaatcaaaaccacaatgagataccatctcacaccagttagaatggcgatcattataaaggcaggaaacaacaggtgctggagaagttgtggagagataggaatacttttacactgttggtgggaccataaactagttcaaccattgtggaagacagtgtggtgattcctcaaggatctagaactagaaataccatttgacccagctgtggggaaaagaaagagagatcagattgttaccgtgtctgtgtagaaagaagtagacataggagactccattttgttctgtactaagaaaaattcttctgccttgagatgctgttaatctgtaaccttacccccaaccctgagctctctgaaacatgtgctgtgtcaactcagggttaaagaattaagtgctgtgctttagatatgcatacacataaacatctcaatgccttaaagagcagtattgctgcccgcatgtcccacctccagccctaaggcaggtttcccctatctcagtagatggaacatacaatcggattttataccgagacattccattgcccagggacgggcaggagacagatgccttcctcttatctcaactgcaaagaggtgttccttctgcttatactaatcctcctcagcacagaccctttacgggtgttgggctgggggacggtcaggtctttcccttcccacgaggccacatttcagactatcacatggggagaaaccttggacaatacctggctttcctaggcagaggtccctgcagccttccgcagtgtttgtgtccctgggtacttgagattagggagtggtgatgactcttaacgagcatgctgccttcaagcatctgtttaacaaggcacatcttacacagcccttaatccatttaaccctgagttgacacagcacatgtttcagagggcacggggttgggggtaaggttacagattaacagcatctcaaggcagaagaatttttcttagtacagaacaaaatggagtctcctatgtctacttctttctacacagacacagcaacaatctgatctctctttcttttccccacacccagccatcccattactgggtatatacccaaaggattataaatcatgctgctataaagacacatgcacacgtatgtttattgcggcactattcacaatagcaaagacttggaaccagcccaaatgtccatcaatgatagactggattaagaaaatgtggcacatatacaccatggaatactatgcagccataaaaaaggatgagttcatgtcctttgtagggacatggatgaagctggaaaccatcattctcagcaaactatcgcaaggacaaaaaaccaaacaccacatgttctcactcataggtggaaattgaacaatgagaacacttggacacaggaaggggaacattacacaccgggacctgttgtggggtggggggatgggggagggatagcattaggagacatacctaatgtaaatgacgcgttaatgggtgcagcacaccaacatggcacatgtacacatatgtaacaaacctgcacgttgtgcacatgtaccctagaacttaaagtataataaataaaaataaaataaaataaaattaaattaaaaaatggagctggattagatcatttctaaattccttttcaaatctgagatttttgagtcaacatggaatttcttggccaagcccaagtggaaaccagttctgcctgctagagagagttgcttaccttgtccctttgctctttcttttttgatttttttctttccttgttccatcttcagtgattccccctttgatgaatcttctgatgggggaaaaagtgttgttgttttgcttgctcggtgttatttggtggaccttataaagtgtattttatgtaatttttttctcttttcataaaggttgtcagcttttgttttaagatgtttccttgaagccgatccttacatagatattgatcagaatgtgttacacagaacatacacttggcttaaaggacatcagaaatccaacggtgaattttgggatccaggaagagtgattcatagtgagcttcaaggtggcaataaaagtccagtaacacttacagcctatattgtaacttctctcctgggatatagaaagtatcaggtatttcgtatttaatttaataaatgatagatgggaaattcaaggaaggtaggtcttaatgggtcaaatatgtgtgtggaaacttaacaagttgcagctttacaacacatgtgaaatctgaatttgagtactcttttgctttgcatttgtggccatgttccaaaatctgagaataaaacattaacccactctttcagaataactaagagaattctaaaaatgctttttaatgtatgtattgtacttgctattggtaagataagtcaatacatgttttatcattgaaaaagttaatttctgaggggaaagaaaattatttaaaatttgacaatgtgttctagcaagtttagattgcaaaggattttttacttataaaacatcatggaacagttacaatatctgttaatttagtgctgagaacacccataccctgaaaagtgtgttgaatgggcatggatgcctggatgagaatgagtatgcgtggaaaggtatgctgacgagcttaagtttgctccagagctgtcctggtgattgatgcctttactgcttactgcctgctgcattttatgagatcaccaaagtcattctctttattaggacccccactattttcctattctactagtaggcatgtagaagctaaacttttcctgaacttagggccgcactaccagagatcaaatataagaaatatatttctcaagcagtttgctgttcttatctgagtctgtgatactgagtgggagaaacactggcaaaagctctacttttttcttctagggaatgacacctgtttacttataaaaactgaaaaacagtattattttcaaaatgcatggcaaatctttaaatgtcaatgatcatggttgattttcattgcctagtacaaggtcaggtacttcatagacactgaacttattttttaaatgcatgtttcaaagtactttttgtttcagtatgtggtaatgggttactctgaatagtaaaaaacatactttttttcttccaagcctaacattgatgtgcaagagtctatccattttttggagtctgaattcagtagaggaatttcagacaattatactctagcccttataacttatgcattgtcatcagtggggagtcctaaagcgaaggaagctttgaatatgctgacttggagagcagaacaagaaggtaatgtgctgggcccacttgaggttgttatgctttatgaaatatataacttacatgagaaaaatttttagccaggtttgaaattgattacatctgcatcttttggtgaaaagtaaaacacataatgagatcaggatgggcctgacatggccacaatgcttctggtctccccagggtttttttaacagaatttcagggctcagatgtctctttattttagatatgtgatgccctatgtcagttaccctttgagtgtctgataccatttctggtttggcagccttgtagtttgctaagaccttgggttctggagagacaggttaaatcctggttctgcaacttacctttatgaggttcagttttcccaactgtaaagtggaaatggcacctattttagagtggctgtgaggattaaatgagataatgtgcaatgctgctgcatagcaaatgctcaaaaataggaactaaaatgctaattaaaagaaatgtgaataccaaaaaatgctgctagtaagtggattatgtgtattttatatacaaagtggacagggatccaggtgtgtgtgtgtgtgtgtgtgtgtgtgtgtgtgtgtgtgtaagaaagagagagatggaagtgggtgggcagaaataagataatgtccagtgattcaaatttctgttaattcaagaagggataattgtagaaagtgtttagaggcttctgagactgtaaaaaatattgtattaacagtaacttagattgaatccttgttacctattccaaagctggggactagaagattattgcttagaggctgaagcagtctttgacattttttcttcttgtctgcttggctaagtggtagttatttaatattccacctaagtgtagtcatcatctaaatagtaatatttgagagagggcaccaagtaggatggtcctctggggactagagcagaattatctctaggaaggttgttgagttagctggggatcctaattttttttcctgggggcttgaacctcaaactgttaacaccaaccttcagataatgaaaatgggagagtccagaatattagagctagttaatggcagattcccagaataggattcttttcaatgtgtcttaaaatattttggggatggcctggtcagataagtaacgtgcattatcttctgaaatatattattttttccttttatttatagctatttagtcttgagccaaatatagggaatttctcataggaaaactattttcatcaaaacatcctcaaatgtaggcaatgggaaaaggatgaaaatttacaagtatataggttgagcatccctaatccaaaaatctgaaatccaaaatgctccaatgagcatttcctttgagtatcatgtcagtgctcaaaaagtttcagatttttgagcatttcagattttggaatgtatgtatgctgtaaatattccaaaaattcaaacaaaacagaaattggacacacttctggccccaagctttttggataagatatacttaacttgtaatagtttaaaaaagcaacatataggcacatgtatacatatgtatgtgtgtgtgtgtttgtgataaataaatacatgtctggcataaataaatacatgtatacaagtatatattttttatgctagttaagtacaacttggaccagagtaggaatatttaatggtataaaatgtaatttttctggataattgatcagaatgttattacttttctcttgcaggtggcatgcaattctgggtgtcatcagagtccaaactttctgactcctggcagccacgctccctggatattgaagttgcagcctatgcactgctctcacacttcttacaatttcagacttctgagggaatcccaattatgaggtggctaagcaggcaaagaaatagcttgggtggttttgcatctactcaggtgagagatgatagttttttccctttaaactataatatataatatagatttatttattatatatattttatatataatatatagtatatattatataaatcatatgttatatataaaaaatatttttaaaagtatgtggttgcattttttccttgatttcataaaattacttggcagtttcaaagtttagtaacttaagcaaaaggctaaattgattaattttaatttttttctcctcattactatgaatttcatgtctgatatttatatggaataaatcagttccccatctgccacttttcatctgtggtaactgatataagagtagatgttcagttccatatagcaaatattttctattttcttttcttctttttggaaaggaaaaactgaaacttttaatttactgataatatgatcatttatgagcaaaattcagtgggatctacagaaatgctactaggattaacaagtgaatttagtaacattgtggtataaaaaaatcattgtacagaaatccattgtatctatatataagcaatggaaatgcaaatcaaaatagcataacatgtgaactgtttagggattaatctgacaaaaatcaataagatctatacactaaaaactataaaacatttcagcaaacattttctgagcctctcctgtactctaggccaaggacattcaaatatgaatcagggagcattccactctgaaggaaggtgtatgaatatccagcaacaaaatactactaaatttactctttgaagaccttgatatatacttatatgtacaaatgtttttcttccctcaacaggataccactgtggctttaaaggctctgtctgaatttgcagccctaatgaatacagaaaggacaaatatccaagtgaccgtgacggggcctagctcaccaagtcctgtaaagtttctgattgacacacacaaccgcttactccttcagacagcagaggtgtgggcaaggggcagttatttaaaaatcagtgtagacaattctttatgctggaatactgctttatttgtaatctgttgatttcaacaaagacttgtttccagagctctgtagagtaatagggagaagtggtgcccttctttggctgaatttgctgagctctggaagggtggggaactttggaaagattggtggaacaggagaaaacacgggcactgtaacattgggaaaggaatgaacatagaaacctgttgagtttctattcttcataggcactgtgctagattactttacgtatgctattgcatttacttctcaaagtaactctaagaagtaagtacatctatccccatcatacatatgataaaactgaggctgagagaggttaagtgacttgctcaagatcatgttactagtaacagtagagctaggatttgaactcatcattccaaagaccatgttcttttcagctgctccacatgtcttcttaggagaattgatagaaccggtagtagaattcttactttaactggaataaaagaatatgctagttcttaactttattcccttgatcagttttgtgggaggttaagtacaatggatgaaggtgataacttcaattctggaaagtgatgaagagtggtgatgataaaggaaaagaaagaataaagttaggcacagtcatagacaatgtgttattgtgttcctgggagagccaggggattaggccctgattaagggaggtcaggggagggagatgactttagtttcttgtcttttatgcttcagccccaacaggaggacagacttgtcagtagcactaatgtgccctcccatgggcagaggtgagggagcttggggagtgtgcacttttcctttcatcaccttgcttacctatttgacccatagcttttgatatgtgagacagtgcaaagctcttagtgctgtcagtgattgcttcttttcctaatgagggataggactgatctgttttgctacttggaaggatctagatatggaaaattagcctcattcactttttttcaccttgattcagcttgctgtggtacagccaacggcagttaatatttccgcaaatggttttggatttgctatttgtcaggtatgtaacgatgcttatttttttaagttaaatatgactttttataataattatttggtttggggctttattaaatcttagataacttgaatataattcctaatgatttacatctgtgacttaagcaagatatatcactgtctttaataaaaagtattagagatgttgccagccaatgagtagagagcaattatatagattgattttctgtttgaaaagtatttcttggagattatttgctttttgaagtgagggttaatgtcctccaatatgattcctgataacaaatacatgttttacttataatttcttaatattcatctgagaatatagaagtcaacatggtagaattattgacttgaggggaggaattgtgtccctttaatgtaaaatcttatataatagtaaatataacaattaaagcataattatgctcaatcctctggtacagaaagaaaatataaagaaatctacatttttatagtgcagcaggagctacaataaaatggaagtagtatgaaaaatactgaataagataatcatcacactaaatagcacataaaaatattgaggactttaagatcatctcattagaacccaaagataatttgtgataggaccaaaaatggttgtgtgcttgggtagaaacaaacgaccaaacaaaaacactgaaacacttactgagaaagtaaaaaaatggctattatggagaaaaagtacttttttcaaaaaccagaacaaccattctagtagagagaacaggtatacttgctgagtagggcgggtataccttgctaagcaggtataatttagaaacttccaaataattctaagattattttgcattattctcagaatacagtaaacattttttaaaactaaaggaaaaatgatcacaatgaaaaggaatggtattcagtgaaaaggtcagaaagagaaagtaaacaatttatttcgatctttactaacaaagaccatgggaaaattctcattctcaagctgtcttgcaatccaagagtaaatccagaagtaaatatgctgtgtattctagataaaattgaaaaattatatgtacttaaatcaccaagttggttggaattcatttttgataaaccaaatgtagagaaattagtgaaaccaagtgattttttacttgaggcttgaagcacacaggggtaaatgtggtacctgttggtcagaatgttcatcaatcccatgttggtctcaaaatgcagaaaacaaaaggaagggactagtaggcacctctcatgagggaggaaaaaaattacaaagaagttggtcactcagaaatgggtattgagatttcttacagttgatatttttataagtgctctggaacaaggaaggcaaagaaaactcatgagtttgcagtaaatattaccctcttttgggtaataaaatactaaactgttggaaataaactgcaagatcttttgaagttccctgagtgagcagttgagctttattgccaaatgtaaaccctaatacttagttatggatgggcattaattatgacccaagagacagagtagtccttgtttgtttcctgatagcattggtctctaaagggacaattgcatgccaccgaaaggggaatgatggaaataatagaaagcatttctccaattttatgggactgttcttcagctgcttcaggaatactctataatttaatcattatactttaagaaagagttgacaaatgtccaaagtaagataaccagaaggatcgagtggatgaaggattatatcagtttggattgtggcagaataagaagattgcaacttttagatttgaaaaatgaaggcttagaggatttttttaagtatgcaaatccatgaggggtattagatgttagttctgaggggtgtgtgtgtatgtgtgtgcacgtgtgcatatgtgtatgtgttttaggtataagttaaaagaaaacacaaccttacaaagcaacagtaagctttatgaaccttgttataaaaaaggggatgaggtaaaacatttaaatagattccagtccatctggagatgagattggactaggaagttttgagtacattcctaagcttctgatttaggatccctttgagaaagacacgggtcctcaggctctcccagtgtgtctacggcacctttaacatcagtggtgggtacagagtagatgctgagaaagacccagttgacttgaaagctatcatttattttatcatctttgacaaacattgtatgaacaaaaataatcctcagcaatgttcaactaaggctcttcaatgttttagttttgatttatcctactgagagtttttgaagttctagttagagaaaaatgactccatttgggcaacaggccttagaaattagtgaatgctgtcaagaaagttttttcctcaagggaatgtttgccctctttggcaaaccagtatccccaaatatcacccatagtgttttattgtacttgttttggaatattacttaacagttttctccatttaaacataattttataaattttaatactatttgttaatagtgatactttgtgagcaagttaaattaatttttttctagtttgaagattaaaaatcttactgggtccatccaaagagaatcattacctaatacagtatttagaaggcaaaatgatggaaatttatgtccaacttgttatttatgctagtttattttttacagctcaatgttgtatataatgtgaaggcttctgggtcttctagaagacgaagatctatccaaaatcaagaagcctttgatttagatgttgctgtaaaagaaaataaagatgatctcaatcatgtggatttgaatgtgtgtacaaggtaagtgtctgcttaggtctctcttctttttttcctttaaaaaatagacttgaaggtttaattatgtatagttgtctatatcaatctaagagttatattgaacaaagaattcagttatgcactacacttcagattacaaactagaaatactactaattatattcaagcatttattagatgcatacaaaaattatttacaagttttccctggacgtataacacatttgaatagaacagtgtatatataaattaataaaactcaggtctaatttaggaaaactttaaattaagtcaatcatatttaatacttcaaaaatggttatttcttgttatgagttatttttctgtagaaataattatttcgggttcatattgaaccttaactgttaggcatttaacccaaaactttatgataacatgcaaattcaatcaagaggatagtttttttttaggtacattgaaaatattccagtttaggagtttctcatcttggataattagacacttaacagctgaagcttctgggagtactttttaagttgactcttaaattgttctatatccaaagcatctgagaatcttgttaataaggaaaaagggttctacctcaaccctaccgacttcacagtaagactgggaagctgcagatttttggtcattccactgcacacaggagtttgagcacactccttgtgaaagttcttgaatagaggcttcacttttttttctttcatgaatctattctcttacatctgcattatttggtattgagctgggacttaaagatgcactggcattgaggagctgctgtttgctcttctaaaatatcccatagtgtcctggtttaacttagcttattgttgggctagaagtccctgatgtggtcctgagctggcagatgttcttcaaggtcatctctgggtgttcatccaggtggccagccttcacagctattgcctggacccagtctccgccattactgctactgtctgtctttatctttggaccttcttgttcatgattttggggtaaaatgtcccacatttgtcccattcttcaccttcttgggcattttgggccagcagcaaggggatatcagaatctctgtgttggcatccttttcagctgagaaaaaagtaggactccaattattttttacgaatcttccaattggtctctgttatagaataacaacttcaagttattactattattataaacaataacaacctacagtaattacaaacttatatgccaggcacggcaccaaacacttttacatgcatatcatttaattcttacaggaactctgtaaagtatgtgttattattatccctgcttttctcaaattcctggcctcaagtgatcctcctgcgttggcctcccaaagtgctgggcttacaggcatgagccactgtgccccacctattcttgcttttctcattcatttatttattacctcagcaagtattgcttgagtctctactatgtgccaggcatggtgtctgtgtgtcaggcgtgggaatataattgtaagccaaaaaagatgcaagctctgccttgtggaacttgctgtttgagggggatacagaaattaatggaaacaatcccctaagcaagcctaaaattctaattttgaaaagggcaaagaagaagaccctcatggagttaagagagggagatttttacctcttaagagacatcaagtgaagaaacatgagaaaaatgaggtggggaaccagaattcagactgtgaagaggcctcagcatttataggggttcatgtaaggatgcaggatttccagttttaagcatcaggaatcaggtggacaacagagtttgggtggtaggtagagcctgaagaagggaaatgttttcatgtgagggtaggggttttataaaaaggatttaaatgctgctactagttttctgagaaaaatctggtatgaaggacaaataacatttaggtgtattttttcagcagcacattataaaaagattacttgatatttcagacactttattcctatcaacagggtccaagaccttacctcataccaggctttctgtgtggcatgatagtttaacaaattctgccccaggcttggtagagagatcagatcaaccaaggtacttttaatatgtactgaaagtataatctgcattgtgcttttaaatgtttaagcatattgactgtttttttctcatctatatttttttctcatatgcaaacacctccagtttcaatccatttattagttctcaataacatctattttggctcagtgcattgccagcagatggtttcagttgcttcggattgcagagccagctgaagtcagcagttgtactgtatggcttttcaatcagtcatgtttggcaggcatgggttttctgctctaaaaagcaagatttttctaacagcccttctttcttttgccatttaaaaggacaacaggtactaacttaatgctatgattcttttaaattggaggcaaacatctttccataatcacttagctgggctccttctgctctaaatgaaaagctcttgccatcaattcattttataaaaatatttatttccaagcagacaaaatgttgttggtgcccagatcctttgatgctcacatcacgtacaacagggcgagagaaggatgcagtgtaataaaactttccaaggcttgtaattccctcacggtggccaaagaaaacagaaaatgttcttcaagtatatgggagaacaaagggatggcttctccctactggtctgatgtttctaaaatcagacgaataaaaggttgctaagaccttggatgggacctatcactaagtggtcaagtgatgcctccttctcagggcctggctttcagcttgcaagtttggtgctgtcaacttttgagaaaaggaaaagtgcaattctgtttggaatcaccactagaaaatagagttgtctgttgaaaggatgtatattgtactgtcacagtttataagcacaagcctcttacattgcaggcattgcatactatctgtcagatgaacacattgttgtatcattattccttatatggttaaaagtttcaagattaccacacatgtaagaaaatgataacctgttttaaaattctctatagggaattttatttgaactcaaacagtgtttggaataacatttggtgggtttgatttttgtatgaagataatttgataacagctatgggtttttcctgaggagttttcattcatcctccctctttgatttagcttttcgggcccgggtaggagtggcatggctcttatggaagttaacctattaagtggctttatggtgccttcagaagcaatttctctgagcgagacagtgaagaaagtggaatatgatcatggaaaactcaacctctatttagattctgtaagtagtaaaacataaggtaactgttgacaaagccactgtgttttgtattcaggtgtctaccttactttaagtatgttttctttaattcattgttatttcaactttttgtgtccctgaatgagtttaacatggcaaccatatatttatctccattagaaagacataagtataaaatcagtttagagagttgctattaatgacgagcctgatgaaggccttcataactaaatctttatgtcatgccagatgtgaaatacatagaaatttccatagtataattaaaaaaattcaacccagatctgaatttgagagcctgtctgcctcagggagttgcctaggctggagtgcagtggtgcaatcgtagctcactgcaacctccaactcctgggctcaagtgatcctcccactgcaggctcctgagtagctgggaccacaggtgcatgccaccatgcctagataatttcatgagaattttttgtggagatagggtctcattttgttgcccaggctggttttgaactcctgacttcaagtgatcttctggtcttggcttctcaaagtgttgggattacaggtgtgagccgccatgcctggctggaagacgaaagtcttaattacacattttaaaattcttccatgaagcttttaacaaaccttaaaggggttcatattcttaccttgaaaaattaggtgctaaatcatggaagactattctcagagatttgatcttgacatagaattgttacataaccttcgtgtactctttccattgctgaatgagtactactgattcaagaataaagtgcacacagtgtgtagggaaaggtaagtgaagaattccagactctacttggtatgtctcaaaactggtggtatgtaagtttattcttttcttatagcatctatatgagcttcataggttgaactgatattgagttcatagtattctaaggatttcatattacatgggtgggtttgtatgtttcttatttcagttttgctaagtatgaatcagaaatatattgctgaatatatgcttttaaaaagatagttcttgaatggtctcatttgttttagcacttcaaaaccactttggttaaagccctgttaaaactaattcagtctcaatataatgttaaataacagtctctagattcttttgctgtttaggaattatcttacattaagcactgctcaaaagccattggcctgatttggaacttgaaaaacaaatttaaggttttagtttagttgtgtaattggttttggagtttgtcttctatctttgatgctcttgttaatggttattttaatttgagtgtccagtactctttgagtggtcagtttgacttttcatttactactattggcaaataagggaatgtttgaaggaatttactaatttctgattctttaatgagtgttgttgccaaattggccaaatctgtctctcttggagacagataggctggctttgtgtaccccatctcagtcattggctgtggagtacagccccatcttagttacctcacctactgggtgacatggcttgcatgagctgagggtgattcccaggagaaggaggctgctgtgagccattagtagtaactgggggtggggtgcaccatctgagacaggagatctaggtgcatgcaccctaaggcttgctgcttacttaaccactctaattctcagtatcccattcagcaaaatggaactaagaacaatacctttttgtaagcattgttttacaagttaaataagatagttcataggaagtacttactgcagtatctgacatgtagaaatcctccctaagtgttagtctctgtttcctaaaatgatgagaaaaaagaaatgtctttacttaatcatgaacacacagtgtgccaaccccttaagactcttttgtatttctcaaggtaaatgaaacccagttttgtgttaatattcctgctgtgagaaactttaaagtttcaaatacccaagatgcttcagtgtccatagtggattactatgagccaagtaagtatgctctggagttcttaatactttagaaattaagccaggcattcattcatttattggaagtgaccacacattggattggttctgtggcgagggcaggatttggtaggagaaagtacaggaggcgggggggcaggaagtgagcattccatttcagtgaagactattgataatttacaagggtcacatgataggttttagcatatgaaatttaaaaatgatatattttttcataatgttttagatttttaactcacaattataaactttacaaagaaaaattggcatatagagtccagttatgtctcatttgcaaggtattgcttctattccaagcacccattccatctgtttccagctttaaaatgggagttcttaatgtggcacatatacaccatggaatactatgcagctataaaaaaggatgagttcatgtcctttgtagggacatggatgaagctggaaaccattctcagcaaactatcgcaaggacaaaaaaccaaatgctgcatgttcgcactcataggtgggaattgaccaatgagaacacttggacacagagaggggatcatcacataccagggcctgtcatggggttgggggaggagggagggatagcattaggagttatacctaatgtaaatgacgagttaacgggtgcagcacaccaacatggcacatgtatacatatgtaacaaacctgcacgttgtgcacatgtaccctagcacttaaagtataataaaaaaaatgggagttcttctaaaagtagagctaccatttgaccccacaatcccgttactggatatatacccaaaggacaataaattgttctaccaaaaagccacctgcactcatatgtttatcacagcactaattcacaatagcaaagacaggtcatcgacctaggtgcccatcaactgtgaattggataaataaaatgtggtagatgtacatcatggaatactatacagccataaaaaagaactaaattatgtcttttgcagcaacatggatgcagctgaaggtcattattctaagtgaattaatgaagaaacagaaaaccaaatatcacatgttctcacttataagtgggagctgaacattgggtacacatggacataaaaatgggaacagtagacactggggacttcaaaagtggggagggagagggggaataagggctgaaacactctctattgggtacaatgttcattatttgggtgacaggatcaatagaagcccaaacctcagcatcacataatatacccttgtaacaaacttgtacatgtacccctgaacagtaaataaataagtaacaaataataaataaaatgggacttcttcaggagagaacatgaacagcatctgcaatgcagtagcatcggctggagttagctgtttctttattgagggagtctggtgttttgccgaaacttacacttgataacagatttttaaaagtgtgtcaagaaaaatatagcctgtttggaaaataacttgagcttctttgattttactggtaacttcttatttgtataaaatgatggaaatttaggacgtaaaaatagagagctggtctggagatggcccaagtttaataggatgaatccatgttcagtcagagggactttttgtatgtgatctctggcctaatgtttctaattgtaatatgtcttattttgaataagcgcttgtggtggctcagaatcatcacaatgcatgagaagcatgaacatttttgtgtgttaggtagttgtagataattacactttaaatgagatgaacttgttcccattgttgttagtgtttcatagagtattcaagactaaggtgtagcaccagttctctcctcatagtcaacaagccagttcctcttgtcttttgcctcctgttggcactgaggaagagggttcacccaggttcttgtgggacatttgggaaacactggtgtggcactttttttctagtggagggatggaatacactgtggagacccaatgacagtaactagttgtccaactttattactttacttagttgcaaaattccccaatttatatttcttgggtgcatggggaacattttaaacatttaagaaacaaaaataattcagtctatgcaaatttttatggaaaacaacttacttatgaggaggccattttaaaatgaaaatatgggaaagatcagaataagctaaaccttccaacccattttaaaaaatctcaaaacacatttacgatatggaaaacagtctctgaaaaatcatgaataaatttgaaaatagaatatgttttttaaaaattataaaactcatttatgttttacagtgagttcactgtggtgttataggtactttaagtagtttttgtcatgttcgcttttagatactatatgctgagtgttttaaaacaaggtattgcataggcagtcttcccttcatatttatgtatttttttactagagcccagggtaaatgccccttttcagtagttctaatgattagaatttgatttgagtgcatagagaatgtcatcctaaaataaactcttgaggaggttaaacagtccttaactgaaaattctccctgatgcagtaagagattaaagtggtgcttgtgattgcagtgtgcagctgcagtctatttgctctcttttaatgctggccaactgctggtggtagacagattggactgagcgcattgtttctctcttggatttggttagtactttggaccactcttggacatttcagttgtttcttgtaaagaaaaataaaattaggttaagaatggaaaactcagaaaagtgtatcgaaatgctcttatattttggcaaagtcaatgtttctaaacaagggagccgtgtgaactgatgtctgcttctttgaacagggagacaggcggtgagaagttacaactctgaagtgaagctgtcctcctgtgacctttgcagtgatgtccagggctgccgtccttgtgaggatggagcttcaggctcccatcatcactcttcagtcatttttattttctgtttcaagcttctgtactttatggaactttggctgtgatttatttttaaaggactctgtgtaacactaacatttccagtagtcacatgtgattgttttgttttcgtagaagaatactgcttctattttgaaaaaagagttttttttctttctatggggttgcagggatggtgtacaacaggtcctagcatgtatagctgcatagatttcttcacctgatctttgtgtggaagatcagaatgaatgcagttgtgtgtctatattttcccctctcaaaatcttttagaatttttttggaggtgtttgttttctccagaataaaggtattactttagaataggtattctcctcattttgtgaaagaaatgaacctagattcttaagcattattacacatccatgtttgcttaaagatggatttccctgggaatgggagaaaacagccagcaggaggagcttcatctgttcccttcccacctccaacctagccctactgcccaccccaccccaacccaccccatgcccagtggtctcagtagatacttcttaactggaaattctttcttttcagaatctaggtggtgaattttttttaagtggcacggtctttttctgcttgaaatctgatcacaccccccagccattgccctccctctctttttcctctgtagagaaatgtgaggggcagtacatttactgtgcttttcacaccatctcagaggttgaggagcatactgaaaattgccctggggggtgctgggtgtgctgtctccttcccacatcctcagccccacaccagctctatttcaggggtgagagtcagagagcactgcaatatgtgcttcatgggatttcgattcgaagatcctagaccagggagacactgtgagccagggatacaacaaaatactaggtaagtcactgcagaccgacctccctgcagtttgggaaagaagctgggtttgtggagaatcagagcatcttgacatgactgctgacctaaagatccctggcattggccagggatcctgtggaacctcttctagttcaggggtgtgagcattagactgccagttgtctagtgacatctgatgcttgctgtgaacttttaagatccccgaatcctgagcacctcaatctttaattgccctgtattccgaagggtaatataatttatctggatggaaattttaaagatgaatcccccttttttcttttcttctctcttttctttccttctccctttcttctttgccttctaaatatactgaaatgatttagatatgtgtcaacaattaatgatcttttattcaatctaagaaatggtttagtttttctctttagctctatggcatttcactcaagtggacaggggaaaaagtaattgccatgggctccaaagaatttgctttatgtttttagctatttaaaaataaatccatcaaaaataaagtatgcaaatgtatcttttaaagttaatttttaaaaatgctcttattttagtgaattttcagaaattatagtggaatggatgctcatatattgcttatggatattttggataccaaagtaggaataactgacattcagtattttaaagctggcaaacctgtacatagaaaatagatccccagacagtggtctatgaagagggcagttaagtatcaaatacttaattttcttgcctttttttcttaagtggggaaaagtttctagatctcttacacctctgacacaatctgttctaaaacaggcacttgtaatgttggggcctccttgtaaacgtgtttttgccctttactctctgggagttctttaaaggtgaaatcatcttacaaagaaattgggggagggtcttggcaaaggactttcccctcctctttcctggcctgggaaccttatactgacaatcaatactttatattttaaagtatataatttatagttaacttctagtgtaatatattaggaaacactagaatggaaaggccattggaagacaggttgtatcttttttagaccatatttccttgtttaaaaactatcatttgaatacttttttggtgaagaactccatgttttcaagttaaaggtcacctcgtaggccaggcgcagtggctcatgcctgtaatcccagcactctgggaggctgaggcgggtgaatcacaaggttaggagtttgagaccagcctggccaatatggtgaaaccccgtccctactaaaaatacaaaatttagccaggcgtggtggcatgcacctgtagtcccacctactcgggaggctgaggcaggagaatcacttgaacctgagagacagaggttgcagtgagccgagatcacgccactgcactccagcctgggggacagagtgagattctgtctcaaaaaacaaaaaacaaaaaagtcaccttgtaactcatctctttttattgtaagtttattaaaaatgaagaggacaacaatgagaaggaacataaagggttagctagcactgtctcctggtgcatggggctgtgcagatgtcccggccacttcttccttcatacttcccttagagaacttgctctgctacaagcagtgggcttggactaaaagtgattaaaataccacaggcataaggagaaaaggagtatatgtagtagtaataattactagtataaattattttcttcacatgctatgagtaataatattaaaaaactcattttaccattaagattccttatgctgaagctcttccatttagaatactgtcaatgtcatttactggtatgaactaaagtcccccttcttttccactcactgggaaccttagtaaaacaccagcatatcttacctctctttctgactggccgatgcttccagagactgaatgttgggaaaacctagtagccaaacaattctaggacagaataacatttttatatttggttccaccatcttattacatttagttatagttttaaaaaagaaattcaagcccattaaaatatgtctggtcaatgaaatgcttccttttattgtgttgtgctattgtactttgtttttcaaaacattgtaaaaatagtatctttggtttagtattttggattatatattataatctgaggagtgttttgcttatgtagaatccagatatatttctgttacctaggagatgttacttacatatgtaatactgtatcctgcacgtggaaatattcagaattgtagatagcataactctccctgctcctattcttttgagcctaggtataattttttttttttttttagaaaaagacatatttagctttaatttctatttatgctaaacatatttataagtagtctgtcaatataataccaactatttttatttttacataattcaattatttcatttgacatgtctggcagactcaagacattaagtaaaaaattggaactatgatttttctttgtcattttttaaaaaagaattattttattaacctgctggcatataatctggagttcttttcacaaccttactttttctgatttgctttattgaatgattgaatactcatttctttctaaaaatatgttgtaaattctcccttggcaagatttctccctatgagggtagttattatttgagtctgccaagtggttaccatggggcaaggtgccatgatgtattcttgggtgcattggttttttgcgcattgtaaatttaagacacttatagtaagtggactcattcatagatgagtttcagaaccttttacgttctcggtagaggcttctgtcggacaggcagaagagtgtattcctcacttttttttttgtcttcaaattccagtaaggcatagcacttttaagaaattagaatttttctatcatctatgcaaatgatatttatgttaatattaaatatcttatgttacactgggagtaatttgaggtgcaattatttttattactactttgaatagaggaccattatccttctttcttcagaaaactaagaagtaagtgtaacttttaaagtaagtatatatcagtgagagtaggcttgttttacaactatttctagccagtgagttgtgttttcatgtctcatcaaaagacaataccacattgcatcattttacaaaatatgttgtcattttcatttcagttgtaacataggaaaatagatatttcctagatgatttctgagtttcttactgcaaagaacagttataaattggtatacatgtgtctctgtaatagggataatattgatatatctgttgctacatatttaagaatcattctatcttatgttgtcttgaggccaagatttaccacgtttgcccagtgtattgaattggtggtagaaggtagttccatgttccatttgtagatctttaagattttatctttgataactttaatagaatgtggctcagttctggtccttcaagcctgtatggtttggattttcagtaggggacagttgatgtggagtcaatctctttggtacacaggaagctttataaaatttcattcacgaatctcttattttgggaagctgttttgcatatgagaagaacactgttgaaataaggaactaaagctttatatattgatcaaggtgattctgaaagttttaatttttaatgttgtaatgttatgttattgttaattgtactttattatgtattcaatagaaaatcatgatttattaataaaagcttaaattctcatctattta

SEQ ID NO: 1699 - DNA, 132534 bp, Homo sapiens; identical to SEQ ID NO: 1698

SEQ ID NO: 1700 - DNA, 132528 bp, Homo sapiens
tgctatgaatttctcctcacaaggatgggcctgtttactcaccctgggcatcgttggtagagcgctagtgtaaacagcctgaggaacccggtgggccggggaagtgggcgcgctctgttctccgcggccagctgggacgccgggccaggtggggccgcctgcgtttagcaactgctttctcaccccctggatttgcgatgtttgccacagcagcgagaagcgccattgtaatggggatgggaggggtggagcctccaagtcctgtctcaatttagatctctcactctgctgttaggcgcgcccatttcagattactaaactcgaattaagagggaaaaaaaatcagggaggaggtggcaagccacaccccacggtgcccgcgaacttccccggcagcggactgtagcccaggcagacgccgtcgagatgcagggcccaccgctcctgaccgccgcccacctcctctgcgtgtgcaccgccgcgctggccgtggctcccgggtaggaacgtgggcgcgcggggggcgcgcgggcgcgcgggcctgggccgctctgcggctctgggccagggcttcggggaggtggcggctgctgtgcagcagcgggtgggaaatgccctcgcggctgcagtccccagcctggtactggcctggaggtttgaccatatgtagcttcagcgtggctctccatgggacagttaactttctccactcatgaagttgtttaagcgtctccccggccataacaactttctgaagagagtcattttatttttagtccacattgcctctgccttttgcttctcaactttttgctcccagattgcgattcttctctcaaagacatgatatattttttctaaccaagatgtctcaaccttagcattgccaaagtgtggcggaggggactgatgtatgggttcaggggcagacattataggaagaaaacaacagcacccaataatggcaagccccattcattcctaaagatttctgtagttgagccctaacccctagttatagcagagaaagtgctgctttagtgacttcttttatgattcgctatacctggaattttcaccagttgtagtttattttcaaatggtatatttcaatcaatggtattggttaaataattttttaccctcgttgggcagctactcaaggataaaggtttgaataagaaacaggcaaaatcttagttaaaaaataacaacaacaacaagaaaataatcacgctgggataaggtcctctgtaaaggagaagcttagagacttttgctttgccaataactccattatgccccggtgcaagccatttacatcatggttccttctgtgcggttcgtggtttataaaatggaaataataacacaggccttcctctagtagtgatgcatgaattactgcattaaaattgatttatgggaattattgttgtttcagtagcatttcaattcagttgccaaatagagcagtgggcaatgttaacggaaacaactgcaattggcgcagtatggagtgcctatcgcactaggaaatctgagggtcacaaaagaaaggagatgtgaggataagaaactttgtttttcccttgttgggaactctttaggcctcggtttctggtgacagccccagggatcatcaggcccggaggaaatgtgactattggggtggagcttctggaacactgcccttcacaggtgactgtgaaggcggagctgctcaagacagcatcaaacctcactgtctctgtcctggaagcagaaggagtctttgaaaaaggtaagataaacagcataaagtcttacccttctgcagtaataactggaatatgttaataaggtcatgtgttaggtagtatagcagagaaaccccaaatttgcagtatcttacctaatatacttttaattctcact[450 bp omitted]tttgtagcagaaccaagtttggttcttgtttcaagtttgggttctgacatggcccaagattaaattgggccaatgaatgtcttctttttcagtgctaagggaaaaataattttgggaggaagaggtaaatacttaaatacttaaaacatttttcattaaaatgaacttttattgcatttttttctttttttagattcttataattatttttagagacaagctctcaccatgttgcccaggctggtctcgaactcctaagttcaagtgatccacccaccttggcctcccaaagtgctgggattacagtcctaagctactgctcctggccgagacatacatttttataatgttaagagttatttaaaaaaaaaaatttaaggcacgtaatgaagggtggttggtattcattacataagtgtttattctctacaagcgtagagaaatgaacaccatcatgaaatgaaataaaagtaaaagtttatctgcatctgtggttctttccccactggaagttcactgggtaggtatatttggaataggagtcaggaagagatggtgtgtgtaggggcaagtcacttttgtccctcatagaagcaatgtcagggaagtgggaggtcttatttccctggaggggaagtataggttagcccttaagatctgagtttgaatcctggtactactttgctactagttgtatgatcttaggtaggttacttaactgctttgagccacagtttccttgtctataaaatggaaataatgaaactgatttcccagggcagttataaagttaaaatctgtatatagtacctcttaggcatgcaataaacaacaattgctaatattattagtgtaataatactgcagaagaggatgcagaaagtccatttcctttttacatgggggcagacttcaactttcgttattggactatcatttctgaaaatgaatgacccctgatcttatgatagtcgctaaagaaaatattgaaatattaaatcacaggacataatacttaaggtagttccacattcattatttattcattaagaatttatgagtgggaagagggagggtattaaaaaaccacctattgggtaccacacttatcacctggatgatgaaataacatgtacactaaagccctatgacaggcattttacctatataacaaacctgcacgtgtatccctgaaactaaaataaaagttaaaaaaaaaagaatttataatattggctccactagtgtggcagttttcctgcaatgcagagatccagaatatatatggatgtttttgataaatatttgagctttgcttggacatttacatactctaattctagaatttcacctgttaggtcttttctgtgatctctgttatcagtctctctttttttttgcaacaaatagtacctacattggggtgcatgttgttgtggcttggttttcagctttattcttagatcttcttttgggagaagggttccttgtatgcccataggaaagttcaagtactcaagactggggcgggcaaagctgtcctgggagcagaatggatctgtgggaaggaaggagggaaaacgctgcttctttcatgggctgtttttgactctattgacatagagtttcattgaaaatgccattgctaggagcactctcctgtttcaaaggagaatgttactgtattatcagaggctgggagttattgttctcagagcagatgcttcctgtaatgtgaggacttgaggatcaagacacttctccctgcttgtcttcacatcctttgctttatctggcttctccagttgtaacaatatgtagataaaccaggacttctaaatcaggggtctggatcttcaagtatctggatgtggattcatgttttgttttttctccatcacataaacaccaaacaccaacaaataaataccttttatttttaagggacagagtctcactctgttgcccaggccagagtgcagtggtgaaatcatagctcactgcaacttggaattcttgggctcaagtgatcctgctgtctcagcctcctgaatcagctgggactacaggcaagtgccagcatgctaggtttaaaattttttttttttttgtagagatggggtcttgctatgttgcccagactggtcttgaactcctgggctcaagcgatcttcctgcctcagcctcccgaagtgctgggattatgggtatgagcctgattgtttcattttcctatgagccacccccagccccccaacagaaggttggttttaataaagatttatcttctagtaaagttgggtaaggcagtagactgtgtcttagtagcttatttccagcagttttggatttcttagaaatcctcaggatagggaggtgttttacccaaaccacaatagatttctggctcaatttgtgttggaaatagtaataactaaattgttcaaatggagaatgtatttaataaaggtgaaaaagtatggcatttcttcagggaagagttcatttgtttgtttgacagatatgggggagattttatttacatttccacttttatggccaggagtgtaggttatattactgttattcatttaaaaatacattaattctacatttattggggattgattgtagtttttttttttttttttttttttttttttgagacacagtctcactctgtcacccaggctggagtgcagtggtgcgatctcggctcactgcaacctctgcctccctggttcaagcgattctcctgcctcagccttccgagtaactgggactacaggcatgtgccaccatgcctggctaattttttgtatttttagtagagacgaggtttcactgtgttagccaggttggtcttgaactcctgacctcgtgacctgcctgcctcggcctcccaaagtgctaggattataggcgtgagccaccgtgcccagcgattatgggctttttttttttttttggtgaataatagacctttagaaaaagtatttctgctacactttgcagagttctgggaaggtgtatcaatgcctttctagtagtgagattcaaaagattgcttgtcactgttaccactgtcactgcctctaccactatcagcatcattgccatcagctccatagtgattagaactatgttcctaatcttatcttcctttgcataaagagttagttaaataaacataactggcaaaacgtagtaaaagttcagcaggtaataattaccagaggaaagaagatggcacagctattggcatttaaaatcaagtcagattactgttttgggtggagagtgagtctgtccctttgtctcttcccatattttttttctctttccttactgtgaaaggagttccttgccaaatcaagaaaaaagaaattaagaacattttgagaactgtcctctcatctgttaaggcatataaaataatttaattttcgtgatgtccttgaaaccataatttctgttttattttcccttctcttgctacaatttgacattttcatttgtaaactttcagtagttttcctgaacaagagtcacttcaagtaataaagaatataacctttctccctcattaatgaattcatcatcattagtttcatgtaaacctgatttaagaaaaaatgctagaggctgagtgcagtggctcacaaccgtaatcccagagcttgggaggctgaggtgggaggattgcttgagcccaggagtttgagaccagcctggacaacacagtgaaattctatctcaaaaacaaaaacaaaagaacccttaaaaccaaaaactcccaaaaacctaaactgaaaatgcctactgaaattttgggaactctgcatgggcgtctccaggtgagtgcctgctggtttgggggcaccattttttaaatgctgccaatcctacttccatcttcccattgagttactggggtggaatgtgctctataaatgtgtctgtaactcgctttttctttttgccctaaaatcctggagagttaatggagtgttaacctttttttaaagattttttaaaaaatctattttttcctttgttgtctttctcacattgactatgatatattttattttccatcttggctcagtaagggtgggaaatttttaaaaattgagatattagctgaaaaacttaaaaaatcatccaatttggtttggatggttttctggtggaaacaaagctcctgaacatgcatttcatgcctcgtagataaaaatcagtcccatggtctttatgaaagtagattaattagtgtagtgtgtgggcagatctcccagagcaggttttcacaggcagctttgccaacataactcagtctgaacctgcagttatgttagaattatttttaaagggtgtaggcttttcattcacacatcgtctttgttcttgtgtgtgatgtatattaacaggtaggtggtacctgagaataaaggaccacagcataatcacgatgtgcctgggctctggagcctggctacctgggcacaggtgctggccattccacttagtggttgtgtggctgtgggcagtcatgatctcactaggcttcagtttcatcatctgaaaaatagtggtttctgccttatacaattatatggatattgtgaggattaaatgaggtaacatattcaaggcacttaacacaaaggaattattcaagaaaatggtagctattgttactagaagagagtagcaacagtttatgtcaaaggcaattattaatcacctattgtgacaatcttgaaccgggaactctataaaagacacatccctaggaggggattggaagggatttaacatattaaatatccagtttcctcatagtgccaaggactttatgcactatatttaattttaacaacttgatgaagtagatactcttgtcttcattttggaggtgaggaaattgaggcaaagagagaagaattagtttttctgagttaacccagttagtaaatggtgaagcctgaatttgaagttagttgtatctgaggtccagagaccataaggttttctattgctgggaagagagtgaagtatttttatttccttgattttgggatattgatgcaatgttgcagttgtcttccactaaaatcattttcacatttgcttgcagtagatagacctggatctaatgaaatctaatttgaatcgaaagaattacaaaatgaaatgccagctctcctcttaatttactttcagcctcatagagttttggagctggaggggacctcaaagataagcaaattcaatagcctaatatatggctgggagactgaggtgaggcatgggatctggggattttcccaaggtcaaatcacttattggtggcagagctggaaacagattgcagtttcccaaatttgcagtccagtgctatttccagtatactctacgaaagtttcctaacatatggagagctgagcttaagacctaagatatatttacaaatgctgattcttctgatatggaagaaaataaggctaactaaggagtttaaaaatgcttacttgcatactgtgaaagtttcttattttagctcaaggtggagttgctctttatgcactatttgttctgtataaggggtgggggctgggttagaagcttcatagaccttttaaaaactaaattctgttgctttgtttctcagagtccaaattgtatttattaaaaaggctgattcatggcctccctcaagacatgggtaagaatcaagaatctcagctgggtgtggtggctcacgcctataatcccagcactttgggaagccaaggtaggtggatcacttgaggccagaagttcgagaccagcctggccaacatggtgaaaccccgtctctaccaaaaacacaaaaattagccaggtgtggtggtgggcgcctatagtcccagttacttgggaggctgaggcaggagaatcgcttgaacccaggaggcagaggctgcagtgagattgtaccagtgcactccagcctgggtgacagagcaagactccatctcaaaaaaaaaaaaaaaaagagaatctaacctttatgttccaccatgaccacaggtgattcttagtcacattagaatgagaacaactgccctttggtatctcacaaattgtactcgaccaaatactggaaagctcgagggtgagtagcatgcccctgcaagcctgtgatgattcatggcggcggagggaaggctcctcgtggactttcatgtttgcttttaagcaaccctcaaccctaagcgctggtgttcattttcagccgcagagaaacatgacttggggtttgattgtgaatcaacgattgggtgaagttaaaagtgaacacactgattctttaaactccaagttaaacatgtgctgctcctcttctagcactggatgagtcactgtcctagtgactcactgaaggattgtggtggaaatagaaaacagatcccataagaatttgggctgggttactgttgatcctttatgtcctgtgaagagggctttataatgctgaaactagttgtttccccacagacatttcttctcattaatgtattatttattgattatttgctgtatgtgaaacatgaatgaatggggagtggggaataagagaaaggaaggcactggaggacattcagaggtcccagaaggataatataatattaaaagtgcagaaggctagaggagtttttattttttgtataaaaaatacaatgcggtttgtaaatagtgcttcttgtatgtgagcctgtgcctggtactattatcttttacttccagagctatacagatgtccattcataaatgtcccacctctgctgacatatttggcctttggagggaacagttacttcacgtactagagacgggaagggtgtgccggaggaaagagctgctggctggtgtggcagttatgaaaaggagataggggtttgtgtatatattttctaaaaagatgtttcattctgctttggatatgagtttggggagacatccaggtggagatgtccagcagatagttttgaaattgcagctggggagagagatttaggcattattttcatagaggcagacaatattttgaagtcctggaaatacataagatgcacaagagagacagagctcatggaaagaacaagtcttttgagagaagcttggaaagaggaaaataagttaatgaagggaaaaagaccagacacagtggctcatgcctgtaatcccagcaacttgggaggctgaggtgagcagatcgcttgagctcaagagtttgaaatcagcctggacaacatattggaacctcatctctactaaaaataaaaaaaaggtagctggacgtggtgacatgtgcttgtagtcccagctactcaggaggctcaggcaggaggatttcttgagctacagttatagtgccgttgtactctagcctgggtaacaaagcatggccctgtctcaagaaaaagaaaagaaaagaaaagaaaagaaaagaatagaatagacaacgagcaatcagagaagggtaaattgaaaatgtctcagaagccaagggaagaagaagttccaagaaggaaggtttaatagttaataatcaattctctcaggtcagagaagaggaggacagaggaaagaacattggtgacgcttaagtaaatggctttaagttgaatgttggaagcaaaagcaaatttgagggaataaatggatggtgaaaaatataatcaaaatttattctttccagaagtttggtagttgaaaggagagaggtggacggtctctcaaaaggcacattagaaaggtgaaagtggttaaggcaaaggagagggtggataattcctgggttagaagtggtgagatcagtattggggcagaggcaagtggattatccttaaaaaaccctcatactttcttctttgaagaaagaaagaaatagaagagaatcattaaggaaagaaatattttgaggtatgaaattgagatgaagaataaaattgaaatacagttttaggaaaacttatttaccgacttgtaaattgcacagatctggccaccactttataggaaatgggggtaaaagttaaaagtagtggcagaccagaatgagaaacacaggactggagatcttccctggtggtgccctaaactgggtcaccgctggattgtaggaaattagaatacaggggcaggaagtcatatttgtatctgggagagctaacacagggaggagagagaagaggaaagggctgtttacgatgaagatatgcctcagttgaagctcgagaggactgggtggagttactttattactgccatggttgtcagtgaatttgtaattcactcttagtgtgggccaagatgaccaaggtgcaatgataaaacttgtctaggaggattaaagtggatcttggtcttgctctatctctttcactcttcacttacctcggagaattctatgaggagactttcttccgttgcaaggctcagggtgaaattggtcaaagatttggtggagggggtagcagtaggtaggtagatgacaggtctataggttgttagttctgaagaaacgattcataaattaaaatccgaaaaccagactggtaaagagcttggaaataaatgaagaggaaaatttttaaagaacacctagtagctcccttttggcagggctgtgttaggaatttacatttatgaaaatatagctggcagaaatgatttagtattacaaacttaagtttcactgcaatatatgttaaagctcctcaggaatatagataagacagggaatttattattctgagcaattcaaatttattcagcaccaaattgcctatggcacaatgctgggtgacataaatatttggtgaccacatgaggttcctgtgcctgtgctcttcgcagggaagcagagtaggcttcatttgatgtgtcctcccacgttgattatagaggcttgttcgggtgccgtgttgacagtttcaaagtcaagcgtgggtttactggactagagaactggatgaattagctgtgtctgccatggccatgggagttggggagtgtggtatgaatgctgcgaaggattctgtagcccatccataaactttatttatggatcagttgaagaggaatggtctaagaggaacggttatctacgtagctacataggggcttgaggtagtaacaacatggataagagagaacagacgaaagagtgggtgtatccaaatagtaaatgagagtggagtaagctacagaggaggaacaaggagggaagggatatgaggttatgtttgcactactgttttggaaggaatagctgggtctgtcctgcactgtttgggaggcacagtgggttagaatgggtgctcaggaaccacactgaaattgaaccctagcatcacctaatagtagtacccacctcgtagcattgttgagaggattaaatgagataatacttaagagctgtatcatccaatatggtagctactaaccacatgtggtttttgagcacttgaaatgtggctcatacaaattgagatgtgccaggagtataaaatacataatggattttgaatacttagttccaagaaatgcaataaaacttatgattttaaaataatgatttcatgttcaatgttaatattttggacatattgagttaaataaaatatgttattaaaagtaatgtcacccaattttttctttttttggcacataaaagacacctaatttaataaatattagttattattttctcttttattatgcagttaagaactttgatttaaaattgttatctttatatatatatatatatatatatatatatatatatatatatatatatttattatactttatgtcctagggtacatgtgcacaacatgcaggtttgttacatatgtatacatgtgccatgttggtgtgctgcacccattaacgcgtcacttacattaggtgtatctcctaatactatcccttcccccttcccccatcccacgacaggccccggtgtgtgatgttccccgtcctgtgtccaagtgttctcattgttcaattcccacctatgagtgagaacatgcggtgtttggttttttgtccttgcgatagtttgctgagaatgatggtttccagcttcatccatgtccctacaaaggacatgaactcatcattttttatggctgcattgtattccatggtgtatatgtgccacaatttcttaatccagtctgttgttgttggacatttgggttggttccaagtctttgctattgtgaataatgcctcaataaacatacgtgtgcatgtgtctttatagcagcatgatttatagtcctttgggtatatacccagtaatgggatggctgggtcaaatggtatttctagttatagatccctgaggaatcaccaccctgtcttccacaatggttgaactagtttacagtcccaccaacagtgtaaaagtgttcctatttctccacatcctctccagtacctgttgtttcctgactttttaatgatcgccattctaactggtgtgagatggtatctcattgtggttttgatttgcatttctctgatggccagtgatgatgagcatttttccatgtgttttttggctgcacaaatgtcttcttttgagaagtgtgtgttcatatcctttgcccacttgttgatggggttgtttgttttttttcttgtaaatttgtttgacttctttgtagattctggatattagccctttgtcagatgagtaggttgcaaaaatgttctcccattctgtaggctgcctgttcactctgatggtagtttcttttgctgtgcagaagctctttagtttaattagatcccatttgtcaattttggcttttgttgctattgcttttggtgttttagacatgaagtccttccccatgcctgtgtcctgaatggtattgcctaggttttcttctagggtttttatggttttaggtctaacatttaagtctttaatccatcttgaattaatttttgtataaggtgtaaggaagggatccagtttcagctttctacatatggctagccagttttcccagcaccatttattaaatagggaatcctttccccatttcttgtttgtgtcaggtttgtcaaagatcagatagttgtagatgtgtggcattatttctgagggctctattgtgttccattggtctatatctctgttttggtaccagtaccatgctgttttggttactgtagcctcgtagtatagtttgaagtcaggtagcatgatgcctccagctttgttcttttggcttaggattgacttggcaatgtgagttgttttttggttccgtatgaactttaaagtagttttttccagttctgtgaagaaagtcattggtagcttgatggggatggcattgaatctataaattaccttgggcagtatggccattttcctgataccaaagcctggcagagacacaacaaaaaaagagaattttaggccaatatccctgatgaacatcgatgcaaaaatcttcaataaaataccggcaaaccaaatccagcagcacatcaaaaagcttatccaccatgatcaagtgggcttcatccctgggatgcaaggctggttcaacatatgaaaatcaataaacgtaatccagcatataaacagaaccaaagacaaaaaccacatgattatctcaacagatgcagaaaaggcctttgacaaaattcaacagcgcttcatgctaaaaactctcaataaattaggtattgatgggacatatctaaaaataataagagctattcatgacaaacccacagccaatatcatactgaatgggcaaaaactggaagcattccctttgaaaactggcacaagacagggatgtcctctctcaccactcctattcaacatagtgttggaggttctggctagggcaatcaggcaggagaaagaaataaaaggtattcaattaggaaaagaggaagtcaaattgtccctgtttgtagatgacatgattgtatatctagaaaaccccattgtctcagcccaaaatctccttaagctgataagcaacttcagcaaagtctcaggatacaaaatcaatgtgcaaaaatcaccagcattcttatacaccaataacagacaaacagagagccaaatcatgagtgaactcccattcacaattgcttcaaagagaataaaatacctaggaatccaacttacaagggatgtgaaggacctcttcaaggagaactacaaaccactgctcaacgaaataaaggaggacacaaacaaatggaagaacattccatgctcatgggtaggaagaatcaatatcttgaaaatggccatactgcccaattttttctattttttttttagtgcacatctttaaaacatttatcacaatgcttggtacatagaagacaccgagggaatgttaactatgttgtacctggtgtttctcagtatcagatattaatactgatgcctgaccacaagcctgtggcatgagtccaagtctccctgctgatgactcattttggcttaggtagatcttcacccttatcccttatcccttgaggaagaagaaaatctccctaaagagagccacaggggtcggcaaaatttctgtaaagggccagatgttaagcatgtaggttttgccaaccttcaggtctttattacagctgctcaactctgcctttatagctcggaagcagctgtagacggttcataaacaaaagagcatggttgtgtaccagcagaactttatttatggatgctgaaattttgagttcatataatttttacttatcatgaaatattcttcttcttttgatattccccccagctatttagaaatgcaaacccattcttagttcatgaactgtacaaaaaacaggcgtgggccagactggatctgtaggctgtggattgctgaccctgccattaaaaatgccctgtacatttagcagccaagaaccttgcttgactctgggtttttcatttgtacttaacctaacatttgctttatagtgtaccattttatttattttacttttagtaggtttgtgtttgacctgcttttttttttactcaatgtttgtgtttaacctgcttttttttagacaatggaacaaaactttgtttatgaaactcaaatttattaagatatttgtaagcaaagggaaataagagagaaaaatataaaaggagtatgtaagggaccaaaggagattttttgtttggttttgttctgctcagaatacttgtgttttctgtgtagactgaatttacccaatagtttttttgccttaaagtgacattaaactgtgaagcagaaacattgtatttttaaaatcgtactttaagtttttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaattttttttttgtatttttagtagagacggggtttcaccgttttagccgggatggtctcgatctcttgacctcgtgatccgcccgcctcggcctcccaaagtgctgggattacaggcgtgagccaccgcgcccggcctaagtttttaaaatattttatttttatagatttagggggtacatgtgcagttttcttacatggatattttgggtagtggtggagtctgggcttttagtataaacatcagccaaatagtgtatgttgtatccattaagtcatttcttatcccttacctccctgccatatgaatctccaatgtctattatttcactctctaaaaaatattgtattttatacaaaaattagccgggtatggtggcgcatgcctctaatcccagctactggggggctgaggcaggaggattgcttgaacctggaaagcggaggttgtagtgagccgagatcatgccactgcactccagcctgggcaacgaagcgagactccgtctcaaaaaaaaaaaaattgtattttaaagttttgttttccatgaatttgtggggggaaaacccttatttcttaccttatctgttgatcaaagaaactgctgaagaatgaggaaaaaaatttagtaacttgataaagagatcaaaattttcagctaaaaaagtgataataaatttattattgcataagactgagtagcaaaaggctgccaaaaataattaagcagcaaacactaagtcaggcatatatatatatctagtggaaaatccactttttttttcatagagagtatttctgtacctagttggatttccggttacacactactccttcccttcaatgattttccaaagttatttggtgaggacagatgtcagaagaggcagcatataatggtattacagagtatgtttaaaaagttaaggaaaggttagtttttgtgtatgcttattacacaatttaaaaatagctttgactctatttgtaaatcaaatggccagttctcaggctgtgccaaatgcgaagccttcaaacaaggtttcttctgagttgcttaagcagccctgggaaggagaaagcatctgaaagggttttcagattgattgtctctggttatacacagaaatgattggagttttataaagttatctataaaaacactaagaagaaccttacataacagagtgtgtctttagttagtgatttaaaagagtgccatactgggtttcaagaggtggtgaccatttcccgtgtctgaatggagcctcgccaaaagggagaaaaatgttcacaacagtttgcaaatactatctatttaattctcaacctagcaacagcagagaaagagattattattcctctctcatctatgctgcccccactctcctccccgctgcccccgattttatgttttggttgtgtaaattattgctaaatgaatagaactttcaaataagtcctatgctaggacttcataagtgcctaggaaattccaagctgtatttgtaaatttaaagggaagatcagcagaaaaaaatgtcaagtacttaaaatcgactttttattaaggacgcatgagaccagtgagtaggccttagattggatgtgtccacatatcctctgagtcgctccctggatccagcaagaaataggggtgggtgggacatctttgtccctacaccatagcgttggggaagagtctttgtattttgtatttttattttttttttaatagagatggggtcacacgatgttgcccaggctggtcttgaactccttgcctcaagggatccttctgcctcagccctcccaaagtgctggtattataggcgtgagctgccacacctggcctgggtaggacttctgtttctagctctgtatctttcttgcatctgtgaacagataaggtcatgtgtctgagcagtaggacccaggcatgcagttgaactgctcgtccaacttctctctggtgagagaattcctcaaagatttgacttcattcagagctgcattaaaaacaaaagacaaaacaaaaaacacttctactatgaaatgagatttcctgcacttcaaatctgtttagcttgttttgaagtgccagaatgcttggcctccaattagtcaatctccgagagcctcatttggattgtagactcccaactgtttttttactttctccttgctgatgtcattggataaaaataaattaccacccctcccccgtcgttcttcatctttgtaaatttgctgccggtgggtggtagctggtatcagaccagggcaggaaggaagcacattgcttcctccagttatggagctagcataatagtcaacccctgatgatttatcttaatacaatgaaaaataagtaactctcaataatggagggtgctggtttgttggggcgaagctcactgcagtttgtttctattttattccaatgtgggacattgtggtggatgctgtgttttagggcccagatcgctctttagggatgaaggactttttcccgaaagctgctaggagtgttgtgcccgactgccttcagagccagttgtctctgatgatcgtatcagctagagaattgccttgcccatggtggcctccctcctggggatggcctgtattatgtgactgattgacgtggggtatgaaggtctggccctttcgccccagttcaggacaactctcactggccctgactgcttctgagctgccctggtggatgcctctttggagcctgcattgcagccccactgctctctcccctagtgcagtttccccctttcccttctgcaggtgctgatccaccgaatactccttagtaaacctcctgcattgtaattaccgtctcagagttggctactgtttaactttcctttgaagaggaatgtttcagatcttggaatcaacttcaaacatgtcaaaactgtgtagtgtgaagaattgacatgagttgggaaagtctttcgtttttatatccttttcagagttcttgtatgacacaaaatattttagagttagctccgctactgcagtgcttggagtataactctaagtttcttctaagagaaacttcatggaagaagaatccacaggttttggtgagtgataaacttagagttgaggagagaaaagagttcaagatgattgagattttgaacatccatgattgaggaagtggtgatagcaacatatacaaacaggctatacaggcagtggaacttttactataatcaaagatatgtataatgaaaacaatggtgaggcacaaggctgggtccagtggctcacgcctgtaatcccagcactttgggaggctgaggcgggcagatcacttgaggtcaggagttcgagaccagcctggccaacatggcacaaccctgtctctactaaaaacacaaaaaattagccagctgtgatggtgcttgcctgtagtcccagctacatgggaggctgaggcatgagaatctcttgaacccgggaggtggaggttgcagtgagctgagatcgtgccactgcactccagcctgggtgacagagcaagactctgtctcaaaaacaaacaaaaaaccagtgatgaggcacggtgactcacatctgtaatcctagggccttgggaagtcaaggtgggaggatcactcgagcctaggagtttgagagcagcctgggcaacataatgagcccccatttctacaaaaaagtaaaaaaaattagccaggcatggtggcctgtgcttgtagtcctagttactggggaggctgaggcaggaagatcgcttgagtccaggagtttggggtggcagtgagctatgattgcaccactgtactccagcctgggtgacagagtgagaccctgtctccaaaaaaaaaaaaaaaaaaggtatgtataataaaaccaactatacaactgattctttttttaatttttaattgttgtggatacatagaagatgtatatatttacagggtacatgagatactttgaaacaggcatgcaatgtcaacaaccacatcatagtaactggggtatccgttccctcaagcatttgtcctttgtgttacaaacaatccagttatactattttagttatttaaaaatgtacaatcaaattgttattgactacagtcctcctgttgtgctatcaaatactaggtcttattcatttttctaactattttttgtgcccattaaccatcctcacttgctccctaacccttcactactctccctagcctctggtaaccatccttctacactcttatctccattattagttaaattgttttaatttttagctaccacaaataagtgagaacatgcaaagtttgtctttctgtgtttgggttatttcacttaacataatgaccttcagttccatccatgttgttgcaaatgacaggatctcattcatttttatggctgagtagtacttaattgtgtacatgtaccacattttctttatccattcatttgttgatggacacttaggttgcttccaaatcttagctattatgaacagtggtgtaacaaacatgggagtgcagatagctctttgatatactgatttcctttcttttgggtatatactcagcagtgggattgctagattgtatggtagctctatttttagttttatgaggaacctccaaactgttctccatagtggttgtgctaattttcatttccatcaacagtgtatgagggttccctttcctccacatcctcatcagcatttgttactgcctgtcttttggataaaagccattttaactggggcgagatgatatctcattgtagttttgatttgcatttctctaatgatcaatggtgttgagagggccttttcatatacctgtttgccatttgtatgtcttctttcgagaaatgtctattcagatcgttttcccatttttaattggattattagattttttcctgtagagttatttgagttccttatgtgttttggttattaatcccttgtgagatgagtagttacaaagattttctctcattctgagttgtatcttcattttgttgattgtttcctttattgcgcagaagctttttaacttgacgtgatcccatttgtcgatttttgctttggttgcctgtgcttgtgggatattgctcaagaaatctttgcccagttcagtgtcctggagagtccctccaaagttttcttttagtagtttcacagttttaggttttaggtttaagtctttaatccattttgatttgattttagtgtatggtgagagacagggtctagtttcattcttctgcatatgtacatccagatttcctagcaccatttattgaagagactatcttttcctcaatatatgttcttggcacctttgtcaaaaatgagttcactgtaggtgtatggatttgtttctggcttctctattgtgttccattggtcgtgtgtctgtttttatgccaatatcatactgttttggttactatagctctgtagcataatttgaagtcaggtaatgtgattcctcctttttttttttctttctcagtatggctttggctattctgggtctttggtggttccataaaaattttaggattttttttctatttctgtgaagaatgccattggtattttgatagagattgcattaaatctatagattgctttaggcagcatggacattttaacaatattgataatttcaatccgtgaacatggaatatcttttcatttttttggtgtcatcttcaatttttttcatcagtgttttatacttttcattgtacagatttttcacttctttgatcaagttaatgcctgggtatttaactttatttgctgctattgtaaatgggattactttcttgatttctttttcagattgttcactgctggcatatagaaattctactgattcttttttttttttttttttttttttttgagatggagtctcgctctgtcacccaggctggagtgcagtggcgcaatctcggctcactgcaaactccgcctcccgggttcagggcattctcctacctcagacttccaagtagctgggactacaggcgcctgcaaccacgcccggctaattttttgtatttttagtagagacggggtttcaccgtgttaaccaggacggtctcgatctcctgacctcgtgatccgcccacctcggcctcccaaagtgctgggattacaggcgtgagccaccgcgcctggcttctactgattcttgtatgttgattttgtatcctgcaactagactgagtttatcagttctaatcgtgttttggtggcatctttaggtttttccaaatataagatcatattggctgggcgtggtgactcatgcctgtaatcccagcactttgggaggtggaggagggccagatcacttgagcctgggagtctgagaccagcctgggcaacatagggagaccctgtgtctatttatctttaaaaagtaaattaattaaaaatattatatcatctgcgaacaaaaataatttgacttcttcctttccaatttgcctgcccttcatttctttctcttgtctgattgccctagctaggacttccagtactatgttgagtaacagtggtgaaagtgggcattcttgtcgtcttcctgatcttagaggaaaggctttcagtttttccccatttagtatcatactagctgtgggtctgtcatatatggctttttttatgttgaggtgtgttccttctatatgcagtttttttgagggtttttatcatgaagaggtgctgaattttatcaaatttttttaaattatcaattgaaatgatcatgtagtttttgcccttcattctgttgatatgatgtatcacattgattgatgtgcatacaactttttttttttttatattcagagtcagtgcagagcagtggtttagagctcaggcccatgagtcaggtggttagggtcagaagcttggccccactactttttgtctgtgtgaccctgggaaagtcatttcacatgtctatgtctcagtgttctcatttgtaaaataagggtaataatacttaatagtattgttgtgagctttaaactcaatgtatgtaatgctttagaacactctgtaagtggtatgtactattattattattttattcatataactaaaaaattgtattctgtctgatctgttggttgtttcattgttgctaaacacaaatttaagtcttctatccccgtgaccagttctgtccaatacaagtataagtcaactacataagttattggcaattttctagtagccgcactaaaaaagaaagagaaacaggtgaaattaattgtaataatatattttatttaacccaataatttacaagtattattagttcagcatttaatcactataaaattattgacatgacattttacatttttttggttgtaagtctcagaaatatggggtgtattttacacttgctgcttatttcagtggctcaatagccacatgtatttagaggctcctgtatgtgactgagcagctttaaagagttgctagttaatcttgctcatttctgaagtgttccagtcaactgttgctgtgaaataagccgcccccagatttagtagattaaaacaacaatggtttattatttctcacaattctcatttagcctatacatgctagattgatgattattgccattatttttgtgatagttgtgaattccatgatagtttttgaattccacgattccttctacatttattagttggaattctgtggtaaggaataactctttcttctctttcactcagtcatatatttaattgtacatcagcatgaactcatagattcttgttgtattcagtaggttgtaacccattatttattttattattcaagtgatctgaccataatattttaaattaagaaaacaccctctccacacatgctcaggtacctgatgagatcagaacaaattctgctacatggatggtattctcaattccatcccccaacacccccgtattgcaatgtttaaatgtttcagcccaaatatttcacagggtctgcttgcagagccccatgcttctcttcaacaaatgtttttacaggacaaaatttgtccagtaaattgtctctatttatggttcctttgaaagttttaccaagtttacttgctgaaatatcctagggcttttcaatttcacttcaattcagtatagaatataataagtctttcccattaaaagtaagcttaatgaacagaagtttcttcctacaaggtaagatactcccaaagtataactggtgtatatccaaagatatgaaatcagtatgttgaagagatagctgcacccccacatccactgcagcattattcccaatatctaagatatggaatcgatgtcagtgtccatcaatggataaatggataaagaaagtgtggtatatatacgtaatggaacactattcagccattttttttaacaaaaaaaatgtaaaaagaaggaggtcttgtcattttcagtgacatggatgaacttggaggacattatgttaagtgaaataagccaagcacagaaaaacaaatattgcatgatctcacttatatgtggaaggtaaaaaaagatgaactcatagaaacaaagggtaaaatggcagttaccagaagtgaaaggaatggggagatgttggtcaatagacacaaaatttcagttatacgggaggaataatttcaagagatctagtgtacagcatggtgactatggttaatatcaacatattgtatacttaaaaattgcttagagtagattttaattgttcctttccacaagtagttatgtgaggtaaggcacatgttaaatagtgtggtttagccattccataagttatacctcattccataaggtatacatctatcatctatatgtcgcataccataaatatattcaattattacttgtcaattaaaaaaagaataaaacattttcagagttaatttatgtgcacattaaacccatcctagaataatattttgctaaccaaaaaaagatccaggacaaatgctaaatcaggatgctggaataacagcgtcaactgggataatcctggtgaggcctcatcttgtccaaagacccccttttgattgggccaggcctcctggctactgctgtctttctggctgtggtctttgctcacccagctctttggtttggtagactcaggttgatctccactgctttgcatttgctgctcttttgcctgtaacattgtacccctccttgctcatatggctaatttctccatatcctacaaccttagacactggcatcgttttctctaggtgccttcccttcatccctccaatgtgctccttgtcctacctgtactatgtatatctgttccacgatacttccttcttcacctttttgaaacaccatgttcaatatcctgttatttaagagtcttgctctttgcttcctatgataacagttattagaggaactgatctgtgctaggtggtaagtgatggtgatgaattacttatctgttcctgaaaacatacttgtatttcatggaggcccactggggtggtagtcttcaaagtgagtgtgcacacgtctaagagtatatgagaccatttataaggatggaagtagaaaatgtagtaatttttatttcttttttttttttttttgagacagtatctccctctgtagcccaggctggagtgcagtggcacgatcttggctcgctgcaagctctgcctcctgggttcacaccattctcctgcctcagcctcccgagtagctaggactacaggcgcctgccaccacacccggctaatttttggtatttttagtagagatggggtttcaccatgttagccaggatggtctcaatctcctgacctcatgatccacccgcctcggcctcccaaagtgctgggattacaggcatgagccacccacgcccggccagtaatttttatttctattattttattaagcaaagctaagaagttaaagtgtttctctttttctttttattgatttatttatttatttttgagacagagtcttgctctgttgcccaggctgtagtgcagtgatgtgatctcagctcactgcaacctccacctcctgggttcaagcaatcctccttcctcagcttcccaagtagctgggactacaggcgtgccactatgcctggctaatttttgtagtttttagtggagatggggttttgccatgttggccaggctggtctctaactcctgacttcaggtgttctgtctgcctcagtctcccaaagtgctgggattataggtgtgagccactgtgcctggctataaagtttttctaatgtttaatattttggttgagaaaatacatgtatataattttataaatctaatttgacattggtaaggtatactaagtatttttattgatggagtactctatcataaaaatttgaagactacgtctataggggcatatgacatcctcaatggaaaactcttcaagctttttgacactataatagctaacatatttcaagtgttttctatgtgtcacgcactgttctatatgctttacaggtatcaacatacgtattccttataaccacctcatgagattgatatgattattagcatcctcatcttatggatgaaaaaaattgagctagagaatcaggtaatttgttcaaggacagggccagtacatatcaaattcttgatgtggtctgattccagatgctgctagcttaacccctgctgtgtactgtgctgtgctctggtgcctctgctctcacatgatagacccatttggcttcctggaggagagggaccacatctgtcttgcacattgtgctagtttttacggggcctattatttccttctctctctttaaaatcatcttttgctccattttatttcccaagggcctgccatcttcgataggaactttggacaagttctcttttatttttaacatgaaaccatttttccccttgaaataaatggatctgatgagaaattggcatgagtttaattagcagtcctatgtatagaaactttacacgaaaaaagtctgcatcaccccagtactcacgagtcagttatgagtcccagctcacccctgacatgactaatgccttcctttcttcctttatcacgagggtatgaggacaagaaataaacctcagactacttctgtacagcgtgtgaagtgtcccgcaagcacgtataaccttaaaatagcaacaagggcagcagcaacaacgacaacaaaaatgataatggcaaagagaagcagaacctaatgttttttgggtttgcccactgatacccttttaatcctgatttttaattgtttggcacaaagatatgtaataatttcttgggtcttctgggcatttaaatgtcattttggtttcaccaaatgtatttatgattccacctacacatgtaagagtattgggagagttttggaaggtttgtattctatcatcatattcaaattgtgctaactctgttttctttcctgttttccttgtaggctcttttaagacacttactcttccatcagtaagtatccatttaaaaaatttggtttcagaaatatattgtatcagtgaactaaataaattaatattttattggattttatgtcaattcacacatttcacgtttcatgtaagtttggcttgagtttagttcagccttcagattatttatgaataatattatttcaaggagattgattatgaggctcttcaaactcttggcagagattttcctcttgtaaaatagaagacttcactgaaggaaactggcctggactattagcacagaaatctggactggtcataaaaaggaacgagaccatgtcctttgcaggaacatggatggagctggaggccattatctttagcaaactaaaataggaacagaaaactaaacaccacatgttctcacttataagtgggagctgaatgatgagaacacatggacacatagaggggaacaacacacactggggcctactggagggtagagggagggaggagggagaggagcaggaaaaatagctaatgggttctaggtttagcaactgggtgatgaaataatctgtgcgacaacccccatgacacaagtttacctatgtaacaaacctgcacttgtacccctgaacttaaaataaaagttaaaaaaaaacaaggcatctgggctggtttgctcctgcttctgtcgtaatgagccttctagtgtggaactctgctcctcagtttccttgtgcttgaaaagagcagtgccatgctgagacatactagaacttgaggcaaaaggaaaaatcagtaatattgaccctgtctttgtttaaaacttcgacttctttgtttataattttttgcattaattttgatattttaaaatattgtattaaaatattattttcttgattgctaaattttttggtacccccttaaattttgcaccttagacaagtgcctcactcacctcaccatagccctggccttggaaaagagaatgaagataccatctttatctcacagcatgtcctggagtgaaatgagatgtggaagtgttgtagcacttgctatagaaatggaaaggagttattattttgttgagagattcataaaaccttattattaaatgtttgtggatgaatcttcctatagctttgatttggaagtttatactttcattactatgctttgttttggggctttacatgcttaatgtacagtatagtaaaccacagcatccaacatcaggtgcagtttgatatatgtacttttctgagaacagaggactaatgacttaggccctgacacactgtatacctgattagtatcagcattacctcataagccaggttcgctcattaccttaaatttttttttttttttttttgagacaggtcttggtctgttgcccgggctggagttcagtggcacaatcatggctcactgcagcctcaatctcccaggttcaagcaatcttctcacctcagcctcccgactactggcatgtgccaccatgcctggctgattttttattttttgtagaaacaggtttccctatgttgcccaggcttgtctcaaactcctgggcccaagcatccctcctgccttggtcccccaaagtgctgggattacaggagtgaaccaccatgcctggcccacttagtaccttttgaaagttacttgtcaagtacattcagaaaccacatttattttggggggttcatagagaatattatactctcaaacaatactttataaaaattacttagtatgctatatctattctgtttgttacatattatatttgtactttctttcctaagaaatatactgctgctaataatagaaagtggaagaaaaaaggcataagcaggcagaagtgggggaaaaaaaccctgcaatctttgtggcaataaaacattagattgcattaaaataacctaaaacattagatactggccccagtgcctgggcgcagaactttgttgaaagggtattccagtggtaagatgaaaataaatcctgtgtcgtatatttgccctatagcagaaggagggtggggtttaagctcaggaatcacagcctaaagcacaataattgtctggtttcctcaaaggagtttgcagtttcacataccggaagtgtagaaaggctgaaaggagaaggcggggcaagggcatgagagtttctttcaatgatactagtataaactgtacgtgtctgagctaatattaactagaaatttgtctactacacttctttttttttttttttttttttgagacagagtttctctcttgttgcccaggctggagagcagtggcgcgatctcggctcactgcaacctccgtttcccggattcaagagattctcctgcctcagcctcccgagtagctgggattacaggcatgcaccaccatgcccagctaatttttttttgtatttttagtagggacagagtttcgccatgttggtctggctggtcttgaacttccaacctcaagtaatccgcctgcctcggcctcccaaagtcctgggattacaggcgcaagccactgcgcccagcctactatacttcttttaagtcttaagtatatgaaatactaactctgacatccagtatttgtctttaatattatgtcatttcaattgtatataaatatagctattatctattgaaagctttattagagattatattttggagtgtatctctttttagtaaagcacagtatgaaagacttagaaataaagtgtatggacaaatttgataatgcttgacaaaaaaagaaggctctgcattttaatgagttttcaattaaagcagaaccaactttctttttccccagtgagaacatacctgtgaatagaaccaccttttaaagtgcacttgcattctgacacttgtaagtgtaatattttaaattatttttcaggtctttatggctttttagtgtaaaatataaatatttcaagaatgtgttaacacaaatgtgttttttatttctgatttactcattgtacttcaagacactaaaataacccccaatatgaagtaaataaaaaacataaattgagacaatataaatattgttttgtacacaatatggcagaaaaacttcttttgttctctttgtcaaatgaaggagtggttttatttgattagaaatgtttttaatgtgtaagtataattactaatatatttttaatggaaactatcatcttagatttctcaattttattttgaaaaattgtctccgttatgtttggtaactggcattattcctgaagtatatgaggataaatactattgtgttgtctcagtttccttacagcagtgaatctttcagagaaggtgaaatggctttagacagcccagattagaataagtaatccttatttattgtctagcaagaatgtttttgaatgtgcttaccttatgtatcctaggcagagagctatcatctcctcagagagtttgcatttatgtatacacgaaatagatgtgcctaagtgagagtcaacatagccaatccagaggctgattgatattctgttggtcaaagctttgggatattgtcaattcccagactcttgtcctgctttcagacagcctctcactgtgggaactgcaccttcctccagccctgtgccctctggtcaaggagtccaaaatctctgtgggtaaataattgactcctgtttaagagccatggaagtcacttatcaaggaacagctttttttccccctttcccccaccaatttcgggaacctttttcagtaactgtggccccaagacggcagaaggcaatttaccagtaaagatgcaggagcttctgttacctcatagtgtccactctgctgtgggcaggttataacccactccagatctggcacagagagagaaacttttataaaaattgcttaaagtcaataatcttttcttcagtctcattatgcgcccccattgttaaccatggagcaccgaggtctgcattgacaccacaagactctggagcaccacccagagtacgtggtgacaccccgagacatgtggtgatgccccatgcttcatacaggcacccaggtctaatgattcaccaaggcccatattgtcatctctgggtggcttgccctgggactaacactgagtctttgaggatcccaaattacctaaattttatatatggcaaggtggggtttttaacggggaaaagttaaaaaagcaaattagttaaggtaacccaaaggaacaggaagatagtcagtaatgtttcccctgagtcagtgtcagctccctgaaggaggatagagtaggaggtagaataaaatgttttcgggcatatttgcatttattttaattctctgaccctttaggctgcttgtggttaataggcttctttagctctaggcctctgtgtcattaatttgacatcagtcttcaatctagcatctgttctggggcctctgtgccactaaaaatgataaacatatcaaatcaggaagagcaatcccatcaaatatatttttaaacatgaaatatttagaaatcgatgccatttataagcatataatattctggttcctggtgtatatattttcttgtttatagtattaggaaatctgattcaaagagtctgaggactgaagtatcacttgagaaaatagaatttaagattgcaagttccaggctagactctgctctaccagggcacaggtctttggttcatgttgtatcccaagtacctagggcgtcctggtacacaaagggtgctcaataaatacttctttaggctgggcgcagtggctcacatgtataatcccatcactttgggaggccgaggtgggtggatcacttgagttcaggaattcgaaaccagcctggccaacatggtaaaaccttttctctactaaaaatacaaaaattagctaggcatggtggcgcacacctgtagtcccagctacttgggaggctgaggcaggagaatcgcttgaacccaagaggtggggttgagattgggccactgcactccagcctgggcaacagagcaagagttcgtctcaaaacaaaacaaaacaaaacaaaacacttctttattgaataaaagcaaaaattgacaccagaagtcatttgaaggtgacatactgattgtttttcctaacattttattattaacttttcaaatatacaaaaaacttgaaaatgtttcataatgaacactcctatacttgccacttagggtctaccattaacattttactatacttgctctatcatacatctatccatctacccatctttctatccatccattagttcatcttatttttaaatgtatttccaagtaaattgcagacatcaatactcttctccctaaatattgctgctgaccattttattgttgacagtggtttcttgcactttcttcatattcttaaccacattgatagcattctgatgtctgctattattggaaaatcccctttgagctatctgtagacaaaacttatttgcaaaaatgagtcaggatatagtttcgggacctcagttttaatatgaaaatcaactaaaagtcaagcatgctagttatctattgctaagtaactctaaaactttgcttcaaacaataataaattaaacttttattacttctcacagtctttgtgggtgaagaattgggaacaatatggttgggcatttctgatttggagtctcacgaggttgcaatcaagatatcagctagggctgcagtcatctgaaggcttcatcagggctaacacattctgtgaggcagctcattcactaggctgacacgtggttgttggtggttggtgggaggccctggttcctcccaatgtgggcctctccacagacttctttagtgtccttaccacaccactctggcttcctccagagtgagtgatccaagcgagaaagagagacaacagggaagaaggtattctttttctgacatagcctaattctaggatttggaaggaaatcactaagtctggggaattaggcttcaccttttgaagggactaaagtcagagaatttttggacatattttaaaattaccacatcaaagtgtgtgtgtgtgtgtgtgtgtgtagtgtgtgtgtctgaaatgattttaataagaatatccacctgagggattgttgtgaattaaaatgatatagtgcaggtaaactgctcagtatggctctggtctgctaatgctagaaggtaggacttctattgttattattattattattattattattattattattattattattttgagacaaattctcgctctgttgcccaggctggagtgcagtggcacgatctcggctcactgcaacctccatgttcaagcgattctcctgcctcagcctcccggagtagctgggactacaggcgcatgccaccacacctgggtgatttttgtagttttagtagagatggggtttcaccatgttggccaggctggtctcaaactcctgacctcaggtgatctgcctgccttggtctcccaaagtgctgggattacaggtgtgagttaacgtgcctgggaaggatttctgttattaatagtagtagtagaagtagcagcatcatcatccctaccaagactatgacacatatgcgcaagatgcattaggagaatgcatctcagaaaacaggttgagagaatatagcaagaaacaaattttgtgcagaagagcctttcatcagctgactgcctcaaatagggtgagcgtggaaaagaaggttgaaggatgttagatattctgacctgcaataactgttagggaggatgaatttgcacttggaataggaaatggcaaggtgactcctgctgagggagagcagtgggctatgtgtcccccattccaggagccctgtgatgtaactggagagcaaactgcaggaagttaaaagagggaaaacaaattaactctgatgcctgggaggggcaaattttcaacatcgcagttacttttgataatactgtgtatttactttttttattctaacttgcaattaaaacatttttgaggtaaaataatgagaccttgatgtgtgatctctttttccccccagctacctctgaacagtgcagatgagatttatgagctacgtgtaaccggacgtacccaggatgagattttattctctaatagtacccgcttatcatttgagaccaagagaatatctgtcttcattcaaacagacaaggccttatacaagccaaagcaagaagtgaagtttcgcattgttacactcttctcagattttaagccttacaaaacctctttaaacattctcattaaggtaagtgccagacagaaatgaagcaaggaattctagccatcttactaaacccctctgggaagttctgcttgtgttactgacactggaatattttagaattcacctaagataagcttccctcccaacatggaactcctctaataggaaagaaggtggtgcatgcactgggttaagagctcagcctctagagtcaacctgcttgagttccaggcctggggtcttcattgatttatacagttgtcaaacatttattaaacttctgtgttccaggcacagcgatagggcagtgaacagaagagattaagtccctgctgacactgagtttatttttcagtgggtagtaggagacagacataataaataaacatacaaatatatatttataaagggacagatatgtatgtatttgtgtgtgtgtatgagagagaaaaagggagtgagagacagagagtttgtgtttgctattttctttctttcttttttttttttgagatggagtttcactcttgttgcccaggctggagtgcaatggcacgatcttggctcactgcaacctccgcctccttggttcaagcgattctcctgcctcagcctcctgagtagctgggattataggcatgtgccaccacgtctgcctaaatttgaatttttagtagagacggggtttcaccatgttggtcaggctgacctcgtgatccacccacctcagcctcccaaagatgctgggattataggcgtgagccactgcgcccagcatgtttgttgctttctctagggttgtctgggaagactgatttgagcagagagccaaaggcagtaaaagaaaataagcccatacagagggggaagcacatggaaaggccctgagggggagcttgtttggcgcattggaggaacaacaagctggcagtgtgctggagccccggggcgaggggacaggtgctaggacatgaggtcctatacaagtaggtgggttagggtggggctcatgcagggccttattggccatgatagggactttgaaacttatgctaagtgaagtgagaattcactggagaattctgaggcaagacttgatgtaatctaacttaacatcttaaaaggatcactgtcagctctaagaagaatagatgctagatgctagctgtgtgatcctgggtaaatttattaaccttctagaacctcagtttccttatctagaaaatatgtaataataaaacctcaaaaggtttttatgaggcttaagtgagataattcaagtaaaccatttagaactgtgtctggcacatagtacatgctcactaaacgttagccattattattattttaggaaccccttttgaaaggtagtagttttgtctctgctgcttaatactctgatgatttggaggcactgtggttagcacactgagtgctttcctgtgagaatcaagttgaagacaactgagatccagctgggcctggttttctgtatttaaacggagaagaacactggacatttgatcattacttggaaatagggtgactaacatcccagtctgcctgggatgcctctgattttaaaactgaaaagtctctggtcctgggaacctccttagtctcaggacattggttactccagatattctaatgaataacatagtgtggaaggtaaagtaggccttttagtttggtatcttcctattcttagtttatttgttgttataaattaaaacaacaaaacccaatcaaataaacatgtatacatttaactttgagccaagatatatttgtagccagtatcacatttgttgccatggtgttcaatgcatattgcttgaattgaactagcattatttcagagtttgcctttggtatgtaatggaatgtttataaagcaggttgacatagtgaatagtatttctaaattcatgtcacccccctgagcagagttgaactgactccattcataccatctttcatcatttatccacatatatggagagcttactgtatgtcagaaaggatgtgtacaatagatggtttaataaatgtctggctatctctgggtgtttacattcaatgcttccttctactgcaggcaaataaaagttagcactgcataaattgcctgttctagacatcaacccagaactaaccctgctggttctggataattagtctgtgcattttcatagttctgcctgtctactctgctctagtatcttcctttgaatctttgatttgcagattctttgggctcttctgtgcagtttgggacttagcagaccacgtttggctttctggaaagggctcagagagactttcctcttattagctctggtactgatatgactctcttggccaggggaggggagtttaaactaaaattctacctggaacccaaagtgttttggaactatgagtgaggggtggccatgctcctgtctctgtacctgggaagtgatgctcaaatgtggacttaggtctagctgccttcctccttgtaacttgcagaggccaggtgggagcagtaatgtgaactctttcagctgaaaacagacatttgggccaggtttacaagtctatgatattttctacatctttcagtgtggaataattggtgtcttggcaaaacttttcagaacaaattgggacttagcctgaactggagcccctgactgagacagttgtactccttggcacagcaccacctgcaggctgatgtggagaagtgcacctgagagttaacggggcccatcttgcccagctagaaatggctgcaggatgtagctaagatactgactgtcacagcaccttcagggtgttcattgttgttcttggggactgcaggccatctttgggtgttattcattttgcatgccccaataactggtcttctcaggagggaaaggagcttcgaggccttttggcagtagaaaaaacataacctatgtctcccacgcttctggcctcctctagccaatttggcctgacacaatggaattgagtgcctctgacactgcgatggcagctggcatggctggcttctgctctgacctctccatccagaagttgttggtgctagtacgggtgaatgatcttgtaggggaacaggtgttattggcttgggggtatatcctgttattgtgccctgacactcagttttggagcagtggtggctaactcagaacctgaccgctggccaggtgaagaagctaccttatttgagtgatttgaattctctaattctacaggctggacagacatgttattcacacataatccagaaatagtcctcacagacatattctccagccagggagcttactgcttgagacaatcaggtactgtgtgctgtgttgaggcatctcagagatccagagcgatctaaaggtgactcgaagggcatgtggggccactattccaggatctctggcctgcagcttttctggctgtgacgggggtattgctcatactgtacatggctgtgtcgtagcagcagatggccgcatgcaaatgctgggctccgctgtgacatcaccatgcttggctggttcaaatcctgatgtgtcttgtagacttctggtgtttctgcattctctccctctgccttattggtaacagttagacctaggtccaagacaggcttgggaaagcagaggaattatctcattctcccccaaccctccagatcccccaggtacaaagccatcaatgaggtcagttcagacttcattgtccaggagaaatgtatgccctcactaccataatgtttcagtagaatatggacattccattttcctacacttcaggtaacaccaagaattattgttattattatttttatctttgtcagactgacagaagaaacacaatattgttttcatttgtatttccttaattactagacagcatatatttattggctatttgtatttcttcctttgttcctgagcctttgaacttcatagccctcccatgcgtcatgctgtggcaggcacagtagggccaactgcccattacaatgcctggcccaggagtttaccaaggatacagtgacctgcttgttcttgacttgcttttggtctctggttttcacaattggtttctggcttattagactgctttctgcacagttctcagcattgtacttacccctaactgtcatatctccactctgggagagaggtttcttctgttctaataactggccccactcactacttctaggcaaagtttagaggataagtctaagggaaaatattcaacccctgctctcagtcacagtctagttgggaataataaaatatagatttttggcaaaataaaatatgtaaaataaacatattttactgcctttaacaaaaatatgtattcaagagagataaactccagatatactagggactttccaggaagaagtcacctctgcctattggaggcatgtataggaggcaagaaactgaaactgatttcaccagtggacaaggaagggagggatttccatgcagcagttgcagagacctacatgcatgggctttttgggaataaactgcaaacaaatccgtatgtttggaggaagatgagcctagaaatgtagatggagtagtattagtaagggccttgtaaactaggcaaaggagtgtagacttcctgtaggcaaacaaaagccatgggtacctagtggtctagtataatcatcatatactataattagggactataaaaagtgtatagccactgctttttatatgccagggactgtgccaagtatttcaaccactgtaactcattctcagatttgcgtttcagatggatcacactgttggcagtggggaagatgtattgtagagggcaagactagagggggaagattagttgcattagttagaaaataggacatggtggctggatgtgaggatggaaagaaggagacaaattagagatatattaacctaacaaagttaaaatgtcaggaaatgtgagagaggaatctaggatgactgctggaatggcttggataaatgttgcatgaagggattgttgtttgggaggttataggaagaatgaagtgttttccatgtatatccgtgattaaacatctctctaatatgcttttgttgagttaaaaggcagacatgagtttggattctgaatttcatcatgcactggtgctgtaatattgagtcatgccagtcacttgaatgcgtacctccctctccaggcatcagttttctcaactataaagtgaggataaccatgtcctaaaggagaattgtaatgattagagataaggcagagtgcctgacacatattgggcctttaataaatggggcctgttatctctacagttaaattttcttttaacactactaccaccaccgccgccaccaggggtttggtgacgtacatgttgtagtgtttcatgtagaaggaaatagggtgccaggaattaaaaggtggagcagaatcaagatgaacttgggagaaatatgagaaaagaataaactttgatttgtcttctttagaaatatagagcctacgttttccaaaatgttcatgcagcattcatccaagccattccagcagtcatcctagattcctctctcacatttccagaccttttaactttgttaggttaatatatctctaatgtgtctccttctttccatcctcacatcctgccatccagccatatttgtgccgtattttggagtaaagttctggacctgggtgggaatgctgcaaggcattattcctaacctgataggatacacatgcacatgggcagcctctacatacttacatgtctggttttcattttaggaccccaaatcaaatttgatccaacagtggttgtcacaacaaagtgatcttggagtcatttccaaaacttttcagctatcttcccatccaatacttggtgactggtctattcaagttcaagtgaatgtgagtataaatatattttttggggggaatgttaaagtgatttaattaggtcaggtgggggaaaatctccaaagtcatttatacaatgaagagaaaaaaattaatgtgaacatttagacaatttaaacggtttatttttaatttatgatgtttatcaagggtttatttagctttcattctaacatattagaattttcataactgttgtctttttctatgatatgatgtttaaaggttaaaacattttgacattttagtacacaatgtttacttatttgtttcatgcattattttaaaactaagtaatgaacacatagctattatttggcaaattttatgccttagaataatgactcctaatgagtgattagattaacctacttttatctttgttttaagaaacagtgacttaaatagctacaccgactgctattccccaatcctttttccctagcttctacacctattgcctttacttgctgccaacttgtatagctctgaaatctaaatggagggcattaaatggcatataaatctaaatggggggcattcattggaatgaatgagacataaacacaatgggatggaaacaattttaaaaagcaatgagacttaactgttttatgtgatataaattggtcatttagtatataacatgtaaacctttatatttttctatatttatgtgacatataaacatataagatataatcaactttttctgtatctaaaggggaagatatgtaatatgaaatgcatgaaattgtagcttattctaagcattgttgctgagccttgagtaggtgggactcgtgtgtgaattgacctgtatgaatgagaacagtgctggaggcacaatggactctcaatatttgcttcatggccaccctgcatctttatgggtgtttgtatgatgtgtttaccaatattattctttttaaggtagcagaagctctaccgaatgaatgtatgatgtggttttaaagaacatttgaggcaatattatgaaaggggctcatactgttagagaacaatgtaatgcataaccattaaagtcatggacaattttcagtgaggtctttgcttatttccttacttataacagtgtaataataaccactgttataaatggcagcctagagcaggatgtgatgagttctaggggaagtggaattctttatatctgagcttgtagagaaagtggaaagagtaggcatttgtgaaacttagaaaatagggaaaaatttgtgtgggagtagggaaaatggaagagaacgttatgtgtctggggatttgggagaagttgatgttactggagcatgtggagaatgatggcggtgtagattaggaagcacgttgtgagtttaaagtagtttgaatattattttcagttcccacttaaattcttaagaatcactttttttggtccatccatccatcgatccttctatccacccacccacccaccaacccagtatgtgttaaggactttatggctgtgatgaatacaaagaaggtaaacatatgacctccattttcaaaggtcattgtcatggtgacatgaacaatatgataaaaattaaatgacataagggggacagacaaacacagggcagtgcaatagcagaggaattgtaaggtgttcagtccagcttggtgataaagagggtttattgttagcacaagcactgatgttttggggccagctgctccttctgtctcccatggtctgctctgttctcctttcactcttctgccaacctttgaggtgttcttcagttcttctgattccattagcttagctaaataaccatcatgcccagaatctttaaagcaagcctctgcacaggtggctggcagcctgtgggtgggccgccctgggtcaaggtgtccatttttggtccattcagatgccacctatgcacaatgaccagcaagagcagttttagctggataacaggcgctgagggattaatttgttcattgaatggtggacagaataagtaccagaagagagggggatagaatagcagagggagactttgcagaagatgtgagattatactttgaaagatttataggatttatcatgttgtggtttgtggacttggcttgtcatattgcttttatagaaaacaaatgctcttaaggaaatttaggtgcttaaaaaatgaaaagcatttgcaggatctggcccttgcccaacttttcagtcttgtaaagtgccgcccttcctcttgaactctatgctttagacatcttatgtcccttaagtttcttaaactcaccgatctgtctcattctagagcctttcatcatgctgttccctctgctgagaatgttttttcttccttattctcgctacttgcttttaacctgcagccattctctaaagtggcctggctgttccagacattcccatagtactgtgtgcttcccttaattcattcatctcacttttaattagtggtccatgatagacagtagcctttgtaaagctggtgaccttctggtcttgctcacctctctattcctgggaccaagttcagtgcttttgcatgtaagtagaaagcagtattttcttaaaacgaatgtgtgaaaactatatagcaataatttgtcttgaaccaaatgcaattttcccttttgtatattctataaagcatctttatctttttgaagacaagtatactgatcaggtacttgtcatttgaggtatgttaatttgaggcattcagctaagaaaaaataagccccttaaaaaaaagagcccttttagaaccaccaggggtcagtataaccaaggaaatgttatgagaagcaactgtggccttggtctctggcttttgtttttctttgactactgcgcagcattaaaggactgtatatttcttgttattaaaccccttttcttttagtagtgaataataacatagaggaaatgtatttattatttaaatagcccaccattagagactatatttttacttttcggtggcagtcaccattctcaatataaaactcagggaaggaaaatatttattttcaagaaagtattggctgggcgtggtggctcacacctgtaatcccagcactttgggaagccgaggcgggcggatcacgaggtcaggagaccgagaccatcttggctaatacagtgaaaccccgtctctactaaaaatacgaaaaattagctgggtgtggtggcgggcgcctgtagtcccagctactcgggaggctgaggcaggagaatggcgtgaacctgggaggcggagcttgcagtgagccaagatcatgccaccgctctccagcctgggcgacagagtgatactctggctaaaaaaaaaggaagtattttttaaattttttaatttgtaagagacagggttgtcgtctgtcactcaggctagagtgaagtggcacaatcatagttcactgcagcctcgaactcctgggctcaagtgatcctcctgcctcagcctcctgagtagcagggactacaggtatgtgccactacgcctgcctagttaaaaaatttttttttccttttcatagagacagggtcttgttatgttgcccaggctgatcttgagctcctggactcaagcaatccttctgccttggcctcacaaagtgctgggattacatgtgtgagccatcatacacagcctttgggagagttttgaaattccattttgtctgtagaaaaaatatggaatgatatgagtattcccactgatggacaatctctttaagaattaccggagttatcagagctttgatttgtaatgactatacaggtaatcagaaagtggtattcttcagttaccctttgtcctaggtcaggaaaaggatcctttaagtaaaacatacttgacggctccttggcatttctccacttgtattaataacatgtttgtttgtagagtaagagtgaataagtcctttatgataccgtgttaacctttctggattaatctaaattgtttgcccttcaagtattgtattgcttttcaccttcaaggttttttatgatagtaatggtgagtaattattttggtctagtatgatttctagttttcttttctttctttcttttttttttttttcgagacagagtctcgctcttttgcccaggccgtggtgtgatctcggctcactgaaacctccacatcccaggttcaagcgattctcctgcctcagcctcctgagtagctgggattacaggcatgcaccaccatgcccagctaatttttgtatttttagtagagacggtttcatcatgttggccagggtggtcttgaactccagacctcaagtgatgcaccctactcggcctcccaaagtgctgggattacaggcatgagccactgtgcctggccaagaaaggaaacaaatgttttgggggattagttaagtgatttgcccaatgtcccacaacttaccaaactaggattagaactcaggccttttgacaccaaatccaaggttctctctaccctgccaccttggttttccatcttatgttttatctctgtcattgttcagcatatgatggtgggacatcataagttctcaatatatacatagactttttttttttttacaatgctagtttaatcaaattgcaaagaaactcttgatgattataatgtttaagacctcttaaaatcagtaaagtttagtaagagccctggctctttttgtgctacttatacgtgtgcttaattgacacacatattctagtgtgaatagttctttgctactttggggattgtacttcttctcttgagaatgtgaccaagtcttctacttctgccatactttgattgccctgctctttttcatcatttctttgtctagagcaccaagccctcctctcagagggcagaggtatattttagctgtaacatcttttcatagaagtgtgttttatagggccgttatactttaggtacattataagttgagtgtgggaatatgttctgatttaataattgacttgaaaatacaccttaggaagataatgtgttttaaaagttagacattcctttattttcatttctttgcaatatagttctctaggtaccttatctctaggtatgttatctcttgattggtgttgacagttttctcaaataattgcacatggtttttttgttttgttttgttttgttttttgagaaagagtctcactctgttgaccagtctggagtgcagtgtgcaatctcagctcattgcaacctccacctcccaggttgaagtgattttcctgcctcagcctcctgagtagctgggattacaggtgtgcaccatcatgttcagctaatttttgtatttttagtagagatggggtttcaccatgttggtcaggctgggctcgaactcctgacctcaggtgattcacttgccttgggtttccaaagtgctaggattacaggcatgagccactgtgcctggcctgcaaatggtttttccctccattttttattttctgtagtaaaatacacataacgtaaaatttgccattgtaaccatttttaagtgtacagttcagtggtattaagtacattaatattgttgtgcattcatcaccaccatccatctctgtaactcttttcatcttgcaaaactgaaaatctacacctattaaacaataactctccattccctcccaccccccagcccctggcagccactgtacattctatctctgtggtgttgattagtcttatatcagcagaatcatacaggatctctttttgagactggcttttttctcttagcataatgttattatggctcacccatgttgtagcatatatcagaattttctctcttttaaaggctgaataatattccattgtgtgaatataccacatttggttgcgaatgtttttgcatctatgatttaaaaattatattcgaggttattagaaggtgattttaggggttctttaaaagaaaggctaatgttggtgtctgagaaccaggcttctgggagccaggaggcatctggccagagcagtgcagcctgcagcccagagctccaggtctttgcgtgacccacgcactggtgctcatgttcctccaagagcccgaaagaagagcctgagtcactgagagattcctggtcatttgatgacggcagccctgtgctgtctttcctcattgtcagatggaagtctcttcttctttctagagtggcttaggcatttgagtttaccataatggccacctgaggctgcagctggttctgaaacatcagtgtgccacagaatcaatggactgggagcttgtttaaagatgcatagtccaggtcccacccccagatcacaatttactaattttggcatgggagctaggagtttgaattttaaataagcactcaaggaaattctactagttttttgaaccacattttgagaagtgctcataaatgcccgcagctaggcatctttagaatccatcttttccattgagaggcagtgttgggcagtgttgggcagtcaacaaggtatggaactggggacaggccatctgatttattctttgaattcctcagcagtgctactttctgctatttactttacctttttaggtaatcagctcagtagagctccccagcaccttagacatactaagtcagaatttctgggacaatgtatatcctttacaacagcttctctgatgcttcagatgcacagccagcttgggaaccactgaacttgataatcatcttttctatctgtcactaactacaatttcgtaaccgttgtctcaatcttaagccattgttagaggtggggaacaagaaatagcaagcagaaaactcaacagggttaaggcttgaagtcactcttctggagccctgtataatgaaacgggttatcaaattattatgtaactcagaagcaatctgcattgagttatttctttgcatctaacagttatatctagtttctcttgagttacttgttttttctagattaggtgagggttgccaacaccttactgctttttataacctttcaggatattccttattttttctggacttgttgtccagcctctgcctgggtcagcttgctgcttctgttaagtatctctggagccgtttttcttttgcaaaagagcacatctttgtttggacagttcttgtccctaaagcactctaccaggagcatctgcttaacccgcctggcttgtgacgacaacttaacagaaagcatggagcaaaactttgacaggtcagaaaacagtggcattctctctgaaatgtggttgtggcttccaaaatactttcactagtctttgcttataagaagaatgctttgtttgggaaggatctcaaactcttacttccttgttcagtgagaaagggagggaggagatggttttagaatattgatttcttagagcattatctggcagagctcagcactttctcctccattcttccaaaggccccgataaacacctctagaatagcatttattaatcagtgtagcgttattttcgttttttaaaaactgtggtaagatatatatgtaaaatttaccattttaacaatttaaaagttaagtagcatcaggtgcattcacattgtggtgcaaccatctgccaccatccatctccagaacctattattatcttcagatatttaaaaaaatgtctgcctcatttcttaaactgtgaactccttgaagacaggaattctattttattaattttcatatttgttctgtctaatataatatctgacctgttatgggaactcattcatgcttgtgggatgaaagaatgagtgaatagagcttcttctagatgattgctgttattatcctttgtgatgttctttgacttctagtctcactctgctatatcatcttgcaacttagtagaaatatctttgtatattttcattttgagaatatatatggttgctgtatttgatgaacctgtgagctaatggaaaacaggacttttggattaatgccctggactttctcattttgaaaattaaaaaaaatctcaggcaagagctgaatattctagtttgttataaagtctaaaatagacttataattttggtgccatattattcttgtgtctttattcagccatttgatctgctagtgccagtcctttggcagtgtgcattttaatttctaggccccatatgcaaattttcatgaggagttctttgttttgttctttctctacagaagccaccctaggaggacccctcctttcaaatgtgtcttctgtacccctctctgaagagacatgtttttggcatcagttagaaaactttggggccagactttaggatgttgtgttcatcaatgaaatggagggtctgagtatgtagcatcatcagtacataggatagggactcagtgctatagatgatcttagaggtcgcctagatccatctccccactttatggaggaagaatctgagataagtgacgtgacctggttaggctcacacagtgtgttgtgggagggtcaggactagcaactagtttactcatactttcagttctgtaaaattaaattatttaatatgtgcagcaattgctgttttatttatttatttatttttgagacagagtcttgctctgtcacccaggctggagtgcagtggtgctgtctcagcttactgcaacttctgcctcccaggttcaagtgattctcctgccttagcctcctgagtagctgggatttacaggcatgtgccaccatgggcctggctaatttttgtatttttagtagagacagggtttcaccatgttggccaggctggtcttgaactcttgacctcaggtgatccgcccgccctggcctcccaaagtgctgggattacaggcatgagtcatcatgcctggccagcaattgctgttttaatatggcctccttttaaggttgaatttagatgtcaacagggcttgctgtatgcattggtggagaagatacctacttcttttatatgacttgtggatgccacgggatcaccttgtttgcacgttggattgttcccaacgtgtcccagattctgaccacagcagccatgtgtttagattgaagatttgagtccagcatgtaggttacttggttcatctatttaatatccattaatatactattaaggattaggctgctgtcacctcacagcctctataaccttggtcatatgaggcttacaaagattaattttttgttgtttgtttttgagacagagtctcgctgtgtcacccaggctggagtgcagtggcacaatcttggcttactgtaacctccgcctcccaggttcaagcgattcacctgcctcagcctcccgagtaactgggattacaggcatccaccaccacgcctggctaaatttttgtatttttagtagagacaaggtttcgccacattggccaggctggtcttgaacttctgacctcaagtgatccgcctgcctctgccttccaaagggctgggattataggcataagccactgtgctcagccaagaagattaattttaaaaataactgtttacctttaggtagattcacagaaagttgcgaagatagcacaaagcggccctatattatcttaacgcagtgcacccagtggttatatcttatgttattatagtacaatataaaaagcaagaatttgacgtttgtgtggtatgtgtgtatggttctgtatgatgctttattttcagtggcatagagggagttttggaaaatgataactcactgggctctgaccagtggtggcagccctgggtgagggggaagggggcactgaaatgagtaccaagtccctgggtggagtgaggaaagggagaaagagcaagaaatggagttattttccctcaagggtaactttcctattcagtacaaacctgtagctatgctgctgcttttgctcccttgcttgagataggtgcccaagaaaggtggtcatgttacatgtctttaaaaaccatagttccttctactttgagtaggaacagagagggttaaatgggtgatttttgtttattgtttgtttttaaagagaatatgtttctagttagtactttttttttttcaacaccaaggaaacaagtttgtcccttgtactgcataatgtatttgtactgcagatggtaacactgttttaggagtatgaatgtgcttgtgatccctggatacctggccactattctgctaactggaggcttgtatggtctatgtcttggtcattggttagatccattattcccaagtcctgtcactatgagtgactgtcaggtatagaccagcttcagttcttcaggtgtttagttccagccttgataagaaccagaatatttgtaatcctttctaatgagagaagggatccaggaacaaaactgtctcctggggaggttctgattcctccctcctcacactcagtagattatcttcctttccacttcacagagaacacagtcatcagatgggaatttctttcactttttctgccagatttgcatgtgttgcctgtgcccatctcatgcttattctcttctttttagaggaaaggtcctattcttcacatctaagaccaatatcccgatttctgccttggcttctttcttcctctactttgtcagaaaacttgcagtgttgacagtctctttcttctcagtcttcaaactggatctctttctgtcttagatctttttataaaatctaatatgtttaattctttctcattgaaaaaacaaaaaatatagagaagtactgtactttaactctacttcctcttcagtgacttcacattcccattctagccagtcttctaaaaaaaaatgtctgatctctctgcctccattttcccaactcactccagtttgactgagatttctttctacttgtttggattcttcttcttggtcactttcgtcatttactctctattacatattggcacattgcaagtttggttttaagtttctttcatttctcactctagggaagttcacccgaaggcatggtttcagtttccatctatacaccaatgactctcaaattggcctctctgagagaacctatacctctgagttctagacctttaaaactatctacctttaaaactatcaacatctgtatttggatgtttcaaagcaccccaaactcttcatgtccagtatcattcttaacaatctttccccaccacacctggctcctctgcagcatttcctaccttatttaattctctatccattcggctgtgcaggctggtaaccttagagttcttgacacctcatgctgcctgaccacccatattcaggccttcatcaattcccacagctttttcccttaaataaatatatttctttctttcttttttttttttcctaccctgagacagagtcttgctctgtcacccaggcaatctcagctcactgcaacctccacctcccgagttcaagtgatcttcctgcctccatctcccgagtagctgggagtacaggcgtgtgccaccatgcccggctaatttttgtattttttgtagagatggggtttcaccatgttgcccaggctggtctctaactccttagctcaagtgatctgcctgcctcaaccttaaatatatttcaaatccacctacttctctatttccacctctccctcctttgtccaagccactattatattgttcctagatattacagtgtctcttaatctctctgcatttggtttttttcccctttgcaaccaattatctacacagcagtaaaaataatctcaacattagctggatcatgttattccccagcttaaaactgtccaaagactttccactggcctcagaacaaaattcagatgttttaccatggcctacacagggtcttacctgatctgactctgtttttcccatctcatctccagatttcataactctctgtaaatgttaattcacagcttttatcataatttgtaatacatactcacatatgtggttatttgataaatatccttctttccactagatcagaaggtccatgcggggttgtattcccattacacctgccactcaggcgcaatgaatatctcttgaaggaatggatgaatgaatgcatttgttgtgtttgggcctcagccctggtaattctgattcagtagctctggggtaggaactggacacctctatttattaaacccaccacagctgattctgatgctgagtttgggttgaaccccatagagaaatatgttgcaactacagtttagaccacaggtgtttagactctaaacaggaaagggaaggaaaggatgatgtaaatgttaataaacattttctctcattttgcaaaccctattgactctgtcattcctctaagtaggacagtgtacatcagctgacacttttacaggatgatatttccattgtgatttcttttttatttttaagctctcccaattttatggtaaaaataaaagaggggaaaaatagggtattacatgattgctattacgtaggcaataggtttaggcatagtcaggttagtagggatcggaataaagctaaaaatatgaagcttttgtgttgtatgcgagggtgggaagaaacaccagtcagtacacatctaaaggtgacaagacacagacctggctttcaaggagcttacaatcagaaaagcttcgtgtaacaaatgcaaagagcattagattaggagtcctaagacctgggtactgtgctctagttaagtgatggtgggcatggcatttcagctgtgggtctccgtttcctcagctgtaaaataaggggtttggatcaagggatttttaaggatcttcacaactttacaagtccaagatagggctggaggggactgtaggatttggatgggaagtggtgggctctgagctggctgacagggctgtggggctgggagcaggcactggctggcatggagggcttgtagagagtagtagttgaagagaaaggtggggaagtttgtgggccgagctgtggaggatattggctatcaggctgaaattttgtatttcattttgtagacaacaggcagctctaaaaacttttgtgtattttactttgaatttcaatcagtgatgcaaatttcaatataggacttctgaggacaaaggaaacaaaatgtgtgtgaatgggtctctcaaattataaaagttataggatcataccttcataattttcctctggttataaaagtaatgcatgagtaaggtaaaaacatccaaacatgatagtgtagaaagtatgacacccttatggtaaacttccaaacaaacaaaaatcatcagtatgtgttgtcttcttattgctttagtagaaagtttctatgtaaaagtatgacatgattaaagttgtattttaggaagatcactttggtggcagcatgtagggtgattagagggagagaaactaaagtccaggagactaccagggggttagtattattgtttaacaaatatacgaataccttcaatgttagcttataatcgaataccttcagtgttagtaagttcaaaggtaatgggggactgcggtaagagagcagaaaaaattaaagaggaatggatgaattcaagagacacttaaaggcagaatcattaggattagtgactggatttcgattggagcagagaagaaagaggagcaaaaggtacctgggaatttcaagttgggtctttgggagaatcacccatatcagttctagggaagttagggatggaagctcagtttgggtgagtggtatgagctagatgtatttggactgagccatcagaaatcacatttaggagcaaagcagagaagccatccaaagcaatagagaaagaacagccagttttgggaagagaaaagcaagcaagttcaggcacagagcagagggcaagagattcagagagagtggctttccaggtgctgcagaggcctcaaagggagtgaggcctgagaaaggtgacaggcggttagaggaaagcaacctggcataccgagcatcttctggggtcagtgaaatgggagaggcagaatcgagatttcaagagcaataaagcgcataaatagctatacataacatagctatgtaatgtagggtaatgtatataatagtctacaacttctgttcctaagaaggagagaattaatatgattatctggtggaggcagcagcaatataatttcatttatgttatggtattcctattcttacttaacatattcatgcccagttatttatgtgtaactgtgaggttgaacatttattacttgacaggtgaagtaaaaaagcacattatttttgtgccattttgtcctgttctttgggacgaattcttccctactccttggataaaatgtagggaaaatctcatcatttttatggttactctttggtaacaaaaggtcctgtcatgttcggttactttcatatacacagtctacattcagtaattaatatgtccagtctaataaaataaaatgctcccttctccagctcgggtcttctttggtctggatgcctgcctccaactcactaggctgcctttgactcctccagactgaattgggtggaggaaagagaagtgaggggtaacaaaattctcatctgatgtataaggatgagtcatgtgaacttgctaatatttgtcctgcaaaaatgtcaatttaatatggttcaatgtaatactgttgtcatctgcatgagacctgtctgggctaagacggcatttaaaactacatttttcctttttagaactcctttctgtattcctaggaggacccttaagattgtggggaggtctttcatccaaagtaccctggatgcttttgaatctgtctcctccaaatggcagctcataactccatctttagctgctgggcatctagatcacacacctcagcttccctcttctgagggcttgccttattcctactaaggctgttttgatcaggatagaaaacagttccatgctgacttgctcttttggcatatctagttgagggaaaatgctcatgctttctctgatcctgaacattcaggagatgcagaccactcctagcatagcacactcttagctccactgccagcacaaatattataccctttagagttttcaggtgtgtcaacagcctgctcactgacagcttgaggatgctcccagggacacatacctagttgtctgcattgtctatggaagcccgtttccctaggcttgaaatgagggccaagcaactctacctgatgccccagggtggggtgagtgccactcctagctcatcgaaagctctctcctgaaattcccttctagttttatttttatcttgacctttccaccttggtgatgggttaagagttacaaaaccagtttttggaaacctcctttacaggtcctgcatccttcacctgtggaaggtggacatagttgacatctattgtcttgggggctaaacgcaaaactgagtctgaaatagttcccttttaacctcccgttatgtgcagatttaacaaattcagtgcctttcttaaagtaaaaggtacatccagacactggagagtagtgctaaaacaaactattagggaattgaaatgaccataaaagaacataatgaacaaacagaaataatccaaccagcaccttagttttgattctggcattgctttttactccagaagcaagagttgaaagaaactgacctgcattttaaaatatattttttaatggtcatgtaatatgctatatttcttcaaatctgttaaaaatagaaactcaagagttggatggcatcatggttagggaagaaaaattctgtaactggaatagatggttgtagtaattcacatgtctcaatttgtattctagtcataacatacttcttaaaagggtggtaaaaataatgtgttttctctttcccacttcatttgtctaatttctgtaacatacaccctcacaatgaattattgactcagggacaagaggtagagaaattacagaggttgctaagaatacctgctgactcttattttctacttctgctttagaagttgtttagaaaatctaatcaaggccgtcttacatccagtagaaacagagagtttctactggatgtgctttggagcaggtttttaagagagagctttccccatggaagagtgaccatattggggaaagaagagctcaggagacatgagttatgcttctcttgcctggggaggtgtttgcttaaaagacatgctgcccaagtatttaagccttcaggttagggtcttttttccagttgttggcagagtgaatgagcatgaactgtatttgatgaactacagttaacacaaatactcattttgaagcagataaaattattttgaaagtgaaggaaaattgtttcataagagaaacttgtacttcctacgaaaagactgtgtttttttgctccatgtttttagtaaagtttagtcaaatttagtttagttcacctagaacgaacactgaacaatttggaaatacattttattcctttttttaaactagaggttagcaaaccctggcagaaaaaccaaatgtagcctgacacctgtttttgtgaataaagatttattggaacatagtcgtgctcgtttgtttacaaattgtgtctggctacatttgcattgcaacagcattgttaagtagttgggacagagaccatatggcctgcaaagcctaaaatatttactatcccactctttacaggaaaagtttgcagatccctgttctagattaatgaaagtactcagtatcagtgtttttgtggttatatatggcataaatggctattaattctctgaattattattaattttaaatatttcagtatcttttgtacttgattatatatctcattaaaataattgaattaattctgaaaattggtatggtctgtttgcctaatggacaatacactggacattacaaaactaatttctgcttttcaaatcccttggacagtaaaataatttatttcttgatttgcattttaccacatatgagcaccttgggaagacattgtgtagtagaaagcatactgtcagcacccacttccaaaatgttttctagatttattggaacaatttaaaatgtcagtgaaaagaagtacttttcttcctttgtgttcttcatttttctatgatggctggatgcattcactccttggggcattcatgttccttccttaaagggcagagttaaggttactctgtgggtcatttgcctcttcagggttgtttgatccttctcaagagaagattattttaatgtattgcaggagatgctgcctgataactgaggctgatctgttgagcactgtaggaaccagactggggacaagaattgactcatttattcatttatacttatgtttattcaacaaacgttgaaggcatgctttactaggttctgtgctctcaaggatttcatagtctcttacaggagatggacacaaagcaaatgattatcatatactgtgttaggcaagatgattgagttatagtcaggatattataggagagaaggggcatctaatccaccatggggagagggcaatcaagaaaagctatttgaaagaggctaaatccagatcaataaatccaggacattctgtcagaaattcagatggagatgtctggcaggtggatttgagtctcaatctgggatagagataaggatttaggtgtctttattctaggaatggcagttaaaaccctgagagctgatgagagcctgaagagtgggaagagggctcagcatgggaaaggccaacatttaaggatcagaaagagatgcataaaggaaacaaggaaggggtcagagagataattaggaataccaagagaacaaaagacaatggtgtttagagactgagtgaggggaaggagacggtcaatggaaagatggaaaatccaggattgatcagggactggcaatgtaggaggcagaggggagatggaattcatttcaaatattctaatgtaaactacttatgtgttaaacaaatgatgacctaaaacttagtttcaggctgttgtttaaagtaggctcaaataagtaagttgatttcctatatttgtaaaagctaataatttttatttaatcaaacacacatttattgagcacttattttgtactaggtgctataacaggttggcaccctaagggataaactatgcgggatataaaaatgatcaaaaagtgaagtagtaatatttaagctaagccctggaaaatggggagggatggaagtacatataagtcaagaataggcaagagttagagcaaaaacacagtgcatgaaaccccaggacactgtcagtcttgaattattgttcttgactatgtctgtctccaccactagactctctaatgctgaggactgtgatttatagagcctcacatggtgttttgcatgttgtatttactcaattaatgtttgctatatgaatgaaacttgagaaacagaaacatcataattgttacttattccatagtcttgtctgtgctggcctcagtaataaagcaaaaactaacttaaagactagcattcttatgttcattagtaaaacaggtaatagataaattaccttcttgatttgacttttgagaatgacgtgttagaacttataaatgaatcaaatacgtgtaatttataatgttactatatgatatgaaaacaatttgagatagaagtcataaatatgaagtttcttaagactttgatcaaaacaacaaaatttctttgagattttctttttttaaaacttttatttttcaacaacagctaaccaaagatgggatcttctttacatgacaatgttgaagccaattgatacacaatttatttgttagcgtgttagtggttctatttgttttatattttgaagtgaactatggccttcttttaggactgaaaaataacttcgtggtgtacagatattttagattaaccaagggtacttgttaacaaaagctattattttatagctgcatctccgtgtttgatttgataaatttgggaattaaatttacaatgcaaatttcattagtggaattacatagccaatttggagaggttctatttaatgtgctaccttgatttagaatgagcgatttagaaatatgaagagttgactgggcatggtgtctcatgcctgtaatcctaggactttgggaggctgaggtgtgattgcttgagctcaggagtttgagaccagcctgggcaacatggcaaaatcctgttctacttaaaaaaaaaaaaaattagctgggcatagtgacttgcccctgtggtcccagctagttggtgggctgaggcaggagaatcgcttgagtccaggaggttgaggcttcagtgagctgtgtttgtgccactatactccagcctgggtgacaaagtgagaccctgtctgaaaaaacaaaaacaaaaacaaaagcaacaaaaaaaggagaaatatgaagagttagataaatgatacgataatagcccacgttttcttgttgattgtggaaaaggaaataattaacagtatctattataaccacataggatgtattgatttaagaattacagtagaaaataattcaaggaattggaaaagtgaggcatgttgttctatgaagattttgcatccttaattatttataagtatttgagttatgtgtaacttcattttctccattaatttttgataatgatatccaaaacaaatctgcagttatttgttagtttgacctgtgttatctttgcttcataaattcctcaattatctagtttaatctagttcttatttcacaaatgatggaagtcagattaagcagtttgtttaaatgacccgcaatgaattatagagataggtcaccattttatgctaacgggttggcaagaaaaattcatgaaattttacaggcttcatgttgcagttgtctacaaatacacttccataaatgaaaataaacaagtttgttcattgcatcattataaatgtaatttaaaaattaattttctaaattgttttatgcaagtaagtaagcaagcaaaataaataagaactcatatactttcctgtcttttttttctcccctgcccaataggaccagacatactatcaatcatttcaggtttcagaatatggtaagagttcctcaatctattttggaagaaaaaaacatttgttactttcagcagagattagagaaatttttaagagatgtattatttgaagtaaaaatctcaatggagttaaaattctggtgttttttaaaggcctaaccatattttttttcctttgtaaaaattctaaaatctcattatacagaaaaaagtagaaaaaaatcacctatagttgcattgtgctagtctttttcttatccacaacatgatttttctatttttctactttgttgtgataaaaaaatatttaaagtgttgcacttaaaaatacttaacaaattctcttccatatttttcatttgattgacattggtaaagatggtctgtttctcaggtaaatcctcttcttgcaggtgccatacttacaatatctgttagaaacccatagataaaaacagtgggacccatctattttgttggtgaatggagaggaatgagagatgagactgaaagcataggatcttagtattagttataatttgaatagttattttgaggttgcacatgcagtttttcatttgatttgagcttcttttttgagattgggttttatttaggcagtagaaattataatatacaggtagtaatacctcaggctctgtgggccatatgtctctgttgttactactcaattttgccgtggtagcatgagagcagccaaagataatatgtacatgaatgttgctgtggttcaataaactttattttatgggcatgaaaatttgaatttcatataattttcatatgtcatgaaatattcttcttcttttgatttttttcaaccagttaaaaattgtaaaaaatgttcttggttcatgctggtcatagtttgctgaactctgatctgtaactgtgctctccagtagcggggccacttgccatgtgtggctgttgagcacttcaaatgtggctagtccagatggagacagcagatgtcaaagacttagtacaagaaaaatgaaagaaagaaaaatagttcattaataaccatttttaaatttttattatttgttgaaaagatactattttagatatatagggttaagtaaaatataaaaattaatttcacctgcttatttttactttaaaaatttgactactagaaatgaaaaattacacatatggctcccattttatgtcttttagacagccctgatctagaagaataagtcataggggaccaacatttttataggctatctttatatcccattgtgatggtatgctgggtggttgtatgttgttgaatgaggtatagtggaggtggggaattgattgcaaacctatgatgtttgaggaagaggcatttggattttcttggtggtgggggttgcgggggcggggtcatagttgactcacgtgactttttggtctccctgtcctagactgatctagagtctaggagtgtcttggtacattcagggccattagccttgattggagctgaaggtctgccctatattgttgactatttggcttttttgatacttctcttatgttaattgaatggtgaggtgccttgttatgagagtggcctgtttctttggtcagagaactatagaaaaaaagttttatcgactgtaaagaaacacacattttttactctggtggagtgctttatatcaattatagtattagtacttataaaatagtttataccttaattattattattatttttcgagacggagtctcactgtgtcactcaggctggagtgcagtggcatgatctcgggtcactgcaaccactgcctcctgggttcaagcgattctcctgcctcagcctcctgagtagctgggattacaggcatgcaccaccatgcccaacaatttttgtatttttagtagagataggattcaccatgctggccaggctggtcttgaactcctgacctcaggtgatccacctgcctctgcctcccgagttctagaattacaggcgtgagccactactcccagcctcataccttaattatataaagctgaccaaattagggatttctagttttgggtgaaacaaagggcttttcatctgtcttaatatgtatttggattctaataaatttaagttcaaatagtacaaattattaactccttcacaacaattttatttttcattttattcagtggaagatgatagtgaagtagattctttaaaagatttacccttgcttcttcgtctcaaaaagaaaaaaagatttacccttgcttttcttttccagtattaccaaaatttgaagtgactttgcagacaccattatattgttctatgaattctaagcatttaaatggtaccatcacggcaaagtaagtgtcatttttcttttgatatgactcaaaaccattataaaactgtgtgaccaaaagctgattgtatacttcagaatattagggcaatttttgcttattaaaataccttagtggacagtaaatgactatttataataaataattaagcatgggacagagctccacatttcactgcatctatcactctgcttgcaagccgacccagtcttaaaatatttcccatatttcttagacttattaagggatttatattatagatagcactgtttttttttcagatgacatggacttgaagccaccacgcctggctaattttttttcctttatagagatggggtcttgccattttctccaggctggtcttgaactcctggcctcacatgatactcctgccttggtctcctaaagtgctgagactacaggcatgttccaccactcctgggctgatttgctttttaaaaattagtcaagcttttattttctgagtgattaacttatcccaaatgcttcccggttctatttgggacaataattgtatctttgtttcacaattattataaccagcttggtgtttggaaaactaaatctgcttcacattaaagtcaaaattaaaaatttttatgtctgagagtactttaaattatatttggattttaaagatccttttactaccatgtgatataactctgttaaaatacaatatcctggcattctagttttgcttttatttaatctttagcacgatacaagtagagtcaggtttcgaagactcttgaatgagtgaatttgatgctcaggttgctaaccagggtttccactgactttactgtttttgtttggaagtgtggtgcatttgaacttggatttttttttttttcttcttagtttggaatatgctatattttaagatttgcttttgagttgagttgatccagatgaggggctgtttctgtgttcagttaatggattcaggaagccgccgtttactgctgtgatttatagactgcaaagcaaaattgacttccatgtctggctcagcatttcacaatagagatagaagcaacccaggaaatgtacttaaaaaaggctttctgggccgggcgcagtggctcacgcctgtaatcccagcactttgggaggccgaggcgggcgggtcacaaggtcaggagatcgagaccatcttggctaacacggtgaaaccccgtctctactgaaaatacaaaaaattagccgggcgcggtggcgggcgcctgtagtcccagctactcgggaggctgaggcaggagaatggcgtgaacctgggaggcggagcttgcagtgagccgagattgtgccactgcagtccggcctgggctaaagagcgggaccccgtctcaaaaaaaaaaaaaaaaaaaaaaaaaaaaaagcctttctggcagtaaaatgtattgcctcttcttcacatgaagagactttcctataatgagagaggataaaattaatacatagaaagaaaagtagcagagaatatttgacttacgaagctaagtttgggccaggtgaggtggctcgtgcctataatcccagcactttggggggccaaactgggtggatcacttgaggtcaggagtttgagaccagcctggccaatatggtgaaactccatttctactgaaaatacaaaaattagctgggtgtagtggcagacgcctataatcccagctattcgggaggctgaagcagagaattgattgaacctgggaggcagaggttgcagtgaccctagatcgcaccactgcactccagcctgggtgacagagcgagactctgtctcaaaaaataaaataaaataaaattcgctggacgtggtggtgtgcgcttgtcatcccagctactcaggaggctgaggcaggagaatctcttgaacccctgaggtggaggttgcagtgagccgagatcatgccactgcatccagcctgggtgacagagtgagactgtgtctaaacacacacacacacacacacacacacacacacacacacacacacacacacacacacaaacccagaaactaagtttggtactacagattttaaaaattattcttattttaaattttttggcaaaaaatcaatttttgacagccatgagcacatttggtgcttcagaatctatggtgtaataaaccttcctcgctaatattggaacatgtagcaatagaccatggtgattgcactatcagctgacatttaaaaatcttctaaagctgcgaagtttcgtgggcattcagttaatgggccagtccagatttctaggagtgaaagatttatgtaatctttaaaaaatctttggacaggaaactgtcacttccaattatgatcaggtattttctggagtctttcagatggtcagaggttgggcagagtgtgtgttaagaactgttttaagctactatagttaaaagtcttcccattttggaaacttaatttcaaggatcaccatttattttttatttatttatttattttttgagttggagtctcactctgttgcccaggctggagtgcagtggcacgatcttggctcactgcagcctccacctcctgggttcaaacagttctctgcctcagcctccaagtagctgggattacaggcacccaccaccacgcctggctaatttttttgcatttttagtagagatggggtttcaccatcttggccaggctggtcttgaactcctgacctcgtgatccaccagcctcggcctcccaaagtgctgggattacaggcatgagccaccgtgcccatccaggatcaccgtttattaaagacatttttgttgggtttagtttaaaaaattatagtaggagtatgtttttaatgtaacttttttctttttaaaattttctctttttagtgttttgccatcccataatgtatttttttttaatttatttattttgagacagagtcttgctgtcttgctgtgttgtccaggctggagtgcagtgatgcgatctcggctcactgcaacctccacttcctgggttcaagcagttctcctgcctcagcctccaaagtagctgggagtacaggtgcctgccaccatgcccagctgatttttgtatttttagtagagacagggtttcactatgttggccaggctggtcttgcactcctgacctcgtgatccacccgcctcggcctcccaaagtgctgggattacaggcgtgagccaccgctcccagcccaatgtaattttttaaaatgttagattgctaattgctaatgtatgctattgaaagtagtatttttattgtgttctgacaatatcaagttgatacataaaaagactatgtttataattattcaggtatacatatgggaagccagtgaaaggagacgtaacgcttacatttttacctttatccttttggggaaagaagaaaaatattacaaaaacatttaaggtaacttttgcagacactttataacttgtgatgggtaaaatatgtgtatttttctagaaataagatttagtactgaattaacaaaaagttaagtgtaagaaaatcaagagctttccagcattgaacaaatgagaatttatgcaattatagcgattaaaatggtaccagagctatcatattgttgtgacttagtttgagttttatttctaaaatttgaattgctaaaatggtaaataatactgaacttttaaacaaaacagataaatggatctgcaaacttctcttttaatgatgaagagatgaaaaatgtaatggattcttcaaatggactttctgaatacctggatctatcttcccctggaccagtagaaattttaaccacagtgacagaatcagttacaggtttgtagactttaaagtggaggtaaaactattcatgtgacactgctttatcatctttcttattataactggcactttcatttgggagcatcattgactttctaaagatgctatttaatgttgaaattgttatgactgttagtctaagttgcaggatgattttataagggggaccttattttctatgaaagtcactacttcaaccacatgtgatagctcttcttaatttttttttccatttctactctttccccctgaaaactacatggaaaggcttacattttcagctggtaaccttcttctttttaaaatcactgaaatctcagctgttcctagacagttttcacttttaataagaaaataaagttgagtttcttggacctttctgttactatttcaacaactttagccaatccctgaaagagcaaaagactattctttcattggccttaatttgctgctgttgtacatgtcactgcggtagaatggcagcaatggtgcttagaggggatccatagagaacataatagaactgtgtggtgcttgtagtgtcaaagtcaatatgggaatgaggcttatgtgccctgatatttttaaccctttttgcaataggttagatggagagatttggtggatagaagctttgggtgaaacattacttttgctttctaaattgtgcaatttccaaaaaaggtatttcaagaaatgtaagcactaatgtgttcttcaagcaacatgattacatcattgagttttttgattatactactgtcttgaagccatctctcaacttcacagccactgtaagttggtatatttatttccagtccatagcagtaagttcagcttaatgaaatagaatgggaaataatattttcaatgcttttctaaaaatttaagccaaaaagtatataactttgtctctttagacatgtggggcatgtagatttgtttccaaatgacctttgtctattttttctaaaaaagtagttttcaacaacagtaaaaatattttttgaaaatgtatttttttttacaagcaatttaagttagatgtggattgctacactgaagcttttattaattaattgaaataattacatggtagtcaaaaatttcaatttcaatttggtttttataatgattaattgtagttctaacaaagatgttacattaaaaaattatcaacaaatctcattttttggagataatgttgaattaacacattaattgtgtgaatgttgacaatgagcaaggcatggtgttgggcagggctatagagccaagaagggctcagtccctaccctcaggttcacagtttttgtgatggtgacaggaaaatatatacttaactataactcatggcagattaagattagtgttacaaattaatttctgtagggatttaaagcaggggttgccaaactttttctgcaaagggctagagagtaaatattttcagctttgtggccatgtggtctttgtcacagctactcagccctgccattgtagtgtgaaagcagccatagccaatttataaataagtgagagtggaatgtgttccagtaaaactttgtttacaaacatactggattggcctatcagcttgcagtagttggctgatctctgatttaaagaaaggaggagtcaggcctggcgtggtggctcatgcctgtaatcccagcactttgggaggccgaggcaggcggatcacctgaggttaggagttcgagaccagcctgaccaacatggagaaaccccatctccactaaaaacacaaaaaattaggcgggcgtggtggcacatgcctgtaattccaactactcgggaggctgaggcagaagaatcgcttgaacccgggaggcggaggttgtggtgagtggagattgcgccattgcactccagcctgggcaacaaaagtggaactccatttcaaaaaaaaaaaaaaaaacaactaaaacgacaaagaaagaatggaggggtcacttgttgaatgggtcggtagacgtttcaggtagtttctgatttcaatgatcttaatttaggcagtttgaaaaggtcagtttaaaaaattgaggctgcaaatggtaatttctgaatgagtagagtgaaaccatgggcgttcagagggggagagttggctgtgggataggcatgggggttactatgggatgctttatggaagaggatggtctaaactgttttttaaaagattagttgtgttttaaatgcttgggcatgggagtgggaggtggggagcaagataagaagtgagacaagaaggagaggtctggctggcaatttcggggtgcactcaggtagtgtttgagggagactgctcaggctgtgtgcaggaggatggctgtagcccaggagtgaggggatgggcagccttgtggtggtagctgtgggagtggagaggatggaagagagaagcataggactttggtgttcattggatttggggggtggggagagggagggaaaattcagaaatgtaaagtcttgcaaaatcctgatgttagcgaaaataggaaaatgacatggttgctcattttagatatgtgaattcaaggtgtccaggatatccaagtagaaatttcctgcaggtaactggaggtgttgggcatgaactccagagaagggcaaggatgggaattttggctttagggtacaatcacagagatgacaagctaagcaataggattgctgagaccttggaggaagggagaagaacagatgtccaaaattcccacatttagggagaggaaagaggaactgaaaaggacactgagaggatgcagaaagagaggtaggaagtgaagggggttattttggagccgcggaagttaagggaatccataatattaacaagggagtaatcagtgatgttggatgcctcctagagagaggccactgaatctggatattatagtgctaccaataatttttgagagttcaatttcatgagaatactacagacggaaactgtatttaatcgtacttaaatcctttgtgtttttaagatgttttgttttgaccattaggtgaaggtaactcgtgctgatggcaaccaactgactcttgaagaaagaagaaataatgtagtcataacagtgacacagagaaactatactgagtactggagcggatctaacagtggaaatcagaaaatggaagctgttcagaaaataaattatactgtcccccaaagtggaacttttaagattgaattcccaatcctggaggattccagtgagctacagttgaaggtgccgtctgtttcccatcattgtgtcactgcaacaacaccattacagttgtaatcttgtggtaggcactcaacctgtcagaactgaaagtacataggaagtggacacatgtttctgtttcacaaaatggaggagagtggtaaaagtaatttaatgacagtggctgaaggttagactaaatttttccttgtaagttcattttgaagagcacagtaaaatatagcaatgtgaagatatgatggagaatttcctcaaatccccagtctagtgtttgaggtcagtcatttgaaattttattttggcaggaattgaaatgaaagataaatatatatacatatatatatatacacacatatatatgtatatgtatatgtgtgtgtgtatatatatatatatatattcctttcctgtgttttaaagctatcagtttctttacagtataagctataaaatgatgaaaatccaatgtctggtgaatgtatttttcttgcattaaaaaaaagtgaagatgaatttggtctttaataattgttcagcaggtaacatcttttctcaaggtgttactaaagatgaacatttacagctcctttttcttttattataggcctatttccttggtagtaaaagtagcatggcagttcatagtctgtttaagtctcctagtaagacatacatccaactaaaaacaagagatgaaaatataaaggtaatgcttacaattcacttgagaattacaatataattggactatcttgcttttgatatgtacatattaattaaggtttttttctaggtgggatcgccttttgagttggtggttagtggcaacaaacgattgaaggagttaagctatatggtaatctcttatagaatctaaatttatgatctattatagaatcatctttttattcacttttaagttctggggtacatgtgcaggtttgttatatagctaaactcatgtcatgggggtttgttgtacagattatttcatcacccaggtattaatcctagtacccattagttatttttcctgatcctctccctcctcctaccctccaccctcccataggacccagtgtcggttgttcccctctatgtgtccatgtgttctcatcatttagtgtgcacttataagtgagaatatgtggtatttggttttctgttcctgcattagtttgctaaggatagtggcctccagctccatccatcttcctgcaaaggacatgattttattcttttttatagctgcatagtattccgtagtatatgtgcaccacgttttctttatccagtccacctttgatgggcatttaggttgagaatcatcttaaatggtgtctaccttatatctacactaaacttattaatttttataactcagcctcatacctttttagcctgtcgttttaacattgcaatcaaataaaaaaccttttttatttcttcacctatgtttgcatttccaatttaaaatagataactaaaccttgttttatgtttaaaatttaaatttctatttgataagcaatatatattcattatagaaaattatacaatgtaagaaaaatgaaaaagaaaataaaaagtgctatccatgaccatgtaattttgctaattcagctttcccaatggtgccctgtattccttgcaatcaaaaatagattcttgactatgaagctactgttgctccaatcagtattactttaatcttaccattttctttttctcagtgtatgctctctgtgtttgtcagagaggttttcctgcattccaaaagactttgaagctggtttaattcaagaatttgtgtgtatgcatacaattatgattaatgtagcttcagatgagatcctactaggtttggcaataaattaaacccatctactgttcttttcaggtagtatccaggggacagttggtggctgtaggaaaacaaaattcaacaatgttctctttaacaccagaaaattcttggactccaaaagcctgtgtaattgtgtattatattgaagatgatggggaaattataagtgatgttctaaaaattcctgttcagcttgtttttaaaaataaggtaagatttaaggtaatgatgtttaaaagaaaactttatattagtgaagtctgagaaatgtaatatttctttagaaaagtatcattaagccaaactggttagaaatttatattattctatttctagaactatggttaaacttttcaatatttagcattacatatatattttcacttgtggagttattggggattgatagtctatttgtaaactatggttctggtctttaagactttaactcagatcatgaagctgtttcagaatttttcaaatggttgaattaatattgctcaggagtgaaattccagtggtaacatagaattcgtgtggtgttgatattgcagtgatataaagggtgtgggaaggagtgaggccatctaggataatacgtagaagcagagctgggctttcattaatctatttaattagctggaaactagcccagggcaacttttcaatgagcttgattaccctgcatgtgaggatctgtgtggagtctggtctccaagtgcaccagtgccttttatagcctaatgtgaccagcttgagtaggaaatccctttggaccccagctctgaaaagaaacctgattgcatcatctcatgtatataagaatgagccattgctgtcactaacaactgctgccctctccatcctcttatgtaaaaaattattcctttaaatagtgatttgcagagtatggttcttctatttctttttcctttatttgttaaaatatttgagaagtaacagtagtgatctgtactttcttttttaaaatttgtatttatttattttttgagactaggttataagactggctaatttttgtattttcggtagagagagggttttgccatgttgctcaggttggtctctaactcctgggctcaggagatccacctgcctcagcctctcaaggtgccgggattacagacatgagccactgcgccaggcctgtactttagttttgttgagaattattactctcactttgattgttaaaatataatacaaacttctatttttttagcttatgaaaagagttcttaaaaagataacactgtgttttgttagtggtagagcacaatttttgacttctagtgatcctagtaattgcctgacaaaggtgaattttaaagtagaagttatggaggcttaaacatctcagaaagcaagaccaggttctaaagctggttacagtgtaaaagatcacggactttgaggaagcagagtatatgaatagcatactttcaagtaatttcttagctataagagaaaggaattagtttcagttccatttgcaactatatatctttctcttatttttatgtgataatcatcacatttataaagaaacaacataattagaaatggaatatgtctaagcaagagaaagttagtgaatgtttattaatgttcagtaatgactatggaataaataaatgagctgtaggagcggcaagagatttaggtttagaaatcatccacacagaagtgcaagttgaagccatggggctctgaggtacagagtatagagtgagaagtacaaggtctaagactgagtcttgaacatgctgctccctctcccccatgctttagtgtgtaggtggagaaagtaacctacatacagtggtttgagaggcatgtcagaaaaaaattgcactggacaagttaaacaggtaaggaaggctttattcaagactattgcaatggaagagagagatgataaactcaactctgctgaaacaaaaggcagaagagtttttaagcactggggtgaactcatatgaaagtgctggaggacattgttgggaggttggtcaatgtgattaggtagtctgtgtttgctaattagtacttactgaagttaggtttccaccctcccacagagaatgagatcaattgggactctgtctttcttgatgattatacttcaaagggatggctctgaggaccttgagaaagacatgcctgggttgtaaaactggccagaggctgggaaaagatttacatctcagagagttggagaaagaatttataattgcatgttttctaaaataaatgctctaagaaaagggagctcaggggcttatagttaggaagaagcctgtctttgtaaagtcgagtcaacttgaggggaatgttaaggccctctttgtcaggcattataatcattggcacagcagaatgttgagatagagctagatgaaatgaaaattcccagcaggggccaggcactgtggctcacgcctgtaatcccagcactttgggaggccgaggcaggcggatcacctgtggtcaggagttggagaccagcctggccaacatggtgaaaccctgtctctactaaaaaagttacaaaaattagccgggcatggtggtgggcgcctgtaatcccagctacttgggaggctgaggcaggagaatcacttgaacccaggaggcaaaggttgcagtgagccgagattgtgccattgtactctagcctgggcaacaagagggaaactccatctcaaaaacaaaaaaagaaaatgcccagtaggcaggggcctcatgacaaggccatttggttcagcggtgatgcgatgactgatgctctttataaagtattagtaggtccaggaccatgctttcctgagggtaatggtgaggaagtttagaaggccatggagacagagcatgagggcctggactagtgtttgctctaaccacccactcccttggaaaggccacccctcaccctcagtccaggtggttctatgagtccccgaggagctctccttgccttcacttctgagctcacgtcaccaacatgtaggcatctgcagtttctttcctctttcgtgtttctcctttgtatactggccttccccaggtatgctagacactgctgtcttctactcagcactggctgggatctgaggggtgggagatggagaaagggaagaaaaaagatacagaattaaagaataattcagatttataccactgtgagaagttctatgacttgcaaacactctgggcgtagtttttttattcctttccctagagaagggttatgcatggttttagaattatccctgagccaaggcaaatgtagaatctttgctatattttgggccagtggtctgctattggcaagaatatgctttaaaaaagtgaaataagttaatcctcctttctctcttttttagataaagctatattggagtaaagtgaaagctgaaccatctgagaaagtctctcttaggatctctgtgacacagcctgactccatagttgggattgtagctgttgacaaaagtgtgaatctgatgaatgcctctaatgatattacaatggaaaatgtgagtttagctattttttcattatgaaaatatgtattacaagagaaagaggaaactttattgtactactttaaatatttaaagaaaatttcattagttcctttgcatgtgtaagtcaataattagtaaagcttccaaataaaaagtaatctgtatcgtaatggttatgttggaaagaagcttatgtggttaagtgtccttgctctctttcatcagaattatcacctaaagttagatgggaggaataaattctggaggtctgtggtacaacatggtgactgtagttaatgataatgtaccatatacttgaaaattgctaaaagagtagatttgaaatgttctcaccacaaaaaatgatcagtatgtagtatgcaaggtgatagatatgttaattagcttaatcattccacagtatatacaaatatcaatatatcacattgtactccataaatatatacaataaaaaatgccacctatagttttccttcattttcatactacattttaagacactcaagaaagtactaggaaattgacttgcattattctgggttacgttggataagagagctttagataatttttgaagtgtgttctattttggttatacgtaatggttataaataattacagcacccattgtgccgggcatggtggctcatgcctgtaatctcagcactttgggaggccgaggtgggtggatcacgaggtcaggagatcgagaccatcttggctaacatggtgaaaccccatctctactaaaaatacaaaaaattagccgggcgcggtggcgggcgcctgtagtcccagctactcgggaggctgaggcaggagaatggcatgaatcccaggaggcggagcttgcagcgagcagaaatcgtgccactgcactccagcctgggtgacagagcaagactctgtctcaaaaaaaaaaaaaaaaaaaaaaaaaattacagttcccattgaatcaggaatttgcagtatattgagggggtgaaatcatgttactctgcagaaaacttacaaaccaagaagtatatgaacatctagcattgcataaatgaatcccatattcattagtcatttgatttttatttatatgtccttgatatattcttgtgtaccattgtcagttgtaaactagattgtataatttttgtctattaatggattcagtagagtgattaacaatacatcagaaagaaaactatatatagttgggttgatttggtcattatattgtaaaatttagtttacttcagaaaaattgtacattttcttcagtctacacaactatttttttcaatcttttcttttttttgaaaactttttttttttttacaaccagttggtcatttttctctctttgacttttcctgagttcacattagttttatgtctgtagatcttgcatttgatttaactgaatataatagtatctgttattttatagctttctaaatatcttggtaaatatattatttcattttttcttccctacatatgtgtatgtttgtgtgtgtgtacgtgtgtgtatacatacacatacacacacaccccatctgatgtgctgcgcactctgtctctatttacatttatatatgtgtgttatatatatatttacaagtatatttatatatacatataatatatgcatatttacattaaattttttcagatattaagattgctttctcagctttcttttggttcatattttcctggtgtatttttacatttcttattttcaaccttttgtaaatttttaagtgtatcttttaaatagcatattattatattttgcttttgtttttcaatctaatctaatagtcaacatcttttaataagcttttatttaatccacttataagtatggtaattctttttctaatggggactttttctgcttttctatattttaaaatttagattctttttctgtgggctagattaaatttgttttggtgatttagaagttatgcgttctatttttgttactctgttagttacaaactgtacccatattaatttatccttgttggtttctaaaggttatcagtatttgaatcttctagtatgctcctattccttttggtctctacctctgtctcctccttctcctcctaccctggccagatcattttgctcgtgtacagattttagttccatgttaccatagattgcctttcaatctatgctgttctttcattttttaattgtggaaatctgtgttgattatttcttcctccccattttattttttctctccttctgggacttttgtttttcagaaattggcacttttacttcctccttcacatctcttagttttttgttttatgttttctatctctttgtcttttctgtgtttctctgggagagttcttcagtcaactcagcttagtgatcattcattagctgtattttaatctactttaatctctcatattgtgtcttttatgtcagctattatgtttttaatatctattatttttcctttgtttcttgtttttgttttatattctgatatttcccattatctccttgtgtatatttgctatgcgtattttaaattattgaattgaacttttcagtaattttgtgtcacatgctatatgttgtttagttggatgtcttacttctacagtatttatactctttggaagtctagctgatttggcagattctctgataatatctattggtgaaggctgagcataaggttccaatctgtgtaagtcctatgaccccttcctgaggggagaggactagcctcatggactagagaattactcttgatcctttctgctgcttgcctctattcagtgtttcactcttaaacccttggggaaaagagcaccagtaagagaaggtctcctgaggttatgattcaccagccctgagggtttggaggaggaggagaggaagagtgaatgcttgagggacatgggtctgtctgcatgttttcttcactttcccacactagaaaggcagaggtgctgacctggtattatcttttggatacttgcacaggccgtctgagctgctactgctgttgattttggcagtgaagttgccaggactgtgtgtcctgaggctaccccctggagggaaataagagcaaagtttaaaaacctctcctccagcctgttttctgactatgtctgctgctgtgtctagctgccttctgccttagactgaagcgatgcactttctcccaagaccaattcaagatgtccaccactcttcctggggttttctcactgtgcacgttaaagttttctgcttgcttttattgtttctccagttggttctggaggagggagtgaggatcctgtcatagtagactgttttggcttcttttttttttttgttaaatttatatgtgttgtcaatagcctcttgaatgccttggaataatttcagtatgtggatcttccaggaataatttttagacattagccttcttttcgttagcctatgctgcagctttgacagtgctttgtttattgagccagtgagaacaggaagatttctttatgagatagatgctgcttttgctttttttaaaataaattttattgtgtatatttgaggttatgtgtatatatatatatgtatatatgtatatatgaggttattgtgtatacatgaggttatggaatacatataggcagtatagtggttactgtagtgaagcaaatttacatatttatcattttgcatagctacatttttgtgacaaaagcagttaaaatcgatttaatgaaaactccaaatatcatacaattctattaactatatctctcatgttgtagattatataactgcattttttcatcccacatatctgctattttgtatcccttgacctctatattcccattttcttcttcctttccccctcgcccctgtaaccatcatttgtttatctatttatttatttaaacttttaagttcagggatacatgtgcaggtttgttacataggcaaccttgtgtcataggggtttgttgtacagattatttcattactcaggtatgaagtccagtacccattagttatttttcatgatcctctccctgctcccaccctccaccctctgacaatctctactgtgtgttgttcctctctatgtgtccatgtgttctcatcatttaactcccacttataagtgagaacatgtggtatttggttttctgttcctgagttagtttgctaaggataatgacctccagctccatccatgtacctgcaaaggagatgatcttgttctttatggctgcctagtattccatggtgtacatgtaccacattttctttatccagtctatcattgacggacatttagtttgattccatgtctttgcttttgtgaatagtgctgcaatgaacatatgcatgcatacatctttataatagaattatttatattcctttggatatatacccaataatgggattgctagtattgaaatggtgtttctgtcttaagtctttgaggaattgtcacattgtcttgtacaatggctgaattaattaacactcctaccgacagtgtataagtgttccttttctctacaacctctccagcatctgttatttttttgacttttaaatgatagctatccattctgactggtgtgagatggtatctcattgtgtgtttttattttattttatttttttgagacaaagtctcactctgttgctcaggctggagtgcggtggtgtgatctcggctcactgcaacctctgcctcccaggttcaagtaattctcctgcctcagcctcccgagtagctgggactacaggtgtcgcctccacgcctggctaatttttaaacttttttagtagagaaggggtttcaccatattggcctggctggtctcaaactcctgaccttgtgatccatctcccttggcctcctaaagtgctgggattgcaggcgtgagccaccacgcaagtggccttttttttttttttttttttttttgacagagccttgatctgtcacccaggctggagtgcagtgatgtgatcttggctcactgcaaccttcaccttctgggttcaagcgattctcctgcctcagcctcccaagtagctgggattacaggcgtgagccaccatacccagctgatttttgtattttaatagagacagggtttcaccatgttggacaggctggtttcaaactcctgatctcaagtgatcctcctgctttggcctcccaaagtgctggggttacagatgtgagcactgtgcctggtggcctccttatggttctgatttgcatttctctaatgatcagtgatgttgagctttttctcatatgattgtaggcctcatgtatgcatgtatgacttcttttgaaaagtgtctgttcatatcctttgcccattttttttttttttttttttgagatggagtttcccccttgttgcccacgctgcaacctccacctcccgggttcaagtgattctcctgcctcagcctcccaagtagctggaattacaggcatgtgccaccatgcttgctaattttgtattttttagtagagatggggtttcttcatgttggtcagcctggtcttgaaaactcttgatctcaggtgatctgcctaccttggcctcccaaagtgctgggattagaggcatgagccactgtgcctggcccctttgctggcttaaaaaaattttttttttcttgtaaatttgtttaagttccttatagatgctggatattagatctttgtcagatgcacagtttgcaaaaattttctcccattttgtaggttgtttactgtgttgatagtttctttcactgtgcagatctctttcatttaatttgatcccatttgtcaatttttgcttttgttgcaattgcttttgaaatctttggctgttcctatgtcctgaatggtattgcctaggttgtcttccagggtttttatagttttgggttttacatttaagtttttaatccatcttgcgttaatttttgtatatgatgtaaggaaggggtccagtttcagtcttctgcatatggctagccagctctcccagcaccatttattgaataggaaatcctttccccattgcttgtttttgtcagatttgttgaagatcagatagttgtagatgtgcagtcttatttctgggttctctattctgttccattggtctatgtgtctgtttttgtgtgagtaccatgctgttttggttactatagccttgtagtacagtttgaactctggtagcatgatgcctccagctttgttctttttgcttaggattgtcttggctatacgagctcttttttggttccatatgaattttaaaatagttttctctcgttctgtgaagaatgtagtagtttaataggaatagcattgaatacataaattgctttgggcagtatggccattttaacaatattgattcttcctatccatgagcatgggatgttttcccattggtttgttcatctatgatttctttgagcagtggtttgtagttctccttgtagagatcttttacctccctagttagctgtgttcttaagtattttatctttctgtggcagttgtgaatgggagtttatttctgatttggctctctgctgtgtgttgttggtgtataggaatgctagtgattttcacacatcgaggctttcctgaagttgtttatcggtttaagaaacttttgggctgagactatggggttttctagatataggattatgtcatctgcaaacagggatagtttgacttcctctcttcctatttggatgccctttgtttcattttttctttctttcttttgcctgattgccctggccagaacttctagtactatgttgaataggagcggtgagagagggcattcttgtcttgtgctgataaccactgtttagatgctgcttcttgaattggtgtctgagcaagagcggaagcaaatcttcatgtatttgtattttgtgacagagttggagtcatggaactctagccttttctctccaatatgcctggctctggctcccttgtctacttgccagcttcttgacacattatgaattttttttcttattttattgttttcttattggtgcctgttctagttgcttactgtggatgcagccatggttgttgttagcattgcagaaatagtggttgcaggtgtttaattttatgctggaatgtgtttttttcaacttagttttttttgtgatttttaattctgactttgtcttaatttgtctggttaatgtaaatttttagggagaagtatcaaaattattacctaaaaaggtataatacttgatttttattgaagttaaatatatataaaataaaatttgctatttttaccattttaagtgtttaattcagtgacattaattacttcacaatgttatatgaccatcaccaatatttccaaaacattttcatggctccagacagagactctgtaatcattaagcaataactactcatttccccttccccacagcccttgggaacctctagtctacttctgtctttatgaatttacctattctagatatttcacatttatataatatttgcccttttgtgtctggcttatttcacttagcacagtgttttcaagattattccatgttgtagcatgtatcagagcttcatttctttttttttttttgagacggagtcttgctctgttacccaggctggagtgcaatagcgcgatcttggctcactgcaacctccgcctcccgggttcaaaccattctccttcctcagcctcccgagtagttgggactacaggcgcccaccactacgcccagctaattttttgtatttttagtagagacggggtttcactatgttggccaggctggtctcaaactcctgacctcatgatccgcccgcctcggcctcccaaagtgctgggattacaggtgtgagccaccgcacctagcctcagagcttcatttctttttacggctgaataatattgtgttgtgtatatataccacattttgtttatccatttttctgctgatggacacaggttgtttccacctttttggctactgtaactattgctgcaatgaacggtggcatacaagtatctcttggagttactgttttcagtccttttgtgtatatacctaggagtggaattactgggtcatattctaattctatgttaattttttgaggatctgacagttttactcttttagcctgttttacccactcttgctagcaatgagtactattcttaaaaaaaaaagcattgctaatggggtacatgcaaatatctcatttttgaaaaaaccgtatctcatggatgttgtcatttgcattgctttgattatcagtgaggctgaatatttttctgcttattaataacttatatttctacttttgtaaattgcctcttcagtttttttttttttttgtaaatttaggtcactgacattttgcagagtttatattaatctccaacaaagttaacctgtttatctctgccaaaagtgtgggtcatttttaatgctgacctctgcctgttggtcttgtcaaacagtaacatctaagttctccctggcagaactcaagtccagacttcttaggaactctggattgctgaacagagtaaaagtaagtataagtaagaaatgtaattttggctgactgactgatgaacaaagcaattacatattcattactcctcaatttgtgtcattttcaaagttgataaacatgaaggctaagtcttatctaagttacttggaagaagtgtggaaagttgttatgaatccattcattccgtatattttatcttctccttaggtggtccatgagttggaactttataacacaggatattatttaggcatgttcatgaattcttttgcagtctttcaggtatgttttgcttgctatattgaaaagatattaatattttttactattgcaaaccctttcagaattagtgatcattttgagatgttaaccttttattaaatgtgtcactgaagcgcagtcttatgtaagtataatttgaaatgaaaagataatcatctttccagttttaaaagcaaatggaacaattcaccattggaaaagttaatggaattgacattaaacaaataatttttcctttatgtatatgtatttccatataaatatattttatgtatatatataatatataaatatattttatgtatatatataatatataaatatattttatgtatatatataatatataaatatattttatatatatttccttgactttgaaatggctcttatgcatgagtgtgtgtgtgtatgtgtgtgtgtgtaagactgatgtgtgtatgtgtgtttgagaaagatcaatgtgtatgtgcgtgtgtgtgtttgagagagatcgatatgtgtatgcgtgtgtgtgtgtgtttgagtgagaaagatcgatgggcatgtgcgtgtgtgtgtttgagtgagaaaggttgatgtgtgtgtgcgtgtgtgtgtgtgtttgagtgagagacagaaaggttgaatgtatgtgcatgtgtatacctaagctctcaaaaatgagcacaagtgagtcaggagtttgggagactgccttgataatttagtgagcatttaaacttgtgttttaaaagaaaataaaaattattctttttaggaatgtggactctgggtattgacagatgcaaacctcacgaaggattatattgatggtgtttgtaagtaatacatggcgacatgcttgtatttgtctttcacatgatattcaacattacttatataggtatggatattttttagatgaacatagagattgtgattttcatttttttgttctcttctcccaaaatgtttggagtttaatgtacttagaagtacatctgggccatgacatggaacgttcatctgagctcctgtctagatatttgaagtgaatgctttcctttttctctaggtaattctttgaggtagttatatttttggacatactggaagctgcttttcttctgatttgtatcacaaactgtcctattcttttggaattatttaaaaggagcaacatatttttgaaatatttttgtactccagctttttgatgttcacctagaaaatagcccagatgccatcatgccataaagtattctggtacacacacacacacacacacacagacacagacacacacacacacacagagacatagacacacacgcagacacacacacacacacacacccctcatcaatctgagttcttcctgggcaggattatatctgtacatcctagtttcttgaattgccaaatagagttggctgccaagtaataataagtgtgcttttagaaagacgtcataaaatgttttgactgaaggaaatgtataaatgtataaattagaatggttaaccttagaagggattctcttttctttcaggttaagttatactaacatcatcttgaaaggcttctagaactgtcacagtttctatccctgaattccctgtttctgtcaggtattctgttattccatgctaagcccccgggtctctttgggctggttcttgccccaacaggacacctgatcctctgtcctgaaacttaaaagataattttatagtcttgaagatgttatgaagtcattatgatctctctacattaaagacatgtggtacatttagctttcctcatataaccctctatcctagacaatcttccaagcatgtttttccatttttcagtctcagtttttacccatctttgttcttttttacatattgaatccttcttgatgcccactgtaatacccattctattgccagtaatacttactgtatcctttaccttttctgaaaaccttcttctaccttttcactgtaacagaaggaacctgatactctcactggcacattatgtctctggacacctcaagtgattgacattcattttgtatgtggagtttacaattcattctctccagtgactgtttttctaactactgtcaatgtttatttatagatgacaatgcagaatatgctgagaggtttatggaggaaaatgaaggacatattgtagatattcatgacttttctttgggtagcagtccacatgtccgaaagcattttccagagacttggatttggctagacaccaacatggggtaaaaatttataaagttctttgcccatacatattttgtttagtgtttgttttaaataagctttgcccgctttctaatgtttaagtacaaacatagtgtaactaagaactaagtagaccaaaaggattttttaggaaatgatatttattgaatctaaatacagtttttgataaagccacacataaattatggcaggaaggtctcatcaatgagaagataggcctttttttttttttttaactgaagggtgattttgacttccttgaagtctcatgattcttgttgaagaaaaattgctgggagtacatttgttgtcacaggatgggaagcactcatgattacctcctgtgacccctggcagtgctgctaactgaaccctgctcctcacaaagcattcccaggagtcacagggagaaggggcatgggtggtggaaagaattcagcttggctgataaaccccgtaccacctggcctgataattgagcaggtaaatcatgaaatccacatagtattttatagtcagctgtttaaagatacttgagttaacacatgagtgaaatctcaaggaaacaaataacagcattgacagggatacagagaaaaacttctgcaaatttagagaaaaaattggagttaagtttgaaaatgtgtatttattatctataaaaaatttgtgaaaaaataatgtttattctgaagatgtaaattttgcaggaagattttattagaatatggatcaatatgcagtattatgaccttatgatgacctattctttgaaaagttgggatttactgttttatacttaaaccttttaaatggttttaaattcagatatgtaaacaataggaaaaattgaaattcttccaaaaatagtttagattattttggcttatttcaaaatgtatcagttcttggttttgtgatgtttatatttattatcttgacttcagttacaggatttaccaagaatttgaagtaactgtacctgattctatcacttcttgggtggctactggttttgtgatctctgaggacctgggtcttggactaacaactactccagtggaggtattgtattaaagagctgcttatcagtattacggtgacattaagctaatacagcgtcagctcctcaattttttttttaaatgactgcttataatgtttatcacagtttagagattccttggctttgtcttttggtttttatctgttttatatttaagaatgtgagctatatatagctatataaactgctaaatgtgcaaagtccgtattaagatttgggtagaaaagtttattattgacctgaactaaccatctccaaaggccagaagagagagaaagaaaaagagagagagagaaagaggagaggagagagagagtgagtctttctatttgtcctcttcaagaatgaacagaacttctcaagatgttccctagccaatattccatcatgtcttttggtcaaattgcatcatatattgtttcctaagccagtcactggcaggaggaatataatgaccatgagtggcctgaattttctcatttgaaattgaaatgtaattttgatttacaaaataatcgtattcatgaaaaatacagtgtagattgaaaaatgctttgggtttatatagaaattggaattagattgtaagctcaggccactataaacagacaattcagcaacatgaatgtctgaagggacattcaagaatcattaggaacatggggcaatttttcattgtctggggctgtcctgagtattgcagactgtcacccactaactacctatagcaccttcgagtcatggtgacaatctaagacaccttcacaaatgtgcagataaactctagagggagttactgctgccagcaaaaccactggcctaaactaacccaggtttagctttagatgcaggtgtggggcttggccttttctgtaggacttggccaacaatatcagaattgggtcactgaggaggaagcacatgtattcagatgtcccacacattttctcatctgtatgtaaaaataaatcatatatatgttttagaaataatttccaatttcctctttaaatttagtcaggaagcacatgtattcagatgtcccacactagaacaggggctgttggatttggcagggcttttaaagcagattggtggagtcaatacagcatgaaagaagagcaaattgcttcgggattagacaggctgggttctagttctggctcctctacttgccagcaatatgaatttgtactagttacaaaaatctcaaaaatttaattttcttttctataaactaggagactaacagtaaccttatggggttgtaataaccaaacaaaataatttatgtgaagtgtttggttgctataaggcacttaataaagtatagcaattattatgttaagtaacataaatcaagtcaatttgccgtcattcatttgtgataagttgctgtttgctttctgttgatagcaagttgacatttctagctgaagttaaaagcttcacaggttttataaagattgcatttaattgcataaaatgtgaagaattttgacctgaataaaaatatgtactcgttgtgttctttccagctccaagccttccaaccatttttcatttttttgaatcttccctactctgttatcagaggtgaagaatttgctttggaaataactatattcaattatttgaaagatgccactgaggtaatgtattcaagcttttgttgatcatttacactacaggagaaaatcgaggtagcatgaagggattgggttgtgtagtatctgggcatttgggattctaagcactttatacatttctgggaggctgaaaatagacatgtcttgtcagtgatttcttctgctaattaatgtctaaggatatcattagcatgtctacacattacctccttgaattttcagcataggttttcctcttttgccatgtaagttccttattgtctctgaagcatgcctttctctttcctgcctccctgcattttcccctggttttccccacatctagaatgtgtggccacttctcactgccactctgtgcccactgcagttttgttttttttttttttttgagacatggtcttgctctgttgcccaggctggagtgcagtggcgtgatctcggctcactgcaacttccacctcacaggttcaagtgattctcctgcctcagcctccgagtagctgggattacaagggtgcaccaccacgcccagctaatttttgtgtttttcatagagacagagtgttgccatgttggccaggcgggtcttgatcaagtgatctgcctgccttggcctcccaaagtactggcattacaggcatgagccactgcacccgactgccattctgttatgtttgtagcccccatgtttatattttcaaggattcactattggattcacgtaccttgtatctccttagctagtcatttccctgggaggcaggaattaggttcactgtttgtgttgtgcccacagtatgttaaccaagtgactgatttttcttcccccagaataagtagagatacgtaattaactttattacatggatgaaaatgacatgatatctttaggcactttatatataattttttttaatttaaattttaattttttaagctttttattggcatatttggctgacaaagtgggaagtaaatttttttaattttttaattttactttttaacccagttatcatggtaccatgtaacaagcaaaagatctagagtctaaaggcctggattcaatgtttaatctaccacttaccagcaaatgacttaattgtagtttcctcatctgtaaaatggaaatgataattattacacccacaaaagataccttgagaagcagatgaaaacatcaatgggaaaataattcgtaaaatttaaggcctagataaatgctattattgatgagacttgcaactttgggataatttacaaaagtttacaaccaagatatgcttcaggactaatatctgagttgtactttccttggaataattttttacagagacttcaataaattcaataacatttcatgctgttttcttcaaatttttctaatgagaccagtatgttccaggatgacatagttaaatcaagctagtagtaatatcaatatatgaaatagcctttctgtgcacatccttaccatctaatggcttcagatagtgagagaatttaaagttagtgggaggactagaaatggggctgaagatcgccctttccccatgtatcttgaggttgaggggaaagcatagaaaagaaatgaagtttttcctgatactctttgatactctccttggtcgaatctttgtctcatcttttcgctagtcttgagcctcacagatttgacagtacttaaactggtgataaaagagcactttactgaagagcatctattatacaaaagctttgatttatttttttctttcaggttaaggtaatcattgagaaaagtgacaaatttgatattctaatgacttcaaatgaaataaatgccacaggccaccagcagacccttctggttcccagtgaggatggggcaactgttctttttcccatcaggccaacacatctgggagaaattcctatcacagtcacagctctttcacccactgcttctgatgctgtcacccagatgattttagtaaaggtaaatatttgatgtctgaaagaagtgaaatggaaatacgtaattaaaaaggaagcagaaggttttttctcttggttaaatttgttggcatatctagtaggtcatcttctttacccttctggtaatgcctaatcactttctaatctgtatgtaaaaataaatcatttagaaataattgccaatttcctctttaaatttagtcaggaatgtgactataaagactaacgtctcttttgcagtcatttacatctacagactgtgttacgttgggatcctattaaaacacggccaagtcgatttgtagatttggaattttggaatttttcagtgaaggtaaaagagattttgtagatttttttcagagaagacattctagacagaaagataatgagcatagtggataaacacttgtattctggggtgaggcaaccctgtgtttgaatctcagctctgccaagtgtgattttgaacaaggcatttaatctccccctctttggataataataggaactacctcaaagggtttttttccttacattttcatcttcttctttgtcattttcaaggccagtccatgagatgccttatctaatttaactagaacttactaacagatttgaagtaagaataacaaaatggtacgcgctgtgtcatcagatttaattcatttccatggaaatggtgcctattaagtgtaaatcctgtgaaaaacacgtttcagttaatgaagggtactgtacttagtgagaaaatctaaaaggaaaaattaatcaaagttatggtaattttttgtaatacagactaacaagaaaaactcattctgtgaaatgaatgtattacttgtttaaataaaatatctaatttaaagaaaacaaaataagaaatgataggtgcctatttagccacacacaaacctcagacacaacaggtcagatgtttgtgctcatatctgcgtatagttctctgtaaacatgtgagtagagaccatgttaattgtgttcatttttttcaacaggctgaaggaatagaaaaatcatattcacaatccatcttattagacttgactgacaataggctacagagtaccctgaaaactttgagtttctcatttcctcctaatacagtgactggcagtgaaagagttcagatcactgcaattggtaagaatagagtatatcaccatctattggtttaattgtatatgatcatatatgttgttcttgtaattatagatgtattttcttattgagtcctaataagaagagatggcaaaagtttttaattgggcccaacaactcattataatatgaaggctagcaaattatgtatcctaaaactgttctcaatcttcaatgtgcataagaatcacctgggagtcttgtttaaaagcaaattctggtttagtaggtctggagtggggcctgggaatctgcttttctaacaagctcctaggtgttggtgatactctggcttgtagaccacactttgagtagcaaggcctcactatactgtggctggagggagggttcattcctaagagcagagcttctggcttctgtggctctccaccactggtgaatatcagaatcttctaaggagctctgtaaatacagaaacatctgggttctactctaaacctactaagtcagaatcacttgggctatggcttggtcatgtatatcttaaaaaactttcacaagtgattctgataaccaaaggttgagtactcctccctagggcagttctctgtgcaggatatgagtaacctttacagtaggaagttactcactgacttcggtcgcctctcctagttactttccataacataatagtacttttcaaaaattggcaatttataattgtataaatttatgggatacaaagtgatattatggcttatgaatgcaatgtggaataactaaatcaagctggttgacgtagtcatcacctcaaatacttaactgtttttttttgtgggaagaacatttgaaatttgctgtctgagcattttttttttttgaggcggagtctcgctctgtcgcccaggctggagtgcagtggcgcgaacttggctcactgcaagctctgcttcccaggttcacgccattctcctgccacagcctcccgagtagttgggactacaggcacccgccaccatgcctggctaattttttttttttgtattttttagtagagatggggtttcaccatgttagccaggatggtctccatctcctgacttcatgatccacccgcctcggcctcccaaagtgctgggattacaggcgtgagccaccgcgcccggccttttttttttttttttcctttgatggagtcttgctctgtctcccaggctagagtgcagtggcaggatcttggctcactgcaacctctgcctcttggggttcaagcgagtctcctgcctcagcctcctgagtagctggaattacaggcacgtgccaccacacccagctagtttttgtagttttagtagagatgggcttttgcagtgttggccaggctggtctcgaacccctgacccaaagtgctgggattacaggtgtgagccatggcactcagcctttcttagcaatttggaaatttacaatactcttgttattaactatatttaccatgctaaaagtcctttttttttttttgagatggagtctttctctgtagcccaggctggagtgcagtggtgtgatctcggtttactgcaaccaccgcctactgggtttaagcagttcttataccttggcctcctatgaagatgggactacaggtgtgtgccaccatgcccggctaattttttatattttcattagagacgggatttcaccatgttggccaggctggtctcaaacccctcacctcaggtgatccacccacctcagcctcccaaagtgccaggattacaggcatgagccattgcgcccagcctaaaagtactttttaattagacatagtgtctacacaaatggtgttattaatcagggttctccagagaaacagaaccaataggagatacttacatataaaaggaggtttattatgaggaattggctcatgcaattatggaggctgagaagtcccatgatctgcttttgcaagctggagacccaggaaggctggtagtactcactctgagtccaaaggcctgtgaagcagaggagctgatgatgtaaatcccagtcctaggagaagatgagatgagatgtctgagctcaagtagtgaggcaggaaaaaaagggtgaattcctccttcctcaagcttttgtctattcaggctgtcagtggattggatggtgcccacacacactggggaggacaatctgctggacccagtccaccaattcaaatgctaatgtcatctagaaacaccctcacagacactcagaagcaatgcttaatctaggcaccccttggctcacttaagttgacacacaaaattaaccctcacaaatggtttgtttatatagttgtgctttacaaataactgaagaaaacattttaattaatgacgtctaatagtttgttaggtctttaaggtgttaggacctaaaacacttttttacagttcttttatatttcactggcagatgtaatgcttttttattataacccaaacaaccaatccataggcagaggactttatttggaggcatatatatacatacatacatatatatatatatatatatatatatatatatatatatatacacacacacacatacatatatatatatatatatatatatatataatttttttttggaagaggcagggtttagctatgtttgccccaggctggacttgaacttcttgaacttctgagctcatgtagtcctcctgcatcagccccttgcataactgggactacaggcatgcaccactgtgcctggccaattcttaaaaggaattaaataagctctctatttaggggaataaattctgcttaagcatctcccacagtgttgggatgctgggacatgcactacacatacatacacacacacacacgcacacatatacacagagggaaggagcctggctttttaaatatgtaccatcactccttacacaggaacgattctgtctgtcgtcatggaaataccccgaggcttaatttttatgcttgatgtaaagaacggattttcaagttttatttttacatgttgttttaaagacctattttgtatcccagaatgtacgaattttagcttgcttctttgaactttgatagtctatgttcactttgaatattaaacacatagcctgcagtggtaataatataacctctatttttttctttgtattcacatctaaaatttaagctatactggcacagcttcagtctattcatatgaaacaggttcttttcccttttttttcatattcattttttaggatcacattttcactaggtatttggacttggcttggtataagttttcaaaataaactacatagaaagatactcttatctatacagcttaacaatggcagggccaaaattagaactcagccttcatatttctgaatttttgctactttccctgagttgtggtgttaggatgtgggtagagggtttttaaagcatgtgttttgtttaattttagattactaactttgaatccttttccgaatccttttgatcctgagattaattgaaatacttatatttgttgttactaaacagaacacattggaaaacactacaatcctcattgtttttttaaaaaattatttctcaagttcttgtggtgtattagtaagaaataagaataaaattttgtttgcgtgaagaatactactaataaaatgtttctttcctgtatgagtgatggtgtcttactgatcaattctgtacatttttttaaagatttttaaaaaaattattttttgcctaatttatgccacatgcttaactgagctaaaaatgtcctctttcatcacatgacctacaagttcagtaccagagcattgttatttttttgaccagtcttcctaaaagcttggtgtaaagttccaactctgttccaagcagtggaataatgatattgcttcaatgacagaggtcttctgtactcagtggaagtctctttgccaccagcaggtcgttgttactgagtatttactgaatgaactgcatgtcttgtgcttccaggagatgttcttggtccttccatcaatggcttagcctcattgattcggatgccttatggctgtggtgaacagaacatgataaattttgctccaaatatttacattttggattatctgactaaaaagaaacaactgacagataatttgaaagaaaaagctctttcatttatgaggcaaggtaagcattttagagacctacatttgttcgtagaaaaaaatttgtttttttcaggtagggttcattctagaccatatttcaaaatagatggattttgtcttaggtaagtgatgggctacacggtgttgacatgtgcaggaagtgcaaacaatggaaagctgttacaattcttcctttagctaactattcactcactgctgctaagatgtttgttagtaatggcttaagagttagtttctggtgggagggcttgtattatactaagggatctgaaatttaaaactctttaaaaatctagaggaatactcattcattttattacacatttgtggagtgtttcttagtgccaggatcagttttcgtgccaagaaaacagagggagccagggcctctcttcttaaagaattcgctgctcaatggagaagatggtttgtatgtaaacagacgcagtgccgtgtggtggggaccttctcagtgcatttaaaatgatgaggaggacctgctggaccctgaggaaatgtcatgctagtgaagactgtatcttgacaccttgaaaggtggaaactgttcacaggcaccagatcctttgttttggcaacttgttaataacagcagctaacatgagttgagtgtgcactgtgtggcaggcagtgttctaaacactttacatctcatacctcattggaggctcaccattagtattagcatgatcctgtttttttgcagatgaggaagctgaggtgcagaaaagttagctaacttgcccagggtcatatagtcatacagagcttggatttggactctgagcctatgctcttgacatccatacctaggaggaaacaaagagatgtgagacacgtttgatgttaatagtaaagtaaatttgattttctgaaatactccaaaagcttaccaaagttacagtctcagttttgtatttccttattagtggacctctagcacaaactctctgtggctgagtttttctctctgcacaatttgtatgatatatcccgtccatcaaattcatgaggattagaagggttcacacaaactgattaaaaatgaggattcactataatctaagagaaatatagttcaacgctttccaactcctaatttttttagtttttgtttttttataacaaatggattaaatgaaaagtaggggcaagctattaattgattgctaatttctccataggagaattagaaaactcagtaaagacgccattgtaatgtgagcttttcttccaggttccattattgtgtagagacctttttattctaaaataattctatgtaatgacagtaataacaactaaatctgtttaaatgttttatgcatgtttcatttaattctcacaaaaactctaggagcaggtgtcctattattatttccattttatagatgaggaaattgaggcacagagaggttaaagaatttacccatggtggtctggttccaccgtccaccttgttcctcagaacactatgggataattctgatttgcagtgttctctggtttttagaagcaatgggatatgatggaaaggaccaggaatcgggacgggatgcttgagtatcaccaccgtgtaagaagtctcactggaggttttgataaaatattaagggaggaacatggggtcctgtagagaaggaggcaccaaaggttagaatatggggtgtcagattagactgaagtaagctgtaaggtgttgggtttaagtagatgagctggagtcagtgtctgaagatctccctgggataggatggcacagacaaaggctgaatgggagtcaaggggttgcgggtcaggaacaatgcagtgtatgagatcacaaaccaagggagaccagcgtttagaatcagggctgagtgtggcctgagttctgatgtggggaaggacatagtggtatattttcccttagattagggccagaccatgcagacactatgaccggccctgaaatgcaccaggtggttaggtcctctgggatatttgtagagatccagcagttggaatttcctgtatagagttgcccatgtaaaattatccctgtttatacacatttgtggattggtcgtgttttaaatatatacgtacaagaataacctttgtcaaattttattataattaaatttaagtggtaccaagtggtctctgtggtatattgtgtgccatgctaaacacaaatgagatctttacacattggcataatggctgtaattaaggagataagtaaaaattatttgggattgtcatgaatgaacgttgtaccttttgaaaacaagattccaatttgtattcaagatttagtttttctggtttgaagtagaaactacataggaattagactggtgctttataatttggcatacattctttgggatagtttaatacaataaggtaaaatatttcagaaaatgccacatataactccatatttacatatgctttatgaactgtaactctggctaatcaaatattaatgctttaaacagaaagcataaattttacatagcttgaaacatgtaagcagtgaaaactcattccttaaaaataatttcagtgtgtgtcctagatacttttgctgtggatcagcagccatcctacaaaatgaatggtccaaatcctcagtatctgttgttttcccaaagcagtgctagtccctcaggtcagtcctggccaggtaggtggccaaactgtagtttttcaaagtaacccagaaagggtctctactgattgcctgagatccctcctcacatctgttggttgttagaaggtacagtggccagagtgcaaaaaaagcatcgttctctaaatgccaagcagtcctcccaagtgttaagaatgccgagcgctacagctgtaagtaggcgagtttccccttgggaggaagtagatcaggggcatagcactggctgtggaggcagtcacacctgggcttgagtcctggctcccaccttggaacaggttcttagtgtctccaaggcttggtttttttacctggaagacagggataataaaagaacccacttagtagggttgtttttaggagtcagtgagaataaaagaacccacgtggtagggttgttttgaggagtcagtgagatatgtcagcattttattcaacacgtagtaagtgcacaacaaatatcagctatagtagaattagttgcctctaactagggagttagaggttaatgtcagtgaataaatcctgtccattctccctctaaaaacctgtatgaaattcttctatttctctccatcccactgctaattgttccattcaagcatgattgctcactggactactccaatggcttcctgactagtctttttctgtgttccctccccttcagtacattctccatataatgtaaaagggatcttagaaaatgtcaagatcctgtcacttgcttgcttatgatcctgcagtgggctcccggcttcagcctacagggtcctgggtgatctggcttggcctccctccttagcctcatctggagctggctgtatctggaacactctgagctccatgctgcttcagggacatgatgctttcccttccttctcctggcatgctttctccctaggtctttccatggctgctccttttcatcattcagttgatgtttgcctcagagtggccttccctgaccacttagtaactccaatttgtactactccattttatttcttcacttaacattatttaaaattatcctgtccatcatctgtcctggcatttagagggggagctctgtgacagtggggaccatgtttgaccttcattgtatagctatgtgggcatctcaataaatccagaatgggcgaataacttattaccaatattaacttttttggactttaggtccatcatcctaatgtggatattgggtccagaagatctctgaagcgcccccacagtgtagcatgatgatctctgggcactaatgggtcgacctggccttggcattctcttagcagctaagaaatgtgaccagtgatttccatgtgctactctttttgctggtgaagtggctggtgaaagtcagcacagtggagctccccaaaaatacatcatctcacatgctgaactaaattatatttcaaagtagtggacgaaagcttcttggtataatgcttttcattatgaaatcagtgtctcatttcagagactctcttttttcttttgccatcacatttgccaaagtcctttaaatatactgtagttgtttttattttttaagaaattaaagtggcttcagcgtgagtcatgattatattatttaaatgtcatttatgaacagcgcattgttttacttaaatcatgcttggcccaggagttctgtaacctaacccattattttgttggtcgaaacaacagctacatcattgaatgaagtgtctttgctgtcaaaaaggaaaatggaaccataacatgaaaactgtttttgataaggactggaaatccagaacctgttaattgaagatttaaaccatttgttttcctcagatatttaaatcacagtgcctgcagttcaactttttaaagtgagactcaaaccaagtctaattgaaaacactatatttcctccattgaaataaaaataagagaaagaaagcttcagaattcggatgttgccattggtcacaagtatggctagtggccatagcttaaaaaactgtgatgttctcactttccatttcatgtcatagaaagtaaacaaattcataatgatttcttttaatacagagaattttttttatcagcttattaccagagaaaattcttgaaatagtcacaaatagccgactttacttcctttatttacatgtaattttgacacgaggtaaatcaagtcaaactatgtttagaatgttactttttcattgtttgtgagcagtatttttatctttattataataaattttgaaattttacattcatggttatcccaaagaaaattcataacccagaacaggatgtgtcttatctggccctttatgaagggctcatgggtttttatcttaagagcctctggacttcttctgcatttcaattttcagaagtctatgaaagttctgagcatatgattacttttcaaactcaagagccattcctaaaatgattaacttaaaggtgatactcttatttcttcataaacttttggagagagctatgtttttgcttttctcgtctgttgtgatgcagagtctccaacttagatgactgcactggaaggctgagttgttgtattaacaacaaacattatagacgagtcatcagtgtcctgtttttttttttttcttttttttgtgatggagtcttgctctgtcatccagtctggagtacagtggtacgatcttggctcactgcaacctccgcctcccaggttcaagcgattctcctgcttcagcctcccgagtagctgggactacaggtgtgtgccaccacacctggctaatttttgtatttttagtagagacgggactttgccgtattagccaggctggtttcaaactcctgtcctcaggtaatccacccgccttggcctcccaaagtgctgggattataggcatgagccactgtgcctggacctgttttgtttatgggatggaaattaggcctgatacactgggacgatttggaggacagtcgagggatccacaatgatgcatgctggtttaagatgaggaaggaaacctcacaggacactcccacaaggagacatacaagttctctccaggttgtgaatttctcccttacttttccatgggagcagagctggtggtttggattctcggtgttatctaagcctgctcaagaaattcactgcaaaactggtgattgtctgtggcctcttctctgggctggctgcctctagtggaagaatggtgctagttgttgatattaatggggaatgttggaggtcagccacctgaggggtaatttccataagcactgatctcatctccatgatctcatctctgaccagtttcacaatatctcatacttggaactgccgttgttgatgtgatctgggggtgtggaggcacatggtcctctccttgaggttggtctttctgtcacaaaagtacctcaaacttttgtgtagggattgagggcctcaaacctattttcttttttcttcttccctctcctctccttctcctctcttctttccttttcctcttttttcttaggttgaattcatagttaaactctggctatctggagaatttagtccttaattaaaaattgagggagaatgtcctggactctcttgctgatttcttttgtgaacattaattattttgcttctctgtgatccctggctgcctctgaaaaatgagataatatactgcatttttaaaggttatgtgaaaactaaaacatgataaaatgaactagagtagtgataatgcctatcatttaattttttccacttttgtttatgttttgaacatgtagaacattaacatgcttccaaaagacaaacttattttgagacatatattcaaaagagtgtctcttcttccccttttctttctccctacctctcattggtaactatatcaggcggttcttgcattactataaagaaatacccgagtctgggtaatttataaggaaagaggtttaattggctcatgattctgcaggctgtgcaggaagcatagcgccggcatttccccctaggaaggtctcaggaagcttacagttgtggcagaaggtgaactgggaacaggcacatcacatggtgaaaacaaggacaagagagacagtgttgtggggaggtgccacacacttttaaatgaccagatcttacagtaactcactcactatctcaaggacagcaccaagatccagtcacctcccactgggccttacctccaacattgaggattataattgaacatgagatttgtgtggggacaaatataccagtaacctacttcattagtttctagactatcttttctctctctccttttgcgaaaataaatgtatacatatatgttttctcatttccccccgcaattttttttttttttttaaagacagggtgtctccctttgcccaggctgaagtgcagtggcacaatcatggttcactgcagccttgacttactgggctcaggtgattctcccacttcagccttctgaacaggtgggactacaggcacatgccaccatgctaattttttttttgtatttttgtagagacaggcttttgtcatattgcccaggctggtctcaaactcctaggctcaagtgatccactcgccttggcctcccaaagtgctgaaccttggcaataggtgaaccttggcgcctcgcctcatttcccctttttattacacagaagatagtatatctatatgtactattttacactttgcctttttcacttaacagtgtatccaggaaattactctgcatcagttgaccgagatattcctcattctttttttcacagctgcatagtactctgtcatgtgtgtgtaccatagtttattcaatcagtctccagttttggggcactaagattgtttccattatgttacaattacagatgatgctgtaatgaataatcttctgcgtatatatttttgtattgttggaggtgtgtcttcagggtagattcctagaactgggattactgggtcagagggtaaagacattcccctacatggtagttgtaaccttctgaattccctctagcagtggatcagtgctggtttccatacagctcacccaacagaaggagtggtcagacttttgaatcttaatgctaatctgatgggagagaaatggtatctcagtgtaggtttaatttgagtttctcctgttatgaagttgaatgtgttttctatattaagatttgtttttatatttttgtcttttgtgacttatctgttttgccttttattcacttatttttatagggctttttatcctttaccctaatttttaaaaagttctttatatatgtatatacatgtaagtaataacatataaacatacataaaaattacataatattgatattagctatttatccatcttatatgttgcaaatatggtcttaatttatttgttaagccttgcttatagtgtgttttgccttggaatagtttaaaaactttaaaaaaatagtcaaatgcatcaatttttttattttattgcatctggtgcttagagagccttcctctacacctatattagagagtaatgcctattgtttgttgagagctttccatgtaaaaggtacttactgaagtcttttcttcttttatcatgtttaataattggaagagctctgtgatttactaggagacagtggccttggagccagtgagaagttggctaatgcccaacttcactccctgttagctgtgtgaccatgcacatggtatctgtatccgctgagtttcagtctcattatctgtgaaaaagggaataataatagcatctatgtcagagggtccttgtgagaattacctgagttaatcctgcaaaggactttgaacagttcctgacatctaatgagtgctgaatgaaagttggctaattactgcaccgtaataattcaattagaaacataaaggtataatctaatgttcccttcttcaaattaagcaaagttttgtcatcactttaaatgtttatatttcttttaccataagtcttaaatatcaccatgaaacagagtatcttgttttctttttttctttatgcattttgttttattgtaacttaaatcagatacttaaatctagggtttcttttggaaagactcagggagaagtttgggacttgaaggtgagaacacattaactgtaatttcaaaccattaatgcttatgtttagttagtcaaatatgaattttacttatagttctggatgcttctaaaatatggtatttataaagtcaaatttgtttattactgcagtttactggggaaggatttcaacatttcacaaatgagtatggttgccaagctttgccatgtctgtgctgcaaagctcaggctgtgtgcccttacctgctaatagtggaattgtgtaatttttagaaggatttttggctatcagagagtcattgataatgccttgagctggaaatgttcctgctaatggttgcttttttagtgataagttattgctatcttaactttatttttagcaagttagtttattgtgggttgtttggtgaatcctttagagtttggcctatgttttctcacactggactttgagatctgtatgcattgctttgcaaatatgaaacatctgctttttatttgcaatcatttatttgtaactatttgcaaatatgacacatttgcttttattaatgcagatacgtgagccttaaccccctacctaatttacttctgtaatgatacttcattgccaccactgagcatgtgtatatgtgtgtgtgtgtgtgtgtgtgtgtgtgtgtgtatatatatatatatatttttttttttttttttttttttagtggaaacatggaattggtgggtaggcaggcaagttggttttttggtttacctcagttggccatggccccaaaatttaagagccaccgttttagattattttgcatttcctcctctgtattgctggtctaagaatagaaaatacttttattttctactttggccttaaacttaaattaatgataccctacatagtatttttcttctgtagcaaacagtgctagatgactaagcattgaaacaattttgatgaacactagacagttaaataaaagtctgcctttaatttgcttgcttttgaatggctagaagcatcatctatgccatagtgatcttttaatttactttaatttgggatatcacaggcttttttttttttttttgagatggaattttatttgctcttgttgcctaggctggagtgcaatgacgcaaatctcggctcactgcaacctctgcttcctgggttcaagcgattctcctgcctcagcctcccgagtagctgggattacaggcatgtgccaccatgcccggctactttttgtatttttaatagagatggggtttcaccatgttggtcaagctggtctcgaagtcctgacttcaggcaatccacctgcttcggcctcccaaagcgctgggattataggtgtgagccactgcacccggctgggatatcacagtttttattttatgcattctgcttgaaaagtcctggcattttaaatttccaacagcacttaaaatagaaagtactcaatattagctcttggtttgatttcttctttccccctctctgcccatatttcctcaatatgaagtcataattagaaactttcatccattgcaagttaatgattactttgactatctgtctatttttgtgtctaggttaccagagagaacttctctatcagagggaagatggctctttcagtgcttttgggaattatgacccttctgggagcacttggtaagtgtttttgccaactgaacaaatccgtgtcatggaatgggctttcactaggtcacaatagccacgaaattgacagatatatctctatatattatagactgggaggttgctttttccttagtctggctttaaaaagagattttctttttaaagtattattttcaaacattaacaaatcaaatgtttttatttagaaaagataagttataaatcctcttttttgtgtgtgtgtgtgtgtggaagaaacagaaataaaaatactttatgatgatggtgcagctgataaaatcagttagaaatgccgggtgattgtgacacagcttttttcttaatcttccatgactaatacaagtgttgtgttactgcggtcaatgtagtttaagtttgtgtgtgtgtgtgtgtgtgtgtaaaaaacaaacactgatggaattaagtatgaacagccagtttcctccagactggaatctctatgtggctgattttggatgattaatctctcttcttgtacttatcttcaatttcctattttactcagaaaaagattgactcactgtatcaatcaggatagactaggagtgctgtggtaacaaccaacctactcaatctaagcaattaacaatgaagggatttcttgttcatgctgcctttccattgtggtcagcagggggctctgcagctgccaacgtgtccacgtctccaaaaggaggctccaggtttgccacagcccggaaagaggaggctggagtctatagcactggcaattagagacttcatcctgagtgtatcatttctactcattttatccttctcagagctggtcacatggctatgcctaacctcactggggcaggaaagtgaattcctctgtgtaaccaaagtaaaagagaactgtatattattgaatatcagtaatgtttaccacatgaaactttatataacatgaaacagatctgcttcaaattttctcttggccttggcctgactcaggatatagaaccataaatagaaagctttcagtgttgtattgcttgatgttctttttacctcagtatagtgttttgtagcagggactggcaaacttttctgtaaagggtcagattgtaagtatttcaggcattttgggccacgtagagtctccgttgcatgctcttccctcttcctccctctcctccctctttctttcctgtctttgtctttttcttttccttcttttaaaacccgctcttaggtggtggtgttggcaggtgggggctgggttggtgcacacataaacaggccctgggctgtatttggcttgagggccagatttgggccaggcagatttggcccacaggctgcagttggctaactcccattctataggagagaaaaatatcattttccccacctgaagtactacagtttgcttgtgaactatgtatgcattcttcacccacagctttggggctgactgaagcgtgttggagctcttctttggtaaatatctagaacagtccaaagatgaataaccttggacaatttatttaactctcttggactgtcagattctcagtctacaaaataatggagctggattcaacagacacattaaaaaatgctcatcatcactggccatcagagaaatgtaaatcaaaaccacaatgagataccatctcacaccagttagaatggcgatcattataaaggcaggaaacaacaggtgctggagaagttgtggagagataggaatacttttacactgttggtgggaccataaactagttcaaccattgtggaagacagtgtggtgattcctcaaggatctagaactagaaataccatttgacccagctgtggggaaaagaaagagagatcagattgttaccgtgtctgtgtagaaagaagtagacataggagactccattttgttctgtactaagaaaaattcttctgccttgagatgctgttaatctgtaaccttacccccaaccctgagctctctgaaacatgtgctgtgtcaactcagggttaaagaattaagtgctgtgctttagatatgcatacacataaacatctcaatgccttaaagagcagtattgctgcccgcatgtcccacctccagccctaaggcaggtttcccctatctcagtagatggaacatacaatcggattttataccgagacattccattgcccagggacgggcaggagacagatgccttcctcttatctcaactgcaaagaggtgttccttctgcttatactaatcctcctcagcacagaccctttacgggtgttgggctgggggacggtcaggtctttcccttcccacgaggccacatttcagactatcacatggggagaaaccttggacaatacctggctttcctaggcagaggtccctgcagccttccgcagtgtttgtgtccctgggtacttgagattagggagtggtgatgactcttaacgagcatgctgccttcaagcatctgtttaacaaggcacatcttacacagcccttaatccatttaaccctgagttgacacagcacatgtttcagagggcacggggttgggggtaaggttacagattaacagcatctcaaggcagaagaatttttcttagtacagaacaaaatggagtctcctatgtctacttctttctacacagacacagcaacaatctgatctctctttcttttccccacacccagccatcccattactgggtatatacccaaaggattataaatcatgctgctataaagacacatgcacacgtatgtttattgcggcactattcacaatagcaaagacttggaaccagcccaaatgtccatcaatgatagactggattaagaaaatgtggcacatatacaccatggaatactatgcagccataaaaaaggatgagttcatgtcctttgtagggacatggatgaagctggaaaccatcattctcagcaaactatcgcaaggacaaaaaaccaaacaccacatgttctcactcataggtggaaattgaacaatgagaacacttggacacaggaaggggaacattacacaccgggacctgttgtggggtggggggatgggggagggatagcattaggagacatacctaatgtaaatgacgcgttaatgggtgcagcacaccaacatggcacatgtacacatatgtaacaaacctgcacgttgtgcacatgtaccctagaacttaaagtataataaataaaaataaaataaaataaaattaaattaaaaaatggagctggattagatcatttctaaattccttttcaaatctgagatttttgagtcaacatggaatttcttggccaagcccaagtggaaaccagttctgcctgctagagagagttgcttaccttgtccctttgctctttcttttttgatttttttctttccttgttccatcttcagtgattccccctttgatgaatcttctgatgggggaaaaagtgttgttgttttgcttgctcggtgttatttggtggaccttataaagtgtattttatgtaatttttttctcttttcataaaggttgtcagcttttgttttaagatgtttccttgaagccgatccttacatagatattgatcagaatgtgttacacagaacatacacttggcttaaaggacatcagaaatccaacggtgaattttgggatccaggaagagtgattcatagtgagcttcaaggtggcaataaaagtccagtaacacttacagcctatattgtaacttctctcctgggatatagaaagtatcaggtatttcgtatttaatttaataaatgatagatgggaaattcaaggaaggtaggtcttaatgggtcaaatatgtgtgtggaaacttaacaagttgcagctttacaacacatgtgaaatctgaatttgagtactcttttgctttgcatttgtggccatgttccaaaatctgagaataaaacattaacccactctttcagaataactaagagaattctaaaaatgctttttaatgtatgtattgtacttgctattggtaagataagtcaatacatgttttatcattgaaaaagttaatttctgaggggaaagaaaattatttaaaatttgacaatgtgttctagcaagtttagattgcaaaggattttttacttataaaacatcatggaacagttacaatatctgttaatttagtgctgagaacacccataccctgaaaagtgtgttgaatgggcatggatgcctggatgagaatgagtatgcgtggaaaggtatgctgacgagcttaagtttgctccagagctgtcctggtgattgatgcctttactgcttactgcctgctgcattttatgagatcaccaaagtcattctctttattaggacccccactattttcctattctactagtaggcatgtagaagctaaacttttcctgaacttagggccgcactaccagagatcaaatataagaaatatatttctcaagcagtttgctgttcttatctgagtctgtgatactgagtgggagaaacactggcaaaagctctacttttttcttctagggaatgacacctgtttacttataaaaactgaaaaacagtattattttcaaaatgcatggcaaatctttaaatgtcaatgatcatggttgattttcattgcctagtacaaggtcaggtacttcatagacactgaacttattttttaaatgcatgtttcaaagtactttttgtttcagtatgtggtaatgggttactctgaatagtaaaaaacatactttttttcttccaagcctaacattgatgtgcaagagtctatccattttttggagtctgaattcagtagaggaatttcagacaattatactctagcccttataacttatgcattgtcatcagtggggagtcctaaagcgaaggaagctttgaatatgctgacttggagagcagaacaagaaggtaatgtgctgggcccacttgaggttgttatgctttatgaaatatataacttacatgagaaaaatttttagccaggtttgaaattgattacatctgcatcttttggtgaaaagtaaaacacataatgagatcaggatgggcctgacatggccacaatgcttctggtctccccagggtttttttaacagaatttcagggctcagatgtctctttattttagatatgtgatgccctatgtcagttaccctttgagtgtctgataccatttctggtttggcagccttgtagtttgctaagaccttgggttctggagagacaggttaaatcctggttctgcaacttacctttatgaggttcagttttcccaactgtaaagtggaaatggcacctattttagagtggctgtgaggattaaatgagataatgtgcaatgctgctgcatagcaaatgctcaaaaataggaactaaaatgctaattaaaagaaatgtgaataccaaaaaatgctgctagtaagtggattatgtgtattttatatacaaagtggacagggatccaggtgtgtgtgtgtgtgtgtgtgtgtgtgtgtgtgtgtgtgtaagaaagagagagatggaagtgggtgggcagaaataagataatgtccagtgattcaaatttctgttaattcaagaagggataattgtagaaagtgtttagaggcttctgagactgtaaaaaatattgtattaacagtaacttagattgaatccttgttacctattccaaagctggggactagaagattattgcttagaggctgaagcagtctttgacattttttcttcttgtctgcttggctaagtggtagttatttaatattccacctaagtgtagtcatcatctaaatagtaatatttgagagagggcaccaagtaggatggtcctctggggactagagcagaattatctctaggaaggttgttgagttagctggggatcctaattttttttcctgggggcttgaacctcaaactgttaacaccaaccttcagataatgaaaatgggagagtccagaatattagagctagttaatggcagattcccagaataggattcttttcaatgtgtcttaaaatattttggggatggcctggtcagataagtaacgtgcattatcttctgaaatatattattttttccttttatttatagctatttagtcttgagccaaatatagggaatttctcataggaaaactattttcatcaaaacatcctcaaatgtaggcaatgggaaaaggatgaaaatttacaagtatataggttgagcatccctaatccaaaaatctgaaatccaaaatgctccaatgagcatttcctttgagtatcatgtcagtgctcaaaaagtttcagatttttgagcatttcagattttggaatgtatgtatgctgtaaatattccaaaaattcaaacaaaacagaaattggacacacttctggccccaagctttttggataagatatacttaacttgtaatagtttaaaaaagcaacatataggcacatgtatacatatgtatgtgtgtgtgtgtttgtgataaataaatacatgtctggcataaataaatacatgtatacaagtatatattttttatgctagttaagtacaacttggaccagagtaggaatatttaatggtataaaatgtaatttttctggataattgatcagaatgttattacttttctcttgcaggtggcatgcaattctgggtgtcatcagagtccaaactttctgactcctggcagccacgctccctggatattgaagttgcagcctatgcactgctctcacacttcttacaatttcagacttctgagggaatcccaattatgaggtggctaagcaggcaaagaaatagcttgggtggttttgcatctactcaggtgagagatgatagttttttccctttaaactataatatataatatagatttatttattatatatattttatatataatatatagtatatattatataaatcatatgttatatataaaaaatatttttaaaagtatgtggttgcattttttccttgatttcataaaattacttggcagtttcaaagtttagtaacttaagcaaaaggctaaattgattaattttaatttttttctcctcattactatgaatttcatgtctgatatttatatggaataaatcagttccccatctgccacttttcatctgtggtaactgatataagagtagatgttcagttccatatagcaaatattttctattttcttttcttctttttggaaaggaaaaactgaaacttttaatttactgataatatgatcatttatgagcaaaattcagtgggatctacagaaatgctactaggattaacaagtgaatttagtaacattgtggtataaaaaaatcattgtacagaaatccattgtatctatatataagcaatggaaatgcaaatcaaaatagcataacatgtgaactgtttagggattaatctgacaaaaatcaataagatctatacactaaaaactataaaacatttcagcaaacattttctgagcctctcctgtactctaggccaaggacattcaaatatgaatcagggagcattccactctgaaggaaggtgtatgaatatccagcaacaaaatactactaaatttactctttgaagaccttgatatatacttatatgtacaaatgtttttcttccctcaacaggataccactgtggctttaaaggctctgtctgaatttgcagccctaatgaatacagaaaggacaaatatccaagtgaccgtgacggggcctagctcaccaagtcctgtaaagtttctgattgacacacacaaccgcttactccttcagacagcagaggtgtgggcaaggggcagttatttaaaaatcagtgtagacaattctttatgctggaatactgctttatttgtaatctgttgatttcaacaaagacttgtttccagagctctgtagagtaatagggagaagtggtgcccttctttggctgaatttgctgagctctggaagggtggggaactttggaaagattggtggaacaggagaaaacacgggcactgtaacattgggaaaggaatgaacatagaaacctgttgagtttctattcttcataggcactgtgctagattactttacgtatgctattgcatttacttctcaaagtaactctaagaagtaagtacatctatccccatcatacatatgataaaactgaggctgagagaggttaagtgacttgctcaagatcatgttactagtaacagtagagctaggatttgaactcatcattccaaagaccatgttcttttcagctgctccacatgtcttcttaggagaattgatagaaccggtagtagaattcttactttaactggaataaaagaatatgctagttcttaactttattcccttgatcagttttgtgggaggttaagtacaatggatgaaggtgataacttcaattctggaaagtgatgaagagtggtgatgataaaggaaaagaaagaataaagttaggcacagtcatagacaatgtgttattgtgttcctgggagagccaggggattaggccctgattaagggaggtcaggggagggagatgactttagtttcttgtcttttatgcttcagccccaacaggaggacagacttgtcagtagcactaatgtgccctcccatgggcagaggtgagggagcttggggagtgtgcacttttcctttcatcaccttgcttacctatttgacccatagcttttgatatgtgagacagtgcaaagctcttagtgctgtcagtgattgcttcttttcctaatgagggataggactgatctgttttgctacttggaaggatctagatatggaaaattagcctcattcactttttttcaccttgattcagcttgctgtggtacagccaacggcagttaatatttccgcaaatggttttggatttgctatttgtcaggtatgtaacgatgcttatttttttaagttaaatatgactttttataataattatttggtttggggctttattaaatcttagataacttgaatataattcctaatgatttacatctgtgacttaagcaagatatatcactgtctttaataaaaagtattagagatgttgccagccaatgagtagagagcaattatatagattgattttctgtttgaaaagtatttcttggagattatttgctttttgaagtgagggttaatgtcctccaatatgattcctgataacaaatacatgttttacttataatttcttaatattcatctgagaatatagaagtcaacatggtagaattattgacttgaggggaggaattgtgtccctttaatgtaaaatcttatataatagtaaatataacaattaaagcataattatgctcaatcctctggtacagaaagaaaatataaagaaatctacatttttatagtgcagcaggagctacaataaaatggaagtagtatgaaaaatactgaataagataatcatcacactaaatagcacataaaaatattgaggactttaagatcatctcattagaacccaaagataatttgtgataggaccaaaaatggttgtgtgcttgggtagaaacaaacgaccaaacaaaaacactgaaacacttactgagaaagtaaaaaaatggctattatggagaaaaagtacttttttcaaaaaccagaacaaccattctagtagagagaacaggtatacttgctgagtagggcgggtataccttgctaagcaggtataatttagaaacttccaaataattctaagattattttgcattattctcagaatacagtaaacattttttaaaactaaaggaaaaatgatcacaatgaaaaggaatggtattcagtgaaaaggtcagaaagagaaagtaaacaatttatttcgatctttactaacaaagaccatgggaaaattctcattctcaagctgtcttgcaatccaagagtaaatccagaagtaaatatgctgtgtattctagataaaattgaaaaattatatgtacttaaatcaccaagttggttggaattcatttttgataaaccaaatgtagagaaattagtgaaaccaagtgattttttacttgaggcttgaagcacacaggggtaaatgtggtacctgttggtcagaatgttcatcaatcccatgttggtctcaaaatgcagaaaacaaaaggaagggactagtaggcacctctcatgagggaggaaaaaaattacaaagaagttggtcactcagaaatgggtattgagatttcttacagttgatatttttataagtgctctggaacaaggaaggcaaagaaaactcatgagtttgcagtaaatattaccctcttttgggtaataaaatactaaactgttggaaataaactgcaagatcttttgaagttccctgagtgagcagttgagctttattgccaaatgtaaaccctaatacttagttatggatgggcattaattatgacccaagagacagagtagtccttgtttgtttcctgatagcattggtctctaaagggacaattgcatgccaccgaaaggggaatgatggaaataatagaaagcatttctccaattttatgggactgttcttcagctgcttcaggaatactctataatttaatcattatactttaagaaagagttgacaaatgtccaaagtaagataaccagaaggatcgagtggatgaaggattatatcagtttggattgtggcagaataagaagattgcaacttttagatttgaaaaatgaaggcttagaggatttttttaagtatgcaaatccatgaggggtattagatgttagttctgaggggtgtgtgtgtatgtgtgtgcacgtgtgcatatgtgtatgtgttttaggtataagttaaaagaaaacacaaccttacaaagcaacagtaagctttatgaaccttgttataaaaaaggggatgaggtaaaacatttaaatagattccagtccatctggagatgagattggactaggaagttttgagtacattcctaagcttctgatttaggatccctttgagaaagacacgggtcctcaggctctcccagtgtgtctacggcacctttaacatcagtggtgggtacagagtagatgctgagaaagacccagttgacttgaaagctatcatttattttatcatctttgacaaacattgtatgaacaaaaataatcctcagcaatgttcaactaaggctcttcaatgttttagttttgatttatcctactgagagtttttgaagttctagttagagaaaaatgactccatttgggcaacaggccttagaaattagtgaatgctgtcaagaaagttttttcctcaagggaatgtttgccctctttggcaaaccagtatccccaaatatcacccatagtgttttattgtacttgttttggaatattacttaacagttttctccatttaaacataattttataaattttaatactatttgttaatagtgatactttgtgagcaagttaaattaatttttttctagtttgaagattaaaaatcttactgggtccatccaaagagaatcattacctaatacagtatttagaaggcaaaatgatggaaatttatgtccaacttgttatttatgctagtttattttttacagctcaatgttgtatataatgtgaaggcttctgggtcttctagaagacgaagatctatccaaaatcaagaagcctttgatttagatgttgctgtaaaagaaaataaagatgatctcaatcatgtggatttgaatgtgtgtacaaggtaagtgtctgcttaggtctctcttctttttttcctttaaaaaatagacttgaaggtttaattatgtatagttgtctatatcaatctaagagttatattgaacaaagaattcagttatgcactacacttcagattacaaactagaaatactactaattatattcaagcatttattagatgcatacaaaaattatttacaagttttccctggacgtataacacatttgaatagaacagtgtatatataaattaataaaactcaggtctaatttaggaaaactttaaattaagtcaatcatatttaatacttcaaaaatggttatttcttgttatgagttatttttctgtagaaataattatttcgggttcatattgaaccttaactgttaggcatttaacccaaaactttatgataacatgcaaattcaatcaagaggatagtttttttttaggtacattgaaaatattccagtttaggagtttctcatcttggataattagacacttaacagctgaagcttctgggagtactttttaagttgactcttaaattgttctatatccaaagcatctgagaatcttgttaataaggaaaaagggttctacctcaaccctaccgacttcacagtaagactgggaagctgcagatttttggtcattccactgcacacaggagtttgagcacactccttgtgaaagttcttgaatagaggcttcacttttttttctttcatgaatctattctcttacatctgcattatttggtattgagctgggacttaaagatgcactggcattgaggagctgctgtttgctcttctaaaatatcccatagtgtcctggtttaacttagcttattgttgggctagaagtccctgatgtggtcctgagctggcagatgttcttcaaggtcatctctgggtgttcatccaggtggccagccttcacagctattgcctggacccagtctccgccattactgctactgtctgtctttatctttggaccttcttgttcatgattttggggtaaaatgtcccacatttgtcccattcttcaccttcttgggcattttgggccagcagcaaggggatatcagaatctctgtgttggcatccttttcagctgagaaaaaagtaggactccaattattttttacgaatcttccaattggtctctgttatagaataacaacttcaagttattactattattataaacaataacaacctacagtaattacaaacttatatgccaggcacggcaccaaacacttttacatgcatatcatttaattcttacaggaactctgtaaagtatgtgttattattatccctgcttttctcaaattcctggcctcaagtgatcctcctgcgttggcctcccaaagtgctgggcttacaggcatgagccactgtgccccacctattcttgcttttctcattcatttatttattacctcagcaagtattgcttgagtctctactatgtgccaggcatggtgtctgtgtgtcaggcgtgggaatataattgtaagccaaaaaagatgcaagctctgccttgtggaacttgctgtttgagggggatacagaaattaatggaaacaatcccctaagcaagcctaaaattctaattttgaaaagggcaaagaagaagaccctcatggagttaagagagggagatttttacctcttaagagacatcaagtgaagaaacatgagaaaaatgaggtggggaaccagaattcagactgtgaagaggcctcagcatttataggggttcatgtaaggatgcaggatttccagttttaagcatcaggaatcaggtggacaacagagtttgggtggtaggtagagcctgaagaagggaaatgttttcatgtgagggtaggggttttataaaaaggatttaaatgctgctactagttttctgagaaaaatctggtatgaaggacaaataacatttaggtgtattttttcagcagcacattataaaaagattacttgatatttcagacactttattcctatcaacagggtccaagaccttacctcataccaggctttctgtgtggcatgatagtttaacaaattctgccccaggcttggtagagagatcagatcaaccaaggtacttttaatatgtactgaaagtataatctgcattgtgcttttaaatgtttaagcatattgactgtttttttctcatctatatttttttctcatatgcaaacacctccagtttcaatccatttattagttctcaataacatctattttggctcagtgcattgccagcagatggtttcagttgcttcggattgcagagccagctgaagtcagcagttgtactgtatggcttttcaatcagtcatgtttggcaggcatgggttttctgctctaaaaagcaagatttttctaacagcccttctttcttttgccatttaaaaggacaacaggtactaacttaatgctatgattcttttaaattggaggcaaacatctttccataatcacttagctgggctccttctgctctaaatgaaaagctcttgccatcaattcattttataaaaatatttatttccaagcagacaaaatgttgttggtgcccagatcctttgatgctcacatcacgtacaacagggcgagagaaggatgcagtgtaataaaactttccaaggcttgtaattccctcacggtggccaaagaaaacagaaaatgttcttcaagtatatgggagaacaaagggatggcttctccctactggtctgatgtttctaaaatcagacgaataaaaggttgctaagaccttggatgggacctatcactaagtggtcaagtgatgcctccttctcagggcctggctttcagcttgcaagtttggtgctgtcaacttttgagaaaaggaaaagtgcaattctgtttggaatcaccactagaaaatagagttgtctgttgaaaggatgtatattgtactgtcacagtttataagcacaagcctcttacattgcaggcattgcatactatctgtcagatgaacacattgttgtatcattattccttatatggttaaaagtttcaagattaccacacatgtaagaaaatgataacctgttttaaaattctctatagggaattttatttgaactcaaacagtgtttggaataacatttggtgggtttgatttttgtatgaagataatttgataacagctatgggtttttcctgaggagttttcattcatcctccctctttgatttagcttttcgggcccgggtaggagtggcatggctcttatggaagttaacctattaagtggctttatggtgccttcagaagcaatttctctgagcgagacagtgaagaaagtggaatatgatcatggaaaactcaacctctatttagattctgtaagtagtaaaacataaggtaactgttgacaaagccactgtgttttgtattcaggtgtctaccttactttaagtatgttttctttaattcattgttatttcaactttttgtgtccctgaatgagtttaacatggcaaccatatatttatctccattagaaagacataagtataaaatcagtttagagagttgctattaatgacgagcctgatgaaggccttcataactaaatctttatgtcatgccagatgtgaaatacatagaaatttccatagtataattaaaaaaattcaacccagatctgaatttgagagcctgtctgcctcagggagttgcctaggctggagtgcagtggtgcaatcgtagctcactgcaacctccaactcctgggctcaagtgatcctcccactgcaggctcctgagtagctgggaccacaggtgcatgccaccatgcctagataatttcatgagaattttttgtggagatagggtctcattttgttgcccaggctggttttgaactcctgacttcaagtgatcttctggtcttggcttctcaaagtgttgggattacaggtgtgagccgccatgcctggctggaagacgaaagtcttaattacacattttaaaattcttccatgaagcttttaacaaaccttaaaggggttcatattcttaccttgaaaaattaggtgctaaatcatggaagactattctcagagatttgatcttgacatagaattgttacataaccttcgtgtactctttccattgctgaatgagtactactgattcaagaataaagtgcacacagtgtgtagggaaaggtaagtgaagaattccagactctacttggtatgtctcaaaactggtggtatgtaagtttattcttttcttatagcatctatatgagcttcataggttgaactgatattgagttcatagtattctaaggatttcatattacatgggtgggtttgtatgtttcttatttcagttttgctaagtatgaatcagaaatatattgctgaatatatgcttttaaaaagatagttcttgaatggtctcatttgttttagcacttcaaaaccactttggttaaagccctgttaaaactaattcagtctcaatataatgttaaataacagtctctagattcttttgctgtttaggaattatcttacattaagcactgctcaaaagccattggcctgatttggaacttgaaaaacaaatttaaggttttagtttagttgtgtaattggttttggagtttgtcttctatctttgatgctcttgttaatggttattttaatttgagtgtccagtactctttgagtggtcagtttgacttttcatttactactattggcaaataagggaatgtttgaaggaatttactaatttctgattctttaatgagtgttgttgccaaattggccaaatctgtctctcttggagacagataggctggctttgtgtaccccatctcagtcattggctgtggagtacagccccatcttagttacctcacctactgggtgacatggcttgcatgagctgagggtgattcccaggagaaggaggctgctgtgagccattagtagtaactgggggtggggtgcaccatctgagacaggagatctaggtgcatgcaccctaaggcttgctgcttacttaaccactctaattctcagtatcccattcagcaaaatggaactaagaacaatacctttttgtaagcattgttttacaagttaaataagatagttcataggaagtacttactgcagtatctgacatgtagaaatcctccctaagtgttagtctctgtttcctaaaatgatgagaaaaaagaaatgtctttacttaatcatgaacacacagtgtgccaaccccttaagactcttttgtatttctcaaggtaaatgaaacccagttttgtgttaatattcctgctgtgagaaactttaaagtttcaaatacccaagatgcttcagtgtccatagtggattactatgagccaagtaagtatgctctggagttcttaatactttagaaattaagccaggcattcattcatttattggaagtgaccacacattggattggttctgtggcgagggcaggatttggtaggagaaagtacaggaggcgggggggcaggaagtgagcattccatttcagtgaagactattgataatttacaagggtcacatgataggttttagcatatgaaatttaaaaatgatatattttttcataatgttttagatttttaactcacaattataaactttacaaagaaaaattggcatatagagtccagttatgtctcatttgcaaggtattgcttctattccaagcacccattccatctgtttccagctttaaaatgggagttcttaatgtggcacatatacaccatggaatactatgcagctataaaaaaggatgagttcatgtcctttgtagggacatggatgaagctggaaaccattctcagcaaactatcgcaaggacaaaaaaccaaatgctgcatgttcgcactcataggtgggaattgaccaatgagaacacttggacacagagaggggatcatcacataccagggcctgtcatggggttgggggaggagggagggatagcattaggagttatacctaatgtaaatgacgagttaacgggtgcagcacaccaacatggcacatgtatacatatgtaacaaacctgcacgttgtgcacatgtaccctagcacttaaagtataataaaaaaaatgggagttcttctaaaagtagagctaccatttgaccccacaatcccgttactggatatatacccaaaggacaataaattgttctaccaaaaagccacctgcactcatatgtttatcacagcactaattcacaatagcaaagacaggtcatcgacctaggtgcccatcaactgtgaattggataaataaaatgtggtagatgtacatcatggaatactatacagccataaaaaagaactaaattatgtcttttgcagcaacatggatgcagctgaaggtcattattctaagtgaattaatgaagaaacagaaaaccaaatatcacatgttctcacttataagtgggagctgaacattgggtacacatggacataaaaatgggaacagtagacactggggacttcaaaagtggggagggagagggggaataagggctgaaacactctctattgggtacaatgttcattatttgggtgacaggatcaatagaagcccaaacctcagcatcacataatatacccttgtaacaaacttgtacatgtacccctgaacagtaaataaataagtaacaaataataaataaaatgggacttcttcaggagagaacatgaacagcatctgcaatgcagtagcatcggctggagttagctgtttctttattgagggagtctggtgttttgccgaaacttacacttgataacagatttttaaaagtgtgtcaagaaaaatatagcctgtttggaaaataacttgagcttctttgattttactggtaacttcttatttgtataaaatgatggaaatttaggacgtaaaaatagagagctggtctggagatggcccaagtttaataggatgaatccatgttcagtcagagggactttttgtatgtgatctctggcctaatgtttctaattgtaatatgtcttattttgaataagcgcttgtggtggctcagaatcatcacaatgcatgagaagcatgaacatttttgtgtgttaggtagttgtagataattacactttaaatgagatgaacttgttcccattgttgttagtgtttcatagagtattcaagactaaggtgtagcaccagttctctcctcatagtcaacaagccagttcctcttgtcttttgcctcctgttggcactgaggaagagggttcacccaggttcttgtgggacatttgggaaacactggtgtggcactttttttctagtggagggatggaatacactgtggagacccaatgacagtaactagttgtccaactttattactttacttagttgcaaaattccccaatttatatttcttgggtgcatggggaacattttaaacatttaagaaacaaaaataattcagtctatgcaaatttttatggaaaacaacttacttatgaggaggccattttaaaatgaaaatatgggaaagatcagaataagctaaaccttccaacccattttaaaaaatctcaaaacacatttacgatatggaaaacagtctctgaaaaatcatgaataaatttgaaaatagaatatgttttttaaaaattataaaactcatttatgttttacagtgagttcactgtggtgttataggtactttaagtagtttttgtcatgttcgcttttagatactatatgctgagtgttttaaaacaaggtattgcataggcagtcttcccttcatatttatgtatttttttactagagcccagggtaaatgccccttttcagtagttctaatgattagaatttgatttgagtgcatagagaatgtcatcctaaaataaactcttgaggaggttaaacagtccttaactgaaaattctccctgatgcagtaagagattaaagtggtgcttgtgattgcagtgtgcagctgcagtctatttgctctcttttaatgctggccaactgctggtggtagacagattggactgagcgcattgtttctctcttggatttggttagtactttggaccactcttggacatttcagttgtttcttgtaaagaaaaataaaattaggttaagaatggaaaactcagaaaagtgtatcgaaatgctcttatattttggcaaagtcaatgtttctaaacaagggagccgtgtgaactgatgtctgcttctttgaacagggagacaggcggtgagaagttacaactctgaagtgaagctgtcctcctgtgacctttgcagtgatgtccagggctgccgtccttgtgaggatggagcttcaggctcccatcatcactcttcagtcatttttattttctgtttcaagcttctgtactttatggaactttggctgtgatttatttttaaaggactctgtgtaacactaacatttccagtagtcacatgtgattgttttgttttcgtagaagaatactgcttctattttgaaaaaagagttttttttctttctatggggttgcagggatggtgtacaacaggtcctagcatgtatagctgcatagatttcttcacctgatctttgtgtggaagatcagaatgaatgcagttgtgtgtctatattttcccctctcaaaatcttttagaatttttttggaggtgtttgttttctccagaataaaggtattactttagaataggtattctcctcattttgtgaaagaaatgaacctagattcttaagcattattacacatccatgtttgcttaaagatggatttccctgggaatgggagaaaacagccagcaggaggagcttcatctgttcccttcccacctccaacctagccctactgcccaccccaccccaacccaccccatgcccagtggtctcagtagatacttcttaactggaaattctttcttttcagaatctaggtggtgaattttttttaagtggcacggtctttttctgcttgaaatctgatcacaccccccagccattgccctccctctctttttcctctgtagagaaatgtgaggggcagtacatttactgtgcttttcacaccatctcagaggttgaggagcatactgaaaattgccctggggggtgctgggtgtgctgtctccttcccacatcctcagccccacaccagctctatttcaggggtgagagtcagagagcactgcaatatgtgcttcatgggatttcgattcgaagatcctagaccagggagacactgtgagccagggatacaacaaaatactaggtaagtcactgcagaccgacctccctgcagtttgggaaagaagctgggtttgtggagaatcagagcatcttgacatgactgctgacctaaagatccctggcattggccagggatcctgtggaacctcttctagttcaggggtgtgagcattagactgccagttgtctagtgacatctgatgcttgctgtgaacttttaagatccccgaatcctgagcacctcaatctttaattgccctgtattccgaagggtaatataatttatctggatggaaattttaaagatgaatcccccttttttcttttcttctctcttttctttccttctccctttcttctttgccttctaaatatactgaaatgatttagatatgtgtcaacaattaatgatcttttattcaatctaagaaatggtttagtttttctctttagctctatggcatttcactcaagtggacaggggaaaaagtaattgccatgggctccaaagaatttgctttatgtttttagctatttaaaaataaatccatcaaaaataaagtatgcaaatgtatcttttaaagttaatttttaaaaatgctcttattttagtgaattttcagaaattatagtggaatggatgctcatatattgcttatggatattttggataccaaagtaggaataactgacattcagtattttaaagctggcaaacctgtacatagaaaatagatccccagacagtggtctatgaagagggcagttaagtatcaaatacttaattttcttgcctttttttcttaagtggggaaaagtttctagatctcttacacctctgacacaatctgttctaaaacaggcacttgtaatgttggggcctccttgtaaacgtgtttttgccctttactctctgggagttctttaaaggtgaaatcatcttacaaagaaattgggggagggtcttggcaaaggactttcccctcctctttcctggcctgggaaccttatactgacaatcaatactttatattttaaagtatataatttatagttaacttctagtgtaatatattaggaaacactagaatggaaaggccattggaagacaggttgtatcttttttagaccatatttccttgtttaaaaactatcatttgaatacttttttggtgaagaactccatgttttcaagttaaaggtcacctcgtaggccaggcgcagtggctcatgcctgtaatcccagcactctgggaggctgaggcgggtgaatcacaaggttaggagtttgagaccagcctggccaatatggtgaaaccccgtccctactaaaaatacaaaatttagccaggcgtggtggcatgcacctgtagtcccacctactcgggaggctgaggcaggagaatcacttgaacctgagagacagaggttgcagtgagccgagatcacgccactgcactccagcctgggggacagagtgagattctgtctcaaaaaacaaaaaacaaaaaagtcaccttgtaactcatctctttttattgtaagtttattaaaaatgaagaggacaacaatgagaaggaacataaagggttagctagcactgtctcctggtgcatggggctgtgcagatgtcccggccacttcttccttcatacttcccttagagaacttgctctgctacaagcagtgggcttggactaaaagtgattaaaataccacaggcataaggagaaaaggagtatatgtagtagtaataattactagtataaattattttcttcacatgctatgagtaataatattaaaaaactcattttaccattaagattccttatgctgaagctcttccatttagaatactgtcaatgtcatttactggtatgaactaaagtcccccttcttttccactcactgggaaccttagtaaaacaccagcatatcttacctctctttctgactggccgatgcttccagagactgaatgttgggaaaacctagtagccaaacaattctaggacagaataacatttttatatttggttccaccatcttattacatttagttatagttttaaaaaagaaattcaagcccattaaaatatgtctggtcaatgaaatgcttccttttattgtgttgtgctattgtactttgtttttcaaaacattgtaaaaatagtatctttggtttagtattttggattatatattataatctgaggagtgttttgcttatgtagaatccagatatatttctgttacctaggagatgttacttacatatgtaatactgtatcctgcacgtggaaatattcagaattgtagatagcataactctccctgctcctattcttttgagcctaggtataattttttttttttttttagaaaaagacatatttagctttaatttctatttatgctaaacatatttataagtagtctgtcaatataataccaactatttttatttttacataattcaattatttcatttgacatgtctggcagactcaagacattaagtaaaaaattggaactatgatttttctttgtcattttttaaaaaagaattattttattaacctgctggcatataatctggagttcttttcacaaccttactttttctgatttgctttattgaatgattgaatactcatttctttctaaaaatatgttgtaaattctcccttggcaagatttctccctatgagggtagttattatttgagtctgccaagtggttaccatggggcaaggtgccatgatgtattcttgggtgcattggttttttgcgcattgtaaatttaagacacttatagtaagtggactcattcatagatgagtttcagaaccttttacgttctcggtagaggcttctgtcggacaggcagaagagtgtattcctcacttttttttttgtcttcaaattccagtaaggcatagcacttttaagaaattagaatttttctatcatctatgcaaatgatatttatgttaatattaaatatcttatgttacactgggagtaatttgaggtgcaattatttttattactactttgaatagaggaccattatccttctttcttcagaaaactaagaagtaagtgtaacttttaaagtaagtatatatcagtgagagtaggcttgttttacaactatttctagccagtgagttgtgttttcatgtctcatcaaaagacaataccacattgcatcattttacaaaatatgttgtcattttcatttcagttgtaacataggaaaatagatatttcctagatgatttctgagtttcttactgcaaagaacagttataaattggtatacatgtgtctctgtaatagggataatattgatatatctgttgctacatatttaagaatcattctatcttatgttgtcttgaggccaagatttaccacgtttgcccagtgtattgaattggtggtagaaggtagttccatgttccatttgtagatctttaagattttatctttgataactttaatagaatgtggctcagttctggtccttcaagcctgtatggtttggattttcagtaggggacagttgatgtggagtcaatctctttggtacacaggaagctttataaaatttcattcacgaatctcttattttgggaagctgttttgcatatgagaagaacactgttgaaataaggaactaaagctttatatattgatcaaggtgattctgaaagttttaatttttaatgttgtaatgttatgttattgttaattgtactttattatgtattcaatagaaaatcatgatttattaataaaagcttaaattctcatctattta

SEQ ID NO: 1701 - DNA, 226288 bp, Homo sapiens
atcagttatccagctggcacagtgaggccacccctcggtttatccagtgcttctggggcatgtctgttggaagctcaatggagaggacatagttggtagagtggcctgtggtggagagggttcctctgcgggcacttgttttgtagactggacacacatagatgtcctgatgcagaaacattgcgctctccccaggtttcagccaaatgatgggcagtgggtcatagaggattttggggagagattccccaatctgcatcgttttcctgtcccaacgggcaccttctaagaagagccctttgatgtaggccccatcttcggggttattctccatcactgtttcttgtggggttacctggaagaataaaaagctatgagctccattgcctgccattttcctacatgggcagctttaagagcctggaatcttctgatactcaaagtgcaacctggttgcaatatctacctctcccaggatccagggacaatggggcttctgtgataatattcctgcccaccatacatgggccaggcctgactcctggtcagtatgctgcccttcccaatggtgggctagagaatgcactcaagtaggagtcacattattctaacacattacctctaactagcttagtgattgcacaatcccttccctttctggatctggatttataaagtgaggggttagattcagatacagagacagactggataaacagttctggagatgagtgtggggagaataaagccttgatttctagtttttgtggtataaagacttccaccatggtcaatttcagcctaccaactatttaacaaccagctcacaaaattcctgaaaatgtaacagttggccctggtgagctgatatgagtgagctccagcacaccactgcttagattcagaggtggtaaactcaaattcctttaggtaattgcagaaaatggacaaagcataggagaatagggaggggtggggattatggtgaaccagagagcacaaactccatttaaaatcattcaaattatactttaaaaaatttttatggtgaatggaattttttcccatttctaattctaagtatatattggaagaataggaaaaggctattgatttttataaatttaaccaatatccagtgaccttgtgaattcttctacagatgctcctcaacttacaatggggttatgtcctgataaacccatcataagttgaacatattgtaagccaaaactgcatttaatatacctaacctacaacaaatatcatagcttagcctagcctcccttaaatgtgcttagaacacttacattagcctatagtgggcaggaatcatctaacacaaagtctgttttatagtaaagtgttgagtatcttatgtaatttatcaaatactatactaaaagtgaaaaatggaatgggtgtatgggtactcaaggtgtggtttctcctgaatgtgtactgatttcacatcatgaagtcaaaaaattgtaagttgaaccattgcaagtaaaggactctatgtttttaatcacttcggatttctaggtatacaatcatttcaacatcaagaaagatggttttatctttttttcaatgtttatcctagtcattttttttcttgttgtatttattttggcttaacattgtcttcaaaggctaatcaagttaagttcattcataaactgatttaagacatagggcaaccagtttgtgacctctggactagatgatttcaaaggatctttccgtataatttaaaattctacaatgctctgtaacagtcaatcgtagccattctactctctatatatgacaggctgatgcttgactgttggccatgcttttaactttactccaagcaaaggactacctaagggcattaacattcttgtaaatgaagagtccaccacattgaacaaacagagtgggagagtgccttcatttttcttggtgttctgacggaatctggaaagattccctttttgtatacacagagacaaagcattgggaatcctctaattattttaggagtagcttttagagctactgtaaattatgctaaatgcttcatatgtaccatttcagaagcatttgggtcttaacacatccacattttttgactcataaggaaattggcaacattgctttctctggtcagccccttgagtgagcctaacccaaagcacccctacctcaaactcaaatccaatgtggtcaatggggatggtatatttccgggcataattttgagagacgccagtcaaaaaagactgtgtgaagtagaatccagagatccaaaataccacagggggccccttgtcaatccattcctggagagccacagaaatcaagattcaaaatcaacaacacatcaaagatagttcaaatgcaagtaatgtaacgagtaccatataaaatatgttttttcatatttttcttgaaacagccctcttggtttagcttctatcttcccacttttgaaataagggtacaaagaaatatatttacactttaagaaacgcctaggtactacaaaaattagccaggcgtggtggtgggcacctgcagtcccagctgcttgggaagctgaggcaggagaatcgcttgaacccaggaggcagaggttgcagtgagccaagatcatgccattgcactccagcctgagtgacaagagtgaaacttcatctcaaaaaaaaaaaaaaaagcccaggtgcaagctgatatcagggatacaacagagagtggtggggactgtagcagtggagaatatgtaccttgtctaaactgagcagctgccactcatctccagcaatagtcgccatgccatgcgagaacgcaggtgcattgtttcaggtcttctattttttgcagtacaaacatcggatttttatatgtaaaaaatcaatgtttacatgctggctcaaaaatgtttaaattaccaggtagccaaaccaaacataattattgtccaaatctatctcatgagccaccagtttgtgacattttttttctttttagacggagtcttgctctgtcgcccaggctggagtgaaatggcgtgatctcggctcactgcaacctctgcctcccaggttcaagccattttcctgcctcagcctcccaggtagctgagactacaggcataagccactatgccctgctgatttttttggtatttttagtagagacggggtttcaccatgctggccaggctggtgtcgaactcctgacctcaagtgatccgcctgcctcggcctcccagagtgctggcaatacagatgtgagccactgcgcccggccggctataatcttttccaggactttcaagtctccctcctgcttctaactccaggaagactgtttccagaggctcaatccaggatgttctgtggctgcctgccctcctccccctgcctctagtctgccatttcagaatgtcctctccacctaagcaagcatgccaggttcccggttacccctgactcccaggtacctggaagaaggtcaggcgggccagcaggtcagccacgtagccccccagaggcttcagtgatgggtaagacttggctgcccacatggctggcactttacccacaagcatgctgttaaagacttcctctagctccgaggacatcaggacctgtcctttgatggctcggccaagattgatgaggctcctccgaaccactttggtcagcctgcaagaacagaggagctggctgagctgggctctccggtggccacattctacccaagtccactgactgctgtcccctttaaaatgtcagttaattaatgcacagtcattaaatgaggaaaaattaaatcacccgttaccttgctacctaaagataacgttgatgtatatctttccagatttttctctatgtgaacacaaattatttttaatgagatcatactatattatctttccgtaatctgtttttctttcttagcatataggaaacatctttccaattcaatagagacctaaattgtcctttttttcttttttttagagatggggtttcactctgtcattcaggctggagtaagtagtgagatcagagctcactgcagcctcaaactcctgggctcaagtgatcctcctgcctcagcctctggagtagctgggactacaggtgtgcatcaccatgcctgtcctttgtaacgactgcaaaatgttccattttgtttaactattcctctattgttgacgtgttatttctagattgttgtcactatcaacaacattgctagcaaaattcatccatctcaatctttttgcaaattttaaattattattaaaaatatttctaggtcaaagagcacgcacagttttaaggctttcaattcatattgtcaaagttgttctttttttttttttttttttgagacagagtcttgccctgtcacccagggaagtgcagtggtggagtcatggctcactgcagcctcgatctcccaggctcaaggaatcctcccacctcagtctcctgagtagctgggactacaggcacatgccactatgcccacctgatttttttttaagtagagacaaggtctccctatgttgcccaggctggtctcaaactcctaaactcaagtaatcctcccacctcagcctcccaaagtgctgggattacagatgagctaccacgcctggccaaaggtccttttttatcgactataaggtgcacgcctgagaaaaggcaactgaagggcagcctgggagatgtcaaattcacctgcctctccctctgacctttatgttacgaggcccagccaagcccggaggtaattcacctgaggagaccaaagaatctgccactacaaagagcttttcatctccaaagctttatggaatctcaactgaatggacatgagaatgatcacatgcaggaagaggatttctggatgtgtaaccactaaaccattgtatcaagaggaatgtagctgggtgtgggggctcacgcctgtaatcccagcactttgaaaggcagaggtgggtggatcacttgaggtcaggagtttgagaccagcctggccaacatggttaaaccccgtctgtactaaaaatacaaaattagctgagcatgcgcgcctgtaattccagctactcaggaggctgaggcaggagaatcgcttgaacccagaaggtggaggttgcagtgagccgagctaagatcacgccattgcactccagcctgggcgacaagagtgaaactctgtctcaattaaaaaaaaaaaaaggaatgtaaaattcagacatgtgtttgctaagcagtcaagggtaaaagctgccatctgagggattacaccacagacctctattatacctaaagacctacttgcaaagattctctttctattcttgcaactatgagctctgctagttttaaggttttagtacccaaggaaagaacacttgcccagaagacacagtcacagttcccctgaagctgaactgtcgctgaatcattctgggcttcctatatcactgggtgaaaaggcaaaaaaaaaaaaaaaaaagggaaagaaaaaaaatagtggggaggaacgttagagtactgcttgagatgattaatcctgaccatcattggaaaataagattgctttccctgttctttttttcttttgagacagggtctcattctcttgcccaggctgaagtgcagtggcacaatcttggctcactgcaacctccacttcccaggcccaagcaatcctccctcctcagtctcctgagtagctggttctacaatgcccagataattttatgtatttttggtagagatggggttttgccatgttgcccaagctgatctccaactcctgagcaatctgcctgcctcagcctcctaaagtgctgggattacagtgctgggtggagtgagccacggcacctggcttgctgtcctttatagaatgcccagtggtgaaggccagtgaaagcccctgcaaccaccaagaaagagctccagtggccttagaggagaatgacagcagaggagggaagccattagttttggtgtccagttggacagtccaggactacagtccatcatgccaaggtgtctcacaacagaggtggcctcgtcctaggctcacaccccataccttgcttggtccctgctacggccaactgcctgttgactctaaagagtaaccctaggccgggcacagtggcttacacctgtaatcccagcactttgggaggccaaggtgggcggatcacctgaggtcaggagttcgagaccagcctggccaacatggcgaaatcctgtctctactaaaagtacagaaattagctgggcgtggtggcaggcacctgtaatcccagctacttgggaggctgaggcaggagaatctcttgaacctgggaggtggaggtcgcagtgagccgagatcgcgccactgcactccagtctgggtgacaagagtgagactctgtctcaaaaaaaaaaaaaaaaaagtaactttaaaattcaggaagcctaacaactctcaaataacactcctccagtcccctggtcctctggaatcagggctgtccttaaaatgaagcagtgacccaatgacacagaatagaggcagtaacacatgcagtgtctggagcagcaagaccttggtcttggaagcagaagtgataagttttagcccacttggctctgagtcacttgagacctacatcaaatcacagtcatctctggacctcagtttcctcatctggcctagatggtctttgataaccctttcagttttgactattcaaaaatcaaatccaggtgatcccactgggctccatgctgtagtaactggagaagaggactagaatacaaggccagagatccttgccccatggccagcctataatacccctaactgtgtggtagaggcactaggatgaacgtctcccacccctttctagatttacccagatttcacatattggataagtacacgggctctggaatcagacttagttctgggtttaaactgagttttcccgttgaatgattgaataactgagcaaccttgggcaagtcttaacccttctgaatctcagagtttttttttattttctttaagagatggggtcttgccatattgcccaggctggtcttaaacccctgggttcaagcaatcctcccggcttgcctcccaaagtgctgggattgtaggcgtgagtgatcatgctcagcctcagttttcttacttgtaaaatgctggtagcaggattagtaactggacgtatttcaaaagactattgtgtaatttttttttaagggatagggtctttctctgtcacccaggctggagtgcagtggcaagatcatagctcactgccgcctcgagctcctggcctccaagagatcctcccacttcaccctcccaagtagctgggactgtagacgtgcaccaccatgcctgccttttttttttttttcttttttggagagatggggtcttgctttgttgcccaggctggtcttggactcctggcctcaggtgatcctccctactctgcttctcaaagtgctggaattacaggcgttagccactgtgcccagccctattacagactttgaatgagacccatgcatagtgcttagaaccgtatctgtccctaaaggctcaatacaaatggctctaggccaggtgcagtggctcccacctgtaatcccaccactttacgaggccaaggctggaggcctgcttgaggccaggagttcaagaccagcctggccaacatgtcaaaactccatctctataaaaaataaaaaataaaaaaattagccagcatggtggcctgtgtctgtagactcagctactcaggaggctgaggtgggaggactgcttgagcccaggagttcgaggctgcaatgagtcatgatcacaccactgcactccaacttgagcgacagagagagacctcaactcaggaaagaaaaatgaaagtggctctaatgactacttttactattagcctgtgcttgatactggttttagcctaactttatagatgtcacatgaatgaatgggaatgaatgaatagaaggaatgattcaacccagggtcagcatgtgctggggatggtcctattcacagcccctattcacacccctaatacgggtggggcaaaccacttcctctgcatagcaaccccttctcagctactgcctgttagatcctactcctcacgttccaactcccaggattcaagctacatcatctggcccacctgttgaatctgatgagctcctgccttaggacggtattcatggattcttcatagaccacggggtacaacttcatgacctcttccaggtcaaagtctctgggaagcttggagagaatgtcttgtgccaactcctcaaccacttccttaaaatgcaggcagaagagaggtgagtgagaagcaagccctacaggctgtggctttggataaactttaagtactgagcatctgacttttcaaatgtattctgtgggactttcctgagaactctccaacagaagccatttctgcctccagtggggaaaggagtccctcatcaccccaccagccttggggagggcatcgcctcttggtccagaagagtagagtcctgtccttggcagagcacggtggctcacgcctgtaatcccagcactttaggaggccgaagtgggtggatcgcttgagtccaggagtttgagaccagcctgggaaacatagcgaaacccagtttctacaaaaaatacaaaaattagccattagccatgcatgatgctgcatgcctatggtcccagctatttgggaggctgaagcaggagaatcacttgaacccaggaggcggatgttgcagtgagctgagatctggccgctgcactccagcctgggtgacagaggaacacctgtctaaaagttaaaaaaaaaaaaaaaaagagtcgtgtcctgacacctcaggcaagagccgaagggccaggaagggaactcttgctcagccaggtagcttcagggcagcactaagcctctgtcttcaatgtcacacccaggtgagaatctcccacagcctctgacccctgaggattagctcctggtgccatggggccctttctcagtgcccgtgacacctgggaaagcagcaggccattcttcagcattggagcaagaaaagcacagaaccctcagcttagccaagtagggaggggacaggcctcgaggctcaaggaggaacaagacctgagtgtgggagagacagacaccctgtggtcctgtggatgtgggaggctgggatgtataattctttccctcttcccactgtgaggggaatttccactcctacatcgggatacaccaaccaggctggtttaccttcataccagtgatacttaatggcactaggaaccaaatcatgaaagcaaattagcaaattctacagttgggaggggttaaacaggaggtagcttggaaggtggagaagggaagggatgggagaggaagcgggtggagtcaggagacggtggctctggttctggctccgtccttgattttatgaaagcctggaagccggtcactttctctctcaggatttgtttctctcttcatttgtagacttaggagggtggcctgggtcaggtcatcacaaagagtgcactgggactactagaggtacccaggattttaggtgtttccaggacacagaaaaatcatgttgagtcacatggtgagaaagttactctttcaggttttgggttttttttcattgttgttgttactgttttgagatagtgtctcactctgtcgtccaggtgggagtgcaaaggcatgatcacagcctcgtgatcacagcctcactgcagcctcgacctcctgggttcaagtgatcctcctgccgcagcccccttagtagctgggactacaggcacgcaccaccacacccagttaactttttttaagacagggtctcactctgtcgcctaggctggagtgcagtggcatgatctcagctcactgcagcctcaacagcccagaatcaagcgatcctcccacctcagcttcctgagtagctgggattacaggtgcacgccactgagctcagctattttttttttttgtatagacggcgttttgctatgttgctcaggctggtctccaactccttggctcaagcaatccacccaccttggcctcccaaagtgctagggttataggcatgagccatggcacccagccctcggttaacttaaaaaaaatttttttgtagtgatgcggtctccttatgttgcccaggctggcctcgaactcctggcctcaagtgctcctcctgcttcagcctcccaaagtgctgggactacaggtgcgattcactgcacctggcctcttttccagttctgaccatctttctcttttcattcctctcaaaaagacagtttcgggtcagtgccaattctttgacactcacacatctttctccttttaacaagaagccagcaaagcctcagctcaggggctttggccagcaacatcatctgggaagaacttaacaactgttaacgctgggagcagtggctcacgcctgtaatcccagcacttttggaagccaacgcaagcagattgcttgagcccaggagtttgagacgatcctggacaatatgatgaaacactgtctctacagaaaatacaaaaaaatttagctgggcatggtggcatgtgcttgtagtcccagctactcgggaggctgaggcaggagaattgcttgagcctgggaggcggaggttgcagtgagacaagatcacgccactgcgctccagcctaggtaaccgagccaaaccgtgtctcaaaaaaaaaaaagaaaagaaaagaaaaacagcaacaacaacaaacagaaaccaaaaaacaccaactgttcactgttcagctttcattttctttttgtgcgtatcatgactttatggaaatgatactgggtttccacttatggttctgatgtgcaatcttttaaattaaaaaaaaaagagagttagttttaaaacattatgtagaaaaaaaagcaaaagaaaaaaaaaaagaataaaacccattatgtaaatggagtataggtgataggtggatatagcagaaaacatgaaggttatacaggaatagctgacattttggaaacactggttcccttgcagctctggatataaggactcccggcagtaaggccacagtgctccttccctgcccttggccaggaggctgccaggcccccactctctgcctcttggtcaccctccaatcctgtgtgcccactggatgaagaactgcctgggaaataggattaagccccctttcccgagcccagttacctgaggggacttgccacttcctcctgactgtctagggagggtcagcaggaccccctcaaacagctggttggtttcctggttgtctttggtgatgtctgcgttctcatggaggccgaacacttctgggtgggctgtgatggggagattcctgagatagtcgatataggactggaagggaaatcttcagttgaaatcaacgagggaccccagaatcccacagatgactccaggcttagcagaacccaatcagaacaggaatcatactgtatcagtagcacaggacacacacacacacacacacacacacgctgggagaacacaaccctagccctccctcatacagttttctggggagtgggcatgaaagcagatgagactgaattacctctcgcccaccctggcttcctctctgctcccccagtgggcctggctttggacccaaacagaactgagtttggatcctagctccatcccaaactgtcagaggcattcgaaccagagcaactccatcttgtatagggactgggtaaaataaggctgacacctagtgggctgcattcttaggaggtgagggcattctaagtcacaggatgagacaggagtcagcacaagatacaggtcacaaagaccttgctgataaaacaggttgtggtaaagaagccagtcaaatatccccaaaccaagatggccacggaagtgacctctagttgacctcactgctcattacacactaattataatgcattagcatgctatgagacactcccaccagcgccatgactgtttacagatgtcatgacaatgtcaggaagttgccctatatagtctagaaaggggaggaaccctcacttcttggaattgcccacccctttcccggaaaactcatgaataatccaccccttgtttagcatataatcaagaaataactgtaagtataatcagttgagcagcaacccatgtcattgctctgtctatgaagtagccattctttattcctttacttttttttttttttgagacagattcttgctgtctgccaggctggagtgcagtggtactatcttggctcactgtaacctccgcctcctggattcaagcaattctactgcctcagcctccctagtagctgggattataggcatatgccatcatgcccggctaattttttgtatttttagtagcgacggggtttcactgcgttagccaggatggtctcgatctcttaaccttgtgatccgacctctttggcctcccaaggtactgggattacaggcatgagccactgcgcccggcctcctttactttcttaattaacttgcttttgttgtactctatagactcgccccgaattctttcttgtgcaagatccaagaaccatccctttgggtctggatctggacccccttccgataataaaactatgtacccttgaacttgtcatctgaaaccccagtttccttatctgtaaatagaaaaacaagtgtagttatgaagtataaaccaaaagtaaaatcttaagaccctccaaccatctgaatggacttcctccttgtccggggcactctaaaatttaacctgaaagcctggttcaggccatgacgggaagtgggggtcagacatgcctcattatgcccctccagcattaccatcaacacagaccttaagtctgataagaaacatttacaatctattctctctgaagcctgctgcctggaggtttcatctgcatgataaaacttgggtctgcacaacctcttatcataacccaggcattcctttctattgataactctttcaaccaattgccaatcagaaaacgtttaaatctacctataacctgctggcctccacttcgagttttcccgtctttctggactgaaccaatggatatcctaaatgtatttgactgatgcctcgcgtctccctaaaatgtataaaatcaagccctgaccacctggggcacatgctctcaggatctcctgagggctgtgtcacgggccatggtcactcatatttggctcagtataaatctcttcaaatattttacagggtaagaaagagactcttttcatccacagaaggaatcaggccttggcatgtgacaggttgtggtgtaatatacatatatatctactggttttcatccatggttcctggcttctaactcccctagcccttgttacagtcacctgttataatgttgggtgtgttaggccttaggggcaggccgcaggaaacagaatctctctgaccttctctttccctccttttacctgcccccaagcaagactcaaatcttcccctgcctttctgattgtgagtcctttttttttttttttttttttttttgagacagggtcactctgtggcccaggctggagtgcagtggtgggaccttggttcactgcaacctatgcctcctgggctcaagcgatcttcccacctccgcctcctgagtagttgggactacaagtgcatgccatcacacccggctaatttttgtatttttagtagagacagaatttcaccacattggccaggctggtctcaaactcctgaccccaagccatccaccagcctcagcctcccaaagtgctgggattacaggcatgagccactgcacctgacctgattgtgagtcttaagactccacctagagagagagggtgctgccctatactctggggaatgtcatacagctttcataaaaacccaagaagactgggtgcggggagcttctggatagctgaccacgtggaggttcctggagggtatttcacccagggagggcatggaagttctcactccttccgccatacttcaccctatgcatctcttcatctatatcttttgtaatattcctttaataaaccaataaacctaagtatttctctgagttctgtgagctgctccagcaaattaattgaattaatttcaattaaagggggagtggtgagaaccccaacgtgaagctggttggtcagttcttgaggctgggacttgtgactggtgtctgggttgggggaaagaattggggactgagccctcaacccgtgggatctgacactatcaccaggtagatggtattggaattgaattagaggacacccagttggtgtccactgcttaatgtgtggggaaggggtaacctccacacatttggtcacagaagtcttcttctgtattgatggtggtggtggttgtggtgagacagtagtagaaaaatacaatttcagagtttttctgttccacaggtcatcaataaaagtaagtggttttttttgtttgtttgtttgtttttttgagacagtttcactgtcactcaggctggagtgcagtggcatggtctcagctcaccacaacctccacctcccagttcaagcaattcccctgcctcagcctcccaagtagttgggattacaggcaggcgccaccacacctggttaatttttatatttttagaagagatggggtttcaccatgttggtcaggctggtctcaaactcctgagcttaagtgatccacccgcctcagcctcccaaagtgctgagattacaggcgtgagccacagcatccaacctgtaagctcttttctatccctcagattgttttcatcttccttttgtcattccctgcccagtttttctgttcctccctttttgccaccttctgaatcttcgtcttcaagtagcaatttccatcttgctcacttccaaggctccatcttaatcatcgttctctctccttcctccacccagatggatcctatattttgaaacaccttgtctaccaaataccgaccccctccttaaacagtagccatgtctctcttgcaggcttttgggaatattgggaatagcttatggattcaattcaggaagcccaaggtcacccctgggatccctggctacactgcagccctgtagccatatagagatgacggagccctgtgggggaaagaggtaggcctccctgcccaccccttacctggtaggagccatgaggagggatgtagtaagtgtctccaggagcgagggagtaatagtcctcctcaatttccttacagtagaacatggacagaagtgacagcaggagacgccggtctttgtcatcagtcactctgcctccgtaattacattcccctggggacaaccaacagaaggagaggttgagcccagggaaggtcatcacgagcttggtggttgatgtaaaacacggcattcttccggccaaagatctctgctgggacatagtgatagggacagcaagcaggaaaattccgggcagaagatggcgggtcccctgcaagggccccaccctcaagctgaaaagcctgaaaccatggcccaaagtgagaacttacatccctgttttcccacttgaatgttgccttttccaaaaccacccatgacctgccccacccccacaacccatgcccatcaaaaccccaggctcagccagcagagagagagaagcagctggacatcagagagaagaggcttgacttcaggggaacagccttttcagctccctttcccgctgagagccactttcttcggcaataaaatcccccacatttaccatcttccattcgtttgtgcgaccccattcctcctggacactggacaagagcttgggtgccatgagtgcaagtgccaaagtctgtcacgctgacccaccactgggcggttaatacttgagctgtctggaccgcagagctacaagagtactgtaaaccttcctctgggtgacagagggagactgtctcaaaaaaaaaaaaaaaaaaaaagacctgcactccagcctgggcaacaagagcgaaacttcgtctcaaaaaataaataaataaataaatataaataaaaacagaaacaaaaaaaaagacatttaaagagcgagggagagaccacattcatataacttttattatagcatattgtaattgttctattttattactgttgttgttaatctctcgctgtgcctaatttataaattaaactttatcataggtatgtatgtataggataaaaaatagtatatatggggttcggtaaaatccgcagtttcaggcatccactgggggtcttggaacatatccctggtggataaagagggactagtgtatatgttgagatggtggcagtaacagtggttggagcctttgctaactgtgcccctgatagagaattacaacgagcaaagactcttgctaattcatgctggaaatgtagagtgggcaagaaatggatctatgatgtcttttatacccttgaggtttgaggattgtttgttatctcagcctaactagcctatcctgactggaacagttggaaggtaactactctcaagctggctggtttatgaccggcaggcagttggtttatggcttgcaggcagttctctaagcagaccatatcccagggcaatcatgcactcatgctatggtctgaagaggaaccctaggatgtgcttctgcatgacctggaactgtgggaatatggttcacttctatttattattattactagttttagagacgggatcttgctgttttgcccaggctggtcttgaatccctgggtccaagtaatccttcggcatcagcctcctgagtagctgggactatgggtgcaagccactgtgtccagctccaggcgcacttctttggagatgttctttcaccaaactgagacccactgtatgcgtactgtgtgtgtcatttggggctttgttttagggaacactctactgagttaaggtcaatgtgaccttctggcactgaacttaatcactgtaaagaacagtctttcaaccttggcactcttaacatgttggactggatagttctgtgttgtggggaccaccttgtacatcgtagactgttcagtagcatccctagcctccactactataactgccagtagcacgcactatgacatccaaaaccatctccagacattgccaaatagccactgggggctgaaatcacccacagttagaaccactcctttaagcctctgtcttcccagctgtaaaatggggttattaacatggagctcataaaattagcatgaagactcaatgcattaatcacaggtatacagtgtctgccacgtgcctggggaagggattctaacaaactccttaacatatggagctgaagaggaaattgggtgtgatcttgatgccccggtgttttaattaagctgcattttgaccttcagccatgatattccattcatttagcacatgtctattcttattcctgtctctgggactatacggcacgttccttgaagttagtggtcacgtttttttggttgtatgtgtgtatgttttttaagagatggggtcttgctctgtcacccaggctggagtgcagtggtgtgatcatagctcactacagccttgacatcctgtgctcatgcgatcctcctgcctcagcctcctgattacctggggctacaggtgcacaacaccatatccagctcatttttattttatttctttgtagagatgtggcccagactggtctcagactcctgggctcaagcaatcttcccaccttggcctccaaaagtgctgggattacagacatgacccaccgcacagagcctatgatcaagttttacacatttacattcttccatattatgtacttgtacatatcgtggactaataaaaggttgctgattgattgctttaatacaaaacagctagtgccatttctacctcaggatcactttgctgggaatgttctccttcctctatgccccacccagtccattcttttccactcataaaactcctactcacccccaaaacccatctcttatgcctttaagaagtttgccacgatcatctcctcctcctaccccaagatttaatcattatgctgcccttctacttataaatgtttctcttgttgaacttattactatgttacctttttttttttttcttctgagacaggatctcgctctgtcacccaggctggagtggggtggcacgatcagagctcaccgcacctccacatccggggctcaagcaatcctcccaccttagtcccctgagtagctaggactacaggcatgtgtcaccacgcctggctaatttttgtattttttgtagagatgggattttgccccagccggtcttaaacttctggcctcaagtgatccatcgcctcggtctcccaaagtgctgggattacaggcatgatccactgcgcctggcccgtattttttttttttttttttttttttgagatagagtctctgtcacccaggctagaatgcagtggcgcaatttcagttcactgcaacctctgcctccccacttcatgcaattctcctgtctcagcctcccaaggagtagctgggactacaggcactggccaccatgcccggctaattttttatatttttagtagagacaggttttcaccgtgttacccaggatggtctcgatctcctgacctcgtgatccgcctgcctcagcctcccaaagtgctgggcttacaggcgtgagccaccacgcctggccaattttttaatttttagtagagatggggtttcaatatgttggtcgggctggtctcaaactcttgacctcaggtgatccacctgccgtggccttccaaagtgctgagattacaggcatgagccactgtgccccgctggcctgtatcattttttaaaatatttttcttcttttggagactgtgagtcactcaagggtaaagattctatcttaattttttttgtttgtttgtttccttacaatatctagcatgatgaccagcattagtaagagctcgatgtttatggtgagggagggagggagtacataagtgaatggaaatgggaggagaacagcaggagggtggaacatgatactggaggtttacagtggaaaaactcctcccgtaaatacctgtcaggtaggtcagagcatcaaagggcacctccttgtagtcattgagaaacatctggatctgccacatactaatcctcaggtcagattcgttgaattcatagggaatattccaccctgcgtgtgggagagcagagagaggcttcagtgctgagagctcttaatttccactcaaagaccaagccgagggagttaagcatcattatggatcaaaagcctctttcaggctcatgaatatcaagcaccgaggccaactattagcctggacgtttaccaccaacatgggagccattctgcctgagaaaacatccattctaaaatcaatttccttatatacctccccatttgttaaggaagatgttaatgtcctgggatttgtggaatgagaattattcagcctggcaggaatatggcggtaatgcacggagctccaaaaataacaccgcggcatggctagacagcaggagctacgactgggcaacagagccacgttggttctgagaattcccctcctcgagctcacgggaaaaactgaatggccagccttaaagaaatgaccactcgtatttccaagggtgtaatgataaatgcccattgggggctgaacaagtgacatacatgtgtaaaccaggcatggtgcaggatacaagaaagagtatggggaaacctgtgctcaatagggaagttttttgtttgttttgcttttgtttgttttgtttttttgtttgttgttttttttttttggagacagagtctcgctctgtcccacaagctggaatgcagtgtcgtgatctcggctgactgcaacctccacctcctgggttcaagagattctcctgtctcagcctcctgagtggctgggattacaggcacgtgccaccacgcccagctagtttacgtagttttagtagagacggggattcgccatgttggccaggctggtcttgaactcctgatcgcaagtgatccgcctgcctcggcctcccaaagtgctgggattacaggtgtgaaccatcgcgcccaggttcaatagagaagtttaatttcctcccaaacactcgctttcaaattataacaaaataataaaattcgtgtgccagcaaacgaagcatgactggcagttagttgcaagccaaacatttgcatggctttttttttttgagagactggatctcgttcttttgcccagtctagagtggtatgatctcccttcactgcagcctcgaactcccaggctcaagtgatcctcccacctcagcctcccaagtagctgggactacaggcttgtgctactatgtcaggctattttatttattttaattttttttttgagacaatgtcttactttgtcatccagtttggagtgcagtggcacaatcttggctcactgcagcctccaccttctcgcctcaagcgatcctcccacctcagcctcccaaagtactgggattacaggcttgcaccattgtgcctggcatgactggtttatttcacttagcgtaatgtcctctaatgtcctcaggttcatccacgttgtagtgtatgtcagaattttcttcctctttaaggttgattaatattcaggagttctagaccagcctggccaacacggtgaaaccccatctctactaaaaatacaaaaattaaccgggtgtggtggcatgcttgtagttccagctactggggaggctgaagtgggaggatcgcttgaacctgagaggtggaggttgcaatgagccaagatcacaacaccacactccagcgtgggtgacagagtgagaccctatctcaaaaaaaaaaaaaaaaattcgttgtatgaatatataacattttgcttatgtattaatctacctatagactttttttttttttttttgagacagggtctcactctgtcacccaggctggagtgtggtggtgtgatatgggctcactacaaactccacctcccggttgaagccattctcatgcctcagcttcccaaatagctgggattataggcgggcaccaccacacccggctaatttttgtgtttttagtagagatggggttttaccatgttacccaggctggtctcgaactcctggcctcaaggattctgcctcccttggcctccctaagtgctgggattaaaggcacaagtcaccacgcccagccaggttgtcagatttagcaaataaaaatacagtgagagtttaatattagttaaataataaatcatttagtataagtatgttccaaatattgcctggaaaatatttataccgtatcttactggcaaccctatctgagcgcaagcttaaacacgcacctggaaacacacctatatgtgtctgatatcctttccctcaggccactcaggtgcactgtcatcgcttacctagggggccgaagtttcttctctcttgaacaacggcgtggaagaaacaaaggccaaataacatcttttgccacatcaccgcctttgcacagctttggaagaacacaggatctgagatggggtcattgaggtaggagcgcaacaggttggcccggagccctttggggggctcattggtcattttgattccattctggagaatgctgactggaaacttctctgatggatagctggttagccagagtctggaagaacaatggacccaacgttttagagcaatacaataagttatagtgaaaagcaacaacaaaaacaaaacaataacaataacaaaacagaccagcctgggtaacatggtaaaaccccatctctatgaaaaacattattttattgataaattaaaaaaaaataacaaaaaagaatagctatgattaaatactaccagagccaaaactatgctaagcatttaacatatgtccttttatttcccttaagcctcacagccacctgatgaggagggacttactacctcttttaccagtgaggaagcggaggcatggcaaggtcaggtgggtttttcaaggacacaccacttggcagtagttgaaccaagatgtgaactcaggactctctgactccaaagctcctactctttttttttttttaatgtagagatggagtccctctatgttgcccaggctggtctcgaactccagggctcaagtgatcctcccacctcaccatcccacagtgctgggattacaggtgtgagtccccgtgcctggccctaaggctgctttctccctacaaccagagttgaatagttgcaacagagacaatatggccacaaaccctgaaatatttactattggccctttacagaaaaagtttgctgatgcctgtcatataagaaatggcatttgaaatgtgccttgaaaaatagggagaaattcttttttaaatgcaagtgtatctatgcccacaaaaaatggaaacatatgtaaaagtgtttagaagaaactagaattgataattttaccacctataggttaacatcttggcacattgcatctgaggctcttttttttcatttttattatttttatcttattttatttttattttcatttttttgagacaaggtctcactctgtcacccaggctgcagtacaggggtgcatctcggctcactgcaacctccacctcccaggttcaagtgattctcctgcctcagcctcccgagtagctgggactacaggtgcccgccactatgcccggctaatttttgtatttttagtagagacagggtttcaccatgatagccaggctggctttgaactcctgacctcaggtgatccacccacctcggccccccaaagtgctaggatttacaggtgtgagccactgcgcccggccagagttgctaacgtttaaaaacctaaggctttcttttacagttctagattcccatcttccctttaaaattgttagaaagtctgatcctacatggcaacagttagctagtattaaacagtgaccgctctccttgccagagcatgtgcccagttcactgcaagccccaccattccctattgtgtctgacactgaggctgactacccatgaggattgttgctgtactgtggaacgtggactatttcttgtatccagccctcttcactcatttatgttacatgcctggcccctataggcacttgagaacttgagttcatgatttttgggtcaggatcatattacagtagaacttaaaatgtcaacataaataactttttcttctttgagtgtgtcattaatggccaatgaattcactcactatcccaaaccaaacaacattcttttcttttttttaaagattaaggcacaacgcttttaggtttttttgttgtttgttttttaatttatttatgtttgggacagagtctcactctgtcacccaggctggagtgcagtggtgcaatctcagttcactgcaacttccacctcctgggttcaaggaattcttgtggctcagcctcccaagtagctgggattacagacatgcaccaccgcacctggctaatttttgtatttttagtagagacagggtttcaccatgttgccaggctggtcttgaactcctggcctcatgtgatccgcctgccttgacctcccaaagtgctgggattacaggtgtgagccacctcactcggccccaaacagcattcttgaaactaatggacttctcttaaactctctctcttttggaagttttatatgaagacaaatcaactgtggcctaatccgactttgtaaataagcaccaaacactttccctcttttctggcagacgactgagatgaaaataaccagctagttttgttggatagagcaggggttgacaaatttttttctgtaaaggaccaaatagtacatattttagactttgtgagcccacatgatctctgctgcaactacttgtcatacaaaagtagccatagacaatatatgaataagcatgatgtttttcaataaaactttatttatggacactaaaatttgaatttcatagaagtttcatgtattatgaaacatgattctttagtttcttccccacactgtttagttagcttgcaagctatacaaaaaaaactggcagcagggtgcatttggctatcgggccataggttgctgctctctgccctggtataagagaatcccttggctgggtgtggtggctcacgcctgtaatcccagcactttgggaggctgaggtgggcggatcacctaaggttgggagttcaagaccagcctgaccaacatggagaaaccccatctctactaaaaattcaaaattagccatgcatggtggtgcatgcctgtagtagcctcaggaggccgaggcaggagaatcgcttgaacccgggaggcagaggtcacagtgagtggagatcgcgtcattgcactccagcctgggcaataagagcgaaactccatctccaaaaaaaaaaaaaaaaaaaaaaaaaaaaaaaaaaaaaaaaagagaatccctgaacatttgagttaaaatggactttaaagtctgtttggttcaactcattattttatgaatgcaaaaactgaggtttagctttgttgggctttaaaattcccaaaaaacaaatagctgtttccaatgttgattaaaattccgaagaaccccagaaatgtaggatagaggcaggaggcgggaggcaggacaaatgatacctggaaaacagtagaattttttttttttttttttgagacagggtctcactctgtcgcccaggctggagtgcagtggtgtgatcactgctcactgcaggctcgacttctcaggctcaggtgattctcccagttcagcctcccaagttgctgggactacaaatgtgcgccaccatgcccagctcattttttgtatttttagtagagatggggttttgccatgttgcccaaactggccttgaactcctgggttcaagcaatccacctgtctcagcctttcaaaatgctgagattacaggcgtgagccaccatgcctggacagaattttttttagacaaataataatttttaaaaatcagacttgctcacattgaatctacctttccagctacgtctcctattaccttctccaacaacttttcatggcatataccagagctgtaagataacttctcaggatttccttaatacctctctttgcttttccaatacctctctttgcttttccaaatgctgtctcttctgcctagaacatccttcctggcaaactcctattcatttttcaaaatcctgggccattgtcaggcctccaagacttccccaaccttcccatcccttctctgtattccatggttcttgttcaaatagtgagtaaatcaggtatgacatggtatcaacattattcatctatggcctgccttctgctatactgaagagcttctttcttttttagagaggaagtctcactctgtcgcccaggctggagtgcagtgatacgatccctgctcgctacaacctctgcctcctgggttcaagcaattctcccacctcagcctcctgagtagctgggattacaggtgtgcgccactatgcctggctaatttttgtatttttagtagagacagtgttttgcaatgttggccaggctagtttcgaactcctgacctcaggtgatccacccacctcagctttccaaagtgctgggattacagacatgagccaccctgcctggcctagactgaaagtttctaaggggcaggactgtgtcttggtcatcttcccagccaccatcctgatgtctggaggttgggtcccagagaaggcagtggtgggacagcatctcacctgaatctggcattggtgctctcaggaacaatcacctcctcacaaatcttctccagggtaggcatccagcttgcggccaggtggcagttctgtaagaccacccaggtcccgtctttgatggcattgttgatcattttggcagcaatagggccttggccttggccaagggagatggtctgtgttctggtacctcccataccaagatcatcagcaaacttcagcaggcctgagaccaggaagaaaggaggcttttgaaagacgacaggccagctaacagtaacagaacagctatatcaacaataacaacatggctgggtgtggtggctcacacctgtaatcccaacactttgggaggccgaggtgggaggatcacttgagctcaggagttggagaccagcctgggcaacacagtgagaccttgtctctatttaaacacacacacacacacacacacacacacacacacacacacacacaccccaacacaaaaggtggggttcacattaaattttggactcagaaaaaaactcattggcttctgttaattacaaaataaacatctctctggggaaactttagacatcagatcagatggcagatgaagctaccatcaacttctcttttgctttaaacacatagacattcttgataaaaaaagaaattatctgaactgaaaagaaacaaaaaaaatcaaggtttgaaagaaaaggatattcccaggtgcccaaaacggggaactcaaaaataaagaggtgagcacatcaaataactaggaaactgatttttgccaatttattttaacaagaaatataagcatttgtaaagtgaaataagtctctcacttctctcttctcagtggtagccaatgtgattagatttgtgaatccttcaagaaatattttgtgtatttaaataaatgcatatatactattaaatttatatgaattgtagaatactgcatttttttcccacttaacaatgtacatatcttataggtctcttccacactagtacatgtataaaggcttttttctttcatggatacatagtatatcaccattggaaaatactacactttatttcattactctagatgttaaagttttaatgtccatgggagatatagctttgcactcataagaggtggggagctggaaccgagacacttgcataaagttagaattctcaaagtgccgtaccttcatgttatgaaggccagacctttggccagatgtggtggctcacgcctgcaatcccagcactttgggaggccgagacgagcggatcacttgaggtcaggaattcgagaccagcatggccaacatggtgaaaccccatctctactaaaaatacaaaaattagctgggctaattaactaattagctgggtggcacatgcctgtagtccgagctactcgggaggctgaggcaggaaaattgtttgaacctgggaagaggcggaggttgcagtgagccgagatcacgccactgcactctggcctgggttacacagcaagactccatctcaaacaaacaaacaaacaaacaaaaggcggccaaggccatttgactactgacccaaggaaaagacatggaagctcataactggtctggagcctggatggaaaaaataactctccagtttaaaaatcaaaacactaagtttatgccacatgaatttgaggagtgtgagttcacggtactctctggtgtgggattcctaagctgagaaatttcccataaaatttgatccagaatggcgacccccacctcaccctctggggtaccactgtttgcacatgcaaagttgttctgtaaggacactccttaaacccaaagtatatgagactcctgctaaacaacacaaatttgctgatggtgaactcacactaaaaaaaaacctacacgaggaagtacatcactatgaggggcaggcagcacataaaaagatcagggttaatattctaaggattacatatggtctctgttacgaactgcatcgtgtccctagcaaaattcatatgttgaagtcctaattccaggtacctcagaatgtaactgttcagtagttggagatagggtctttgcggaggcaaagttaaaatgagttcattcaatgagaacacttggacacaggaaggggaacatcacacaccagggcctgtcgtggggtgcggggagggagaaaggatagcattaggagatacacctaatgtaaatgatgagttaatggttgcagcacaccaacatggcacatatatacatatgtaacaaacttgcacgttgtgcacatgtaccctagaacgtaaagtataataataaaaaataaatgaataaaaaaataaaataaaataaaataaaataaaataaaatgcgttcattagagtgggccttaatccaatatgactgatatccttatgagaagaggagatgaggacagacacagagagaaggccctgtgcagacatagggagaagatgaccatcagcaagccaatcagagaggcctcgaaagaaaccatccccgccaacagcttgatttcaaactttctttaagaattgtgagaaaataaatttctggttttttttttttttttttttttgagatggagttttgctcttgttgcccaggctggagtgcaatggcatgatcttggctcaccacaacctccgcctcccaagttcaagcaattctcctgcctcagcctcccgagtagctcacaccagtaatcccagcactttgggaggccgaggtgggtggatcacttgaggtcaggagttcaagaccagcctggccaacatggtgaaactccatctctactaaaaatacaaaaattagccagacgtggcagcacgtgcctgtaatcccagctactcaggaggctgaggcatgagaattgcttgaacccgagaggtggaggttgcagtgagccaatatcacgccactgcagtccagcctgggcgatagagcaagactccatctcaaaataaataaataaaataaaataataattaaaaaaaataatcattgtgcacctgctactgaaatagtggatcttggtgatgattttcaaaggccactaaaactattaaagtcagtggttcccatccctggctgcacactggaattactggaaaggcttcataaaacacaattcgtgggtctcaccccaaagattttaatttaattggccaaagctgtggcccgtgcattgtgaggcttctttaaactccccaggtgattccaatgtgcagccaagattgagaactgtcacatcaggtgaaaagctggtgggaaactgtataagggagggagtgggggaatggagagccagctcatgctgacaatgcctgagtccccagatctgtctttatcagaaaagacagccagacagtatggatctcatgacatgcggcactagaagggacacagtgtgaagtttcctgtggaatcatccgagctgaatctcaccaagcttctattttgttcttttttggggggagggggcagggtctgtcacctagactggagtgcagtggtgtgatcatagctcactgcagccttgacctctcaaggctgaagggatcctcctgcctcagcctcccaagtagctgggactacaggcatgtgccaccatttccagataattttttaatgttttatagcaatggaggtctcactatgttgcccaggctggtctcaaactcctgggctcaagcaatcctcccaactcattctcccaaagtgctgggattacaggcataagccacctctccggaaccctcaccaggtttttaaggaaagaactttgaatgaattatcaagatacaaaagtgggaaatttctccatttctggttctcttgaaaaatcagatgatctagcaattctgggcttacattcccaaatggcccaatttgtggatgcggagtagcagctgacctctataggcagaaaaggacgagttccgtggctccacctcagcctatgaaccacctggccttcaaagccatctgaacttgagatccctgctgtaagggacgggctactgatatccacccacacatactgggctttccacgtctctcccacaacactctgttcttacctgccattgggtctgcacttggagacaacacaaaaatcaaaggcgcacagcagctggaatcattgtaggatccctggagatcgaacgtaggggcttcgatatacagctttcccatatgttcagcaatgaactcccggaccgctggcaccattttgtcaggccgcaaacatcgaaggatcaccatcttctccaatccttgagagaacttccaagacccagggagttgctcctcatggggccaggccgagtcatagatcagcttccattcacccaggttctgttccaaatgctccatcaggccatgcagtttgggtaaggcagatgcacggacaatctctgcccatgccttctcagacagccattggggagctggattggggtaggggttatccagtgcgatgcctccagtgagaaggaagtaccacacctcctccgtaatttccttcttctgtttcatgatgccgatggtcaggaggagagagaagagtagcttgtccttctcaaacagagaacggcacacgttgttgtagatgctcagggtgaaatggtcaatgatgtacttgatgcgcagattcagttcctcgctcttcgtgctgtgggtcaaggaatgcatgtagagatttatgaaccaagtcagggagtactggtacatcggctcgatgttggccaggtccgagatacaaaagaagatggtggcagaatgcacagccactggcttgtagcccatccgagtctcgtcaatctgcgtttctgtcatggaagcaactttctgtttctctgagatctcttcagatagcactttggaggaggacagaactttgatggcggtttcatcctccaggatgttacccttggacatggagagaacctccaagatcttatcttcaatttccttgagatgcttcttgttcttggcactttccacaatcaactggttctttttctcttccagctctggcttctccttcgcagccacgatgccaaggagttgatcttggagacccaagggggtgatcatgaagttgaggagacagaccttcacggcaacttctgggaggtaatgtggattcctcaaacgggttgtgatgtataacttaaaatccctggaatattcaatgatgttttcacccagcctcatgtactcaactccttgctgtttgaatgttgccttgagcaagataggttcgatagaagcatccagctcttctccaatgttttcaatcaagacaggggtgcctaactgcagcgcgttttccagcatcctcatgtagttgctatcagagaacttgatgacagccagtttattcgccttctccatgttcttaatccatttattggcctgcccgtgagggtcaatcattaaggcccagcgtctggaattggatacaatgatgccattgtcgatggagaaggagtcaacgggaagcccagcaatctgccaggcacggatttttatgggatcccctaacgtgtggctgagactgaagtcactgaagccagggatgaccttgtccttacattcagccaaccactgattttggcactggacccgataatccactgtaaaagcgcccaggtaagccacagttcctgaggacagcaacacgtcaccagtcagattagtatagcggatccccagctgtcgggcagcttcggtccatctgtccttctctcccccaagaccactgatcagtttctctgccctgaccagcttttgggagcagatttcaatgttttcctccaagtcctttttcttggtgttcatctcttcaaagtcgtcattcagggcctggagccgatctaccaccagcttcagctctgctcttttctggttcagcttctgcatctgtgcagccagcttcccctctgcctccctcagtcgctcccgtttgggagccaccaccttggccacgcgatcgtacacctccatggccctcacccacttgcacagaccctcgcaggccgacgatacatttttaatgacagctggctggaattccgggtgattgataaacctttcccggatccgcttcatggtcagtggggggatgttgtctttgtcatatgtcttaagactctccaagaatttcagatccccaagaatctttttggataccccccagtaatcttctatcatcttacctatttggaacaagaaacagagataatgtgttaagacattctggccaagacttaaaattctgcagtggttactgctggtatttgagaaaaaacaaaaacaaaaacatggtctgagaggcccagccaacctcatcaaccccatctctgccttgctccctaaacttgagttataaaggaccttccttcaattcctccatgaccccaagtgcttcttaccatgagccctttgcctatactgtaaatggcatctagctggctcctgaccagacctcaggcctcattttatttattcatttatttattttgagacagagtcttgcactgtcagccaggctagagttcagtggcacgatcttggctcactgcaaccttcgcctcctgggttcaagtgatcctcctgcctcagcctcccaaggagctgggactacaggcatgtgccaccatgcctggctaatttttgtatttttagtagagacagggttttaccatgttgaccaggctggtcttaaactcctgacctcatgtgatctgcctacctcggcctcccaaattgctaagattccaggcctgagccaccatgcccagccaattttttttttttttttttttttttttttttttttttttttgagatggagtctcacttttgctgcccaggctggagtgcaatggtgcgaccttggctcactgcaacctctgcctcctgggttcaagcgattctcctacctcagcctcccgagcagctgggattacaggcacccaccaccacacccggctaattttttgtacttttagtagagacggggtttcaccatgttggacaggctggtctcgaactcctgacctcaggtgatccacccacctcagcctcccaaagtgctgggattacaggtatgggccaccacgcccagctgtgcccagccaatctttgtattttttatagagatgaggtttcgccatgttgcccaggctggaggcctcgttttaaaagccattgccatatagaggtttccctagacttatctgacaagagaggcccccctccccgctgcaccagcattttctttcaccttgcttgctagaaagtccattccctttatagcacttattgcaacctgtaagttttcaattattatctaccatctacctttccctcaaagcggtaaacttcttctgttttctagaacctggcacactgcctggtacttagttatcaataaatatgggttgaatgaatagtaccccattatcttattcatggatggaaaaggcagcgggagccacagcccgtggggatgagtttcgaatatccttccctagtctgggaggtgggttggatggagcccaatcagtcctccctttgatgaactgtgtgagtgaggcaaaggtcttgtgagaatgaaggaggctggaagaagcagcttgcaggcttccacccatacagaagactacccgtggcctgcccagacacaaagccaggccgttattccccttagcagccatcatgctgactaacaagtaatcaagtgagtctcaatcccatcccggaacaatgctccttctgttgacacattggaaaaaatttgggaagctttttggcccatggtacttgccaagctcaggctcatcaaaaaagttatactctgagacatcacattgagtacagcaggtcaaatgtgtcccattcctaattacaagaggagaaatcagccaaatatttcccatgaaggtttttgttggcattctagaaaatgatctgcttcatttagattcaaggtaccccgaactaactcaattgctcttttgctccatctcaatatactcactcaattccatggtttgggtgaataacaggcataatttgctttaattttaatttaatgatgggttctgtgctgatcatcagtgatccaagatgagaagtgacattcatgacctggctgtgctttgtgtatctcagcaggtctcaaccccagctgcaggggagcttaaaaaaaatcctaatgctcaggctgcatcccagaccaatggaatgagactctctaggagtggggcacagacttctgctttttttttttttttttttttttttttgagacggagttttgttcttgttgcccaggctggagtgcaatggcgtggtctcggctcactgcaacttctgcctcccggattcaagcaattctccttcctcagccttccgtgtagctgggattaggcacacaccactatgcccagctaatttttttttttggtatttttagtagagacaggatttcaccatgttggccaggctggtcttgaactcctgacctcaggtgatcctcccatcttggcctcccaaagtgctgggattacaggagtgacccaccgcacctggccgacttctgcattctttaacctctccaggtgattctagggtgcagccagggtgcagaagtactatctagctcatctttgctcaaggccaacttattatacattagctatttccctaaaggatgctcttgtaacatctgctctttgcttgactattcctgatgagctttgcctctgctttatgtgagtttaggcctgacacccgccagagaagagggaatgctaagcaatgggaagcaggagccagaaggtctcaaatgagggatcagggatttctttcttgagacagggtctcactctgtcatacaagctaaagatcagtggcaggatcacggctcactgcagcctcaacctcccaggctcaagcgttcctctcttctcagcctcctgagcagctgggactacagacatgcgccagcatgcctggcgaaattttgcattttttgtagagatggggttttgtcatgttgtccaggctggtctcaaactcctgggctcaagtgatccacccacctcagcctcccaaagtgctgggattacaggtgtgagccactgcacctggatgggattagagcagagatctaacatttcagaaagaatgaaggaatagccagactgttcccaggactggaagactcaaaaggcaggaaatagatttggaggtgatttttaaagtcactgttcagctctaaggcactggtcttaatgcaaagtcctacacctaatttaaatttgaaggagaatgaatattcacctgttaatgtttctaggctcaactgtagaaggagctttccttcctccttccccattcctttctgcccgtttctaattctctgtatcctcctctttctctttctttgttcatctgtccctctctctctctttcttcctctccattgccgtctctgcctctctttgcccttgtctcctgcccatgtctctctccctctaattttccattccccactcctgctccaccccacccctcccccaactcctcttctctgtcttcgtgtgagtgtttttttctccctgtctctgtctctcttctctctggtctcttttcttcccactctgtctctctgtttctgtgtctctctttgtgtctctggcactccatgtgtctctgcatctctctgtctccatttctctgtcgctctctgcatatttgtctctcagtctctatttctacctgtttctctcccttcatgtcttactctctcctgtatgtctgcatctcacttgtgcatgcaagtctctccccatctgctttttctttctctgtgtgtgtgtgtgtgtgtgtgtgtgtgtgtgtgtttccctgtctctttctcccgatttccttctctcctggtccccctgtccctttgggtgtatatgcatgtgcatgcctgtatgtatgcatgtctgcaagtgtgttcgtgcatggctctgtgtgtgcatgtatgtctatatgtgcatgtctctgtgtgcatgcatgtgtgtgcatgtgtgtgtgtgtgtgcatgcatgcatgcgtgtataggtgtctgggtctccatttatttttcagactctttctctctgttcctttctttgtctctgtctcattcttttgctttccctaactctctttctctgcttctctctctctctctctctgtagctctcctggtcacccacacgtgactctgtgtttgttccacaccaagccttttgtctacctgaccttcatttttgtaatgacttgcagggagaagccttgactgagctcagctccacctacagatacctgcatttttcccaactgactgagagggcggaggccgctggagaagcctgagagaggccttgggtgcacacacacagcctggttcctttcttaattcctccaaactcagtgatcttgcctgcacgcctgcagtcgacttggggatgcagtgggtgctggcaccccactgccaggaaagagcagcctgtgcaggcatctgggtggggtggcacttaccggagccactggggtctggcttcctctctggcttcatccctttcatgatgcagatgctctccatgaccagtttgacagggcctggtgggttctgcatcgacttcaccagcgagatgtcggccgggttcagggtgtccagagcagctagtgcagcctcgagtgcaggcattgcctcagctaggtccccctcacattcgttctgtgggcggcatgaggacaaaggagatgagtgcccagggcctggcacaatgggggcgaagcagagctccactcctacatgaggaagaaggaagaggtgcttcctcttccagataccctttaacatggtgcctgccgctggagctggacaatggctctgaccgttaaccagcagccggaacacatgcatggccttttggggctgtggtctggatgtcccgaacatctgagcattcaacttatttgcttttttggccaggcacagtagctcatgcctgtaatcccagcactttgggaggccaacgtggtggatcacttgaggtcaggagttccagaccagtctggccaacatggcaaaaccctgtctctactaaaaatacaaaaattagccaggcgtggtggtgggcgcttgtaatctcagctactcaggaggctgaggtagaagaattgcctgaactggggaggcggaggttgcagtgagctgagattttgccattgcactccagcctggccgacaagagtgaaattgaaactctgtctaaaaacaaaaacaaaacaaaaatctcacataggcattgttaccacatttgtttctatgctaaaaacataatttaaaattgcccctgagtcttagcatgaaaagagcaatcggattgtttgagaggtatggagttcagtgcagtgtgacgaaatgtaatcagatcacagtaattttggtatcattgatcatcctcattaggggggaaagaaataattggaaagaattgaccaatgtaagcaaaccattgcgcttgtgaatcaagagttggtgacctgattcttgctcttccagtctttgtcttcccagtatggatttcttttcttttctctattctttttttttttttttttttgagacagagtctcgctctatcatccaggctggactgtagcagcggtgctatctcggctcactgcaacctctgcttcccgggttcaagtgattctcgcacttcaggctcccgagtagctgggactacaggtgcctaccaccaggtctgactaatttttgtatttttagtatagatggggtttcaccatgttggccaggctggtctcgaactcctgacctcaagtgatccgcccgcctcggcctcccaaagtgctgggattacaagcatgagcctctgtgctcagccgtacttctgagtttctaacaaatcactttttttttttcttttttggtaaagagcagggaactaactttgtctccatataaagaaacactaaaatttatgtttcttaaaggcaaattaggatcaaacagaaactcctaatatggatttcatttgcattcctactgtgcattcggtaccctactgggcactattccatcttgtgtcatttctgggagtgtgaggagattagagaaaattagcaacttctcctgggcaggagggccacagccctgaaaggtccaggaagggattccggtccacaaaaaagcctcaggaaagctgcacaatcagacaccggtttctcctcctccctgggtagtttcttccacttcctgactcatcccaggatgtcactccctggaagagggatgggatggcagagacttgagcctcaccctttgcaccgaaacctgatgtggcagttattgcctgggagtgggtgtagtggggcgtcctgggtcaccgccttacaaaccttgtgcgatcactcacctccctcctgctccaacaagtcgctgtttggcctgacattacagagcagaatcttggctgtgctgttttccttccctctgcgacccacatgtggaaaggggctagccttggtcacataggcaagtccccttggtatagagcaaagtacagcagttttgaagaatcactaacatagacccttacgctctggcacaggctacaaatgttacatgttttcctcttagtacccccattttgtagatgaagaaactgaagctaggaaaggacagagcaaaaattgagccctgatgtacctgattctagcacagaaacattaaagagttgccaattcatgcgcctcaggggccaggccagtgagtgcgagtgggtggggctgggactttggtgaattggaacacacaggggcagcatctatttaataccgaagatgagtgcaacccgggagggcagctccgatgttgccaggttgcccgatgttttccaaagaaaagctgaaaattcagaattgttacttgaaatctcctgatttttttttctctctttttttttttttgagataagatcttactccgttgtccaggctagagtgcagtggtgggatcatagctcactgcagctcctggaatgaagtgatcctcctgtctcaggctgctgagtagctaagaccgcaggtgtgctccactgcacctgaccaatttttttctttttagttttttgcagagaagagttttcactattgttacctgggctggtctgaaattcctccttgcctcaagccatcctcctgcctcagcctcccaaagcactgggattaaaggcatgacccatcatggctggcccattatcactgatggtttccattcacctcgtgtctattctaccaggactacaagtgaaaaagcatctgtaattcagggtattcattatgtgactctgacagggatcagacccacccaggggatctcccacaggccaggtctcaggactcagtggagaaaagccaatcaaaaaggcctgcccttctgagacaatgccccgtgattttttttttttttttttttttttggtcactcaggctggagtgcagtggcatgatgtcagctcactgcaacctctacctcccaggttcaagtgattcatgtgcttgggcctcctgaatagctgggattacaggtgcccaccaccacgcccggctaatttttattcttttagtagagacagggtttcaccatattggccaggctggtctccaactcctgacctaaagtgatgcacctgcctcagcctcctaaagtgttgggattacaggcgtgagccacctcgcccagctgccatgacctatttatgatagaagacacataggctgctttttaatcaagcccttgtttgaagaatggttgagagaattttctgttaagtgggggcataggttcaagtatgttaaggtaagtgccatgaaccttggcttctaatcccactaaccatgcagctctggaaagtcaatttaccactgaacctcaatgctgtcaactctcatatgcccatgtctgtcattcttttttttttctttttgagataaggtcttgctctgtcactgaggctggagtgcattggtgcgatctcaacgcactgtaacctctacctctcgggttcaagaaattctcccacctcagcctcctgagtagctgggattacaagcatgtgccaccacacccagctaatttttgtatttttagtagagataaggttttgtcatgttggcaaggctgttctcaaacacctgacctcaagtgatctgcccaccttggcctcctgaagtgctgggattacaggcatgagccacctttcccggccctatctgtcattctgaagtctcaaagtagttgtaatgctcaaatgtaaccatgtacttcaaagtgctttgtgaaatatacaacatcacatcagtgctaattgaagaagtagattttcttctactacgtgaacgtaggtcaagcccttaccaggactatttcctctctggcacaagaatcaccttcaagcgggtttcctctaggttccacattctgtcatccaacaaatatttattccacgcctacaacacgccaggcataatttagcaaaaatacaatggagacgaaggaaacagccatgtggatatcaaaaggaagggcattctgtgtagagggaacagccagttcttaggctctggggtgggagtgcggcttatgattatttaacaaatagctaggagaccaacatggccagagtacagggaatgaaggaaaagtggtaaaacatgaggtcaaaacatattgggtctttttgtttgtttgtttttgagactgggtcttgctctgtcacccaggctggagtgcagtggtgcgacctggacccactgtagcctcgacctcctgggctcaggaccctcccacctcagtctcctgagtagccgggaccataggtgcatgccaccacagctggctaatttttttttacattttttgtagagatggggtttgccatgttgcccaggctggtcttgaacttggctggtcttgaactccaggactcaagcaatccacccactcagcctcccaaagtactgggattacaggcatgagccactgcccctggccactttgttttgttttgttttgttttttagacaacacaaggtcttggtcagctactcgggaggctgaggtgggaggatcacttgagtccaagtgttcaaggctgcagtgagctatggattgcagtggcacgatcctagttcactacagcctcaaactcctgggctcaagcaatcctcccacatcagcctcctgagtagctgggactacatgggtgtgccactacacctggctgttttatagtgttttttttttttttttttttttgtagagacagaatcttgctacgtttcccaggctggtcttaaactccgaggctctggcgatcctcctgcctttgtctcccaaaaatctgggatcacaggtgtgagccaccacacctgcccatatgttgggtcttaatgcttcctggtttcagcgatgtttcagaacaacttccttcatcacttatcagctatgtgatgctgggagagtcgcctaccccttattattattattatttttttagagtttcactcttgccgcccaggctggagtgcagtggtgcaatctcagctcactgcgacctctgcctcccaggttcaagcaattcccctgcctcagcttcctgagtagctcggattacagatgcacgccaccacacctggctagtttttttttttttttttttttttaaagtagagatgaggtttctttatgttggtcaggctggtcttgaactcctaacctcaggtgatccacctcccttggtctcccaaagtgctgggattacagctgtgagccaccatgcccagccttgcctaccctttctgagcctcacttttctcatccgtaagatgggtataaccacgctcattcggcagcaccagttccctccctttcttctcagtctttctaccttgattccttgggcaatggcagcagcaacattggcttctttttcatctgcctgcaccagaagtttctttccatcagcttctctcgtctccgcttcaattttcaccatcatcttggcagtttcctcggaggtgaggatgagttgaggttgaagagctgtcagttctctttgcataaccgctacctagcaaggagagaggtgggagaaatccagggtcagcactgaaaatggcaaagtagacaagaattgaaatgattctccaacctatgacataagcagaaaatatgtactaatgattttgacatggtcctgggtacagattcgtttcctagtgattatctcataggtttttcaacacagttattgagtttacactctgcattgtggttatcaagcactgtgctaggcactagacatataattgtaaactaaaatcttttttaaaaaccgtttcctccctcactgagtctatattgtagtgttgggggtaatgggagagagacagagcaaaagcaagttaagacttttttttgacagagtctcactctgtcacccaggctggagtgcagtggcatgatcttggctcactgcaacctccaactcctgggttcaagcaattctcctgtctcagcctcccaagtagctgggactacagtcacacaccaccacgcctggctaatttttatatttttagtagagacgaagtttcaccatgttggtcaagctggtctagaactcctgacctcaggtgatccacccaccttagcctcccgaagtgctgggattacaggcatgagccaccacgcccggccaagaaatttttttttaaactacatttttttcttggcttgtaatcccagcaatttgggaggtagaggtgggagaattgcttgagcccagaagttcaagaccagcctgggaaacatagtgagaacaggtctctacaaaatttttttttaagttaaaatattttttctttttttgagatggagtctcactctatcacccaggctgtagtggtgagatctcagctcaatgcaacctctgcctcctgggttcaagcaattctcctgtctcagcctcccatgtggctgggattacaggcatgtgccaccacacccagctaatttttgtatttttagtagagatggggtttcaccatgttggccagactggtcttgaattcctgacctcaggtgatccacctgccttggcctcccaaagttctgggattacaggcatgagccactgtgcccagccaaaataattttttaaagctacatttttttcttaaaggctatgaagaaaaaagacagctgagatagaaggtactttcaaggctactttttccaatagtattgtggactaaatgtttgtgtcctcctcagatttatatgttgaagcataatccccaatttgatggcaattataggcgaggtctttgaagataattagagttagaagaggtcataagggtgaggcccacatgatggggtaaatgcccttatataataaaaagaggaagccacgtgagatctgtctcttcccactgtgtgaggacacagcaaaaaggcagccgtctgcaaaccagggaaagagcccccaccagacagtggatctgctagtgtcttgatcttgaacttcccagcctccagaactatgagaagtaaacgtttgttgttgaagccacccagtttgggatattttgctatggcagcccaagctgactaagacaaacagtctgatgctctataaaacattcctgccaagtagttttctggtctctgaactcctctaataacagggagcgcaccacctctcatgagggttgtgccattttttagacaattaaacccattaggccaggctcagtggttcacacctgtaatcccagcactttgggaggctgaggtgggcagatcacttgaggtctcaggaggtcgtgaccagcctgaccaacatggagaaaccctgtccctactaaaaacgcaaaaattagccaggcgctgtggcacgtgcctgtaatcccagctactcgggagactgaggcaggagaattgcttgaatgcgggaggtggaggttgcagtgagtcaagattgcaccactgcactccagcctgggtgatggaatgagactctgtcaaaacaaaaacaaaaacaaacaaacaaacaaaaaaccattagcttttcctgatgcagagctagaattacccccctgaagtttgcactcactggtcatgattctgccttttaaggcagctcagacaaacagggttgggtttcatgtatttggagacagttttcatgaccttgcacccaatgcccccagtgagcttgtgtgagaccacaagcacagcaggctggcctagttaggaacataggttttggagtcatgcagatctaagtttcagttctagctggaccactccccaggctgtgtgatcatgggcaagacacttggcctctctgtgtcctggcttctttgtgtatcacatggagatggtaacgatactttcttcacacacagcactagggatgcagtaggacccaagaaatgttaactggtgcaatcattttattttctggtctagactgtcttaggtccttttgctgttcctcagacacgaccgacctcacccttgctggacagacttcactttcaacatctctaaaaaccaaccactcaaatccccaggaacagagcaacagaggccatttccaatgttctctcccatccctgcattgcagtgtttgtgggtttgctgtacacagagccaagctctgtaaatcaatcaatgttctttggtctttattggggctgaaaatccatctcctagtacagctttcattttagataatttttcaggtggctctaagaacaaattaattaataactcatgtgccaggcattttgctaaaggctgcactgtgtcagcttacttcatcttcataacagccctatgcagtgaaaactgctaccacttagttttttcttcttttttaaagggacaaggtggccgggcgggtggctcatgcctgtaatcccagcactttgggaggccgaggtgagcagatcacctgaggtcaggagtttgagatcagactggccaacatggcaaaaccccgtctctactaaaaatacaaaaattagctgggcgtggtggcacgcacctgtagtaccagctatttgggatgctgagacaggaggatcacttgaacccaggaggtagaggttgcagtgagctgagattgcgccactgagttccagcctcagtaagagagagattgcgtctcgaaagaaataattataataaaataaagagacaaagtctcactctgttaccccgctgcagtgcagtggtacgatcatagctcactgcagcctcaaactcctgggctcaagtgatcctcccacctcagcctcccaagtagttgagactacaggcacatgtcactgcacttggctaattttattttatttatttttttgtagagatggggtcttgctgtgtttcccaggctggtctcaagcgatctcttggcctcaactgatcctcccggctttgacctcccaaatgctgggattacagacgtgagccactgcactgggccttcacctttttatagaagaggaatctgaggctcaaagaagtgaaataacatgcccctggctctacagctggtatgctgtagagataaatttgggcccagatctgactccacaaagatatcttgaatgattcactgccttatcctgcccaggtccccataaggtgagacaagggaggcactcaccttgaggacaaaacttaaggggtcattaaaaaaaaagtactcaagataaataatacattattgcaatagattaagaaatcaaaattaatgcaaaaaacccatgatgaacaaaatatcaaaatcttaaagacaggatcccacagggcagggattacagtgatgtaggtaaggtaagctctgcaaatgcagggtcacattctgcttgatctggtgtcctcttaattccgcacctgaacacatgcctcggcacatccacctcgtcccgggcctctttgtctctgttctgttttggcagtgctcacctgagaagctgcaaagtcgagtttctgcaagcctgtcaggtagcggttcctcatcatagccacctcttgcctcttgctattcaggagcgtcttgaaggttagaatcaattcaaggtaggaggtgggggtaacatagttgtgtcttcgaagtttgttgtaataatcgagtgacagcttcttgacgctctcttggaaatatttgcacatggacacgaccctgccgaggacaccaaggcggttaggcaggacccaacatcttccagggagatccagtacagctttagttatagacatgaggatatgagaaggcacatacactgactgtgacacgttagaatccaaactctctgaggacatgtcaacagagctgaggcagagaaggatggggcaggtacataggtgcatactctcacacaaatgattttatatttatttattgagacagtgtctctctctgacacccaggctggagtgcagtggcgcgatctcagctcgctgcaacctctgcctcccaggctcaagtgattttcctgcttcagcctcccgagtagctgggattacaggcatgtgccaccacgcccagctaatttttctattttcagtagaggcagagtttcaccatgttggtcaggctagtctgaaactcctgacctcaggtgatctgcccaccttggcctcccaaagtgctgggattacaggcatgagccaccacgcccagccacaaatggtctttgatcaagtcatttctatcactgatccctttgatgaatcaccagggcttaagcaggaattcctaaactttggtagtttggagatattccctgactttgtagaaaaaaaaatatatatatatatatataattttattatatatttatttatattatttatattatttatttatattatatatataatatacatcatatattatattataatatacatcatatattataatatacatcatatattatattatatattataatatatactatattatattttattatatttatttatatataaatatatatatatgtggggggggagagagagagacaggattgcactctgtcatccaggctggagtgcagtggcacaatcatggctcactgtagccttaacctccctggctcaagtgatcctcccacctcagcctcctgagtagctgaagtctcaggcacacaccaccacacccagctaatcttctgcacttttagtagagatggtggggggtggggtaggggttgctatgttgcccaggctagtctggaattctcgacctcaagtgatccaccagccttggcctcccaaagtgctgggattataggcatgaaacaccatgcccagccaatttttaaaaatgcataaaataaaacacagaattaccatggaaaccaattatattgaaatagactttttgaaatgttttaaaatattttaaaatttgtaatatagtaatatacatgctgctttactgaggcattaaatcagggattagtaaaccttttctggaaagggtcagataataaatattttagcctttgtggaccacatgatatctgtcacagttactcaactctgccattttagtgcaaaaacagccacagatggtgtgtaaactaatgggcatgcgtgcattccaataaaactttatttacaaaagcagggtgaattcaactaggcccatgaaccatagtttgtcagcttctgcattaaataacaagagtgggcagcaggtctaaaaagcaccatcaattcgaagaaaattatacactgagttaactgtaatgatgcaatgagttctgcaaagaactgattcctactggtaacaaagtcaggccctgctcatcccactggggtttactgcctacattcataactggaggaaatgcaaagtaccagttggatgtcattggaaatgaagatgtaatgtttcccattcatattcatccacccactgaattctacccacaagcacgtggacccaggttaagggtcttctggtctagataataaagttcaaaataccccaaatggaatttaaggccattgacactcttacccctacctacttcctcatttttcatccattaattcaacaaacagtgattgagcctgggtgcggtggctcacgcctgtaatcccagcactttgggaggccgaggtgggcaaatcacttaaggtcagttgagcctggccaacatggtgaaacccagtgtccactaaaaatccaaaaattagctgggcatggaggctcacacctgtaatctcagctactcgggaggctgaggcacaagaatcgcattaacccgggaggcggaggttgctgtgagccgagatcgcaccactgcactccaacctgggcgacagagtgagactccatctcaaaataaatagataaataaataaataaataaaataaacaatgattgaacctactgtgtgccaagcaccttctagaaactaaggaaacagaggtagacaaggttgactgatctctagccttcatggaacatccagaatgactgatattctcacctcttcccttactctagccaaataaaatgctttttttatatatgtatgcatatatacatacataaagtgtataaagcacatatattatatataataaagcatatatataaagcacatatataatatataatatatataattaagtatatatatataataaagcacatatatatatgtgctttatacataaaagagtaaattttcacccttataggaactaatttttgccaggtgcagtagctcacacctgtattcccagcactttgggaggccaaggcgggcagattacgtgaggtcaggagttcgagaccaccctggccaacatggcgaaaccccatatctagtaaaaatataaaaattagctggacgtgatggcaggtgcctgtaatcccagctgcttgggggaggctgaggcatgagaatcacttgaatctgggaggcagaggttgctgtgagctgagattgcaccaaggaactccagcctgggggatagagcaagactccatctcaaaaacaaataaacaaacaaacattgttttgtggtctcagcagcaatcttcttcctgttgagaatgcatattctaggactactgaaatagctatatcattattccaggttctcatagctaggacaaatctccaggacaattctgaacaatgaaattttcttcttttacagacaagatgctttattaaatatctaactaactgtgattcaatttaaaagcataagacatttgctatatacaaattgagaaatcttcaaaacaacaacaaaaatagagccagcgtctggacttcaaatttggaatatctagagtcctaaaatgcaatcaacacttactctacccgaatgttgtcatcaagctccacatcctctagaaatttgttagccaccaactctagggcatctgtgggccaggactggaaccaatcaatcgtacagcaattgatcagcgaagggaacatccgcaggcggttcctgaaggcatcccctattggactcatggctaatgaaaaggagattttgttaattaccttcctccaaggcaggtggacccaaggaggcaggcgggtattcccaaggattctggtggggtaagtgggggcaggcttcctcctggcgctccagggatgtgactgtcaatggccataatgagtgcctgggaaatgcgggctaattagtgggatattttcacttaactttgtgaggagcccattacaatagcccctttttaaaaaaaattttaattttttattttttattaagacagattcttgctctgtcacccagactggagtgcagtggcgcaatctcggctcactgcaacctccgcctcctgggttcaagctattctcctgcctcagcttcctgagtagctgggactataggcacccaccaccacttccagctaatttttgtatttttagtagagacggggtttcaccattttggccaggctggtctcaaactcctgacctcaagtgatctgcccgcctcagcctcccaaagtgctgggattacaggcgtgagccaccatgcctgagtctattaccttctaactggtctcccatacacactattgttccttccgcatccttcgggtcacgtagccagtgtggctggagccctttgattgacttgctgtatttgtgctgatacacgggagccatacactgttatttatagaagttgctgtgaggtcatctgcttgtttctgatcccatctctggccaataacaaattttgggttccacacttaaaattccattcattgttatttagactatgtgtggtggaagggagcatgatgtctaggtggaagtgaaaggtcactgtgggtaaagaacagaggcctggcacagtggctcacgtctgtaatcccaacactttgggaggccaaggcaggaggatcatttgagcccaggagtttcagaccaacctgggcaacaaagtgaaccccacatccccgtcccctatctctacaaaaatggaaaaaattagctgggcatcgtggtgtgtgcctgtagtcccatgtactcaggaggctgaggtgagaggatcacttgagcccaggaagttgagcctgcagtgagctagaaccacatcactgcactccagcctgggtgacagagcaagaccctatatccagaaaaaaaaaaaaaaaagacagaaagggcgatggtttgaaaagatgaaggtggagaggatacagaggacagtctggcaggtggccttatggcattatgagaccgcaggttagtaattttggtccttatcccaatgtgtgtgtgtgtgtgtgtatatgtgtgcacgtgtgcgcatgcgtgcgtgtgtgtgtgtgtgtatgcatgcatgaacacaatgataatatttgcagcatatgaaaaaaatcagcctggcttcatggaacagacaagaatggagctagaatgattagaaagttgcagaggtgagcctgggtaaaaggatggcagcttagccaatgtgaaggtgatggagatggagataagagagtggatatgagacagctggaggtaacagacaggacttggtaaagaaagggaagtactaaacacaattgctaggtttctagatacattggaaatgtcgttcacagagaaaacccgagatgtcattctgtgcaagggtaattctcagaggagaattcaggaaattgaagacgggggacaggtttgaaattattcagggtccggcacggtggcttatgcctgtaatcccagcacttcgggaggccgaggcgggcagatcacttgaagccaggagtatgagactagcctggccaacatggtgaaacccctctctactaaaaatacaaaaattagcaggtgtggtacgcgcctgcaatcacagctactcaggaggctgaggcaccagaatcgcttgaaactgggaggcagaggttgcagtgagctgagatctcaccactgcactccagcctgggcaacagagcaagactgtctttaaaaaaaaaattgctgctcagaagagtgaaaaaagttgccagaggaactccgggccctgaccccgagctggtgcgttggctgaatcaaccctgggaccattgtaagggattggcctgctcagggcactcagaagaccccaaaacacccagaagaacaagggcaaatggagttttcttcttcttaccgaggacaatgtgaaggttctttctcaccctctcaataaagaagttatacatagaaagaggagtgacttcaaccttctctccttgggtcctggctgcagtctgcatcttctccacgatgtcagccttctcgtcagcagggaagatgttaggcacgtcacctgtgttcagaagcatgttgatgtcctccacgaatgattcatccttgatctggttgtcggcgaagaggaacacggtgctcttggtggccacaccgacctgcagtatgatcttcttaagatcttctcgccagtcattgcctgcgtagttcttggtgatctcaatctggtatagctcgtatgcgttcatgaatgtggacagtttggcggcactttgccgcccgctgccccctatgcccaccaggagcaggtggcctttgtcctgcttcaggacacggcagatcctagagatgtgctcaatggcaaacctgaacatgaccagggacatgggggccttgctgatgttgttgaattcttccagatagtgctccatgaccacagtcagctgtttcaggtcagtgatctcatcgtagattttttggtcactttctggcttgaaataatctccaaagaagaggcttcgaatgttatcatcgactatctttccagtgggtgacaagtggataagcacctgtaagaaaagtaaatctcggcggggcattcagtgaatggcccagccaggctggtagggacatcatggagggagggcatgggagacgtggcttatttcctctgagcacatccttcaaggtcatgggtcatcagttttgttttgtttcgttttgttttgagacagagtctcactctgtcgcccaggctggggtgcaatggtgtgatctcggttcactgcaacctctgcctcctgggttcaagcgattctcccgcctcagcctcccaaatagctgggattacaagcacccaccatcatgcctggctaatttttgtatttttgtagagatggagtttcatcatgttggccaggctggtcctgaaactcctgatatcaggttacctgcccacctcgtcctcccaaagtgctgggattacaggcatgagccactgtgcccggcccagtctttttgttttttaaacataatatgtggatttcatgcttgtaaagactataatgaaagaacattgctgggcacggtggctcatgcctgtagtcccagcactttgggaggccgaggcagaaggatcatttgagctcaggacttcaagaccagcctgggcaacatagtgagactcagtctctacaataaaataagaaaaaattaactgggcatcgtggtgcacacctgtaatcccagctactcaggaggccgaggtggaggactgcttgagcccaggagcttgaggctgcagtgtgctatgatcataccattgcactccagcctgggtgacagagtgaggtcctacctctaaaaataaatattttttttgttaaaagaaaggacattagagtatgaacgctttaatcagtctatttgccatgtgattaaaacattggtgatcagtttgtacggtccccagaaaagacagttgaaggatgtgcttttcttaggtgcttgatcctccaccaaatagaagtatagacactatcctggtccccactctgtgcctggagtaggaacgttttagatgcctcctcgtcctatgttagaacccagtgacgcttttgcacttggcctctgaacgcaagataaaacacttgaaatttttctatggagaaatcacagcttcttagcagtggaagaataaccagatgataaaaatatagatgtttaaaacaacttttcttatatggaaatggaaaagagaaaatattcacacctggaaaaccataacaatctttcacttgagctttataggacctcagtcaaatcatgacaatgtacagttcatttctcaactcaccaattaattgatcctaaaaatgcattttaagttcataataaacattcatttataatgaacttaaaatgcatgttaagccattttgagtggattcaaacttatatgttacaacagaagggaagcaaagttggaccaagtaaaatatcaccaagtcaaaaagagcagttgactcaatactgtttcccgagattcagagtgcagagctggcagtctccaacaggaagggaacctgaaatctgaaagtaacgtggttaaacacttggaaccatttctgaggtcaaatgatcacagaatctggtttaccttctctatggtctgcttgaagcaattggaggtggtttccttcaccatgttgaaaaagacctgtctgtcctccttgtcaatcagacgatcatagaagacccgataaacctcatggatccaaagccggatacatttttctacatcctaaaaatccagagttaattattcaaacgagtggaagatggtccctgaggtggtagttctcagtagtaggtaagtcctggggttgatttgaggattgaactagataatgtttataaaatgcttagcacaatgcctagcatagactaagtgcctaataaaagttagctattactgctattactacatgttctatgtagccaaggatatgctgaatgatcttggtagtaaaatgatagtggctgacctgcaggtgtgtgtgagggcacagcaggaccccttgaatcactcgtgagaagtcccgcaggttaaagacgtaatgtgacttcgagggagttggcaagaagttctccactgcatctctataaattgtcttagtagcttggaccagcatctttccgtaccttgggaggaaagggatggcacagtagtcaaggaggggccagaaactgagaacccccagcccactatccaggaagacagagaaacctcttaccttaaaaacatcacatcaaaccctttcccgaagtgccagtcaacaatcgaactgaaaatcttggttaaaatgtcatcctcaaaggcattgatggaaatgatattcagatggcgagtgaatcgtcctggggaatacaacacacaagtgaatcatcctggaaaacacatattctcacactgtctgtgaccctaggatgcacacgaggtggctttgccttctgccttcatgttccagagctgtgctgtgcaatatggcaacctctagccacctgcagcaaatttaaacttaaattaattaatattaaataacattaaaaatgctcttccttagtctcaccacacttcaagtgctcaagagccacatgtggctagtggctaccgtattgctcagtacagatatagagcatctccatactgcggaagttctactgagtgctagtttagtgctcattattatatcatatcatgttgtattatattacattactttttgagatggagttcccctctgttgcccaggctggagtgcagtggtgccatctcagttcactgcaacctccgcctcccgggctcaagagattctccagcctcagcctccagagtagctgggactacaggcctcccagagtgctgtgattgcaggcatgagacaccgcgcccagcctcaagaatgtttttaaaagataaaggcaatacatgatcattgtaaaagagtctatcaattcaggaatacttttgttgaaagtgaaaatctccttttgtgtccggaattggtgggttcttagtctcactgacttcaaaaatgaagccgcgacccctcgcggtgagtgttacagctcttaaggtggcgcgtctggaggttgttccttctgatgttcgaatgtgttcggagttttttccttctggtgggttcgtcatctcgctggctcaggagtgaagctgcagaccttcgcggtgagtgttacagctcttaaggcggcatgtctggagttattcgttcctcccggtggactcgtggtctcgctggcttcaagagtgaagttgcagactttcgcggggagtgttacagctcataaaagcagtgtggacccacagagtgagcaccagtaagatttactgcaaagagcgaaagaacaaagcttccacagtgcggaaagagacccgagcgggttaccactgctggctcgggcagcctgcttttattctcttatctggccccacccacatcctgctgattggtagagccgagtggtctgttttgacagggtgctgattggtgcatttacaatccctgagctagatacaaaggttctcctcgtccccatcagattagttagatacagagcatctacacaaaggttctccaaggccccaccagagcagctagatacagagtgttgattggtgcactcacaaaccttgagctaaacacagggtgctgattggtgtgtttacaatccttgagctagacataaagtttttccaaggccccaccagagcagctagatacagagtgtcgattggtgcactcacaaaccttcagctaaacacagggtgctgattggtgtgtttacaatccctgagctagacataaaggttctccaagtccccaccagactcaggagcccagctggcttcacctagtggatcccgcaccggggctgcaggtggagctgcctgccagtcccgggcggtacgctcgcactcctcagcctttgggtggtcgatgggactgggcgccgtggagcagggggtggtgctcgtcggggaggcttgggccgcacagagcccatggagtgggtgggaggctcaggcatggcgggctgcaggtcccaagccctgccccgcggcaaggcagctaaggctcagtgagaaatcgagcgcagcaccggtgggctggcactgctgggggacccagtacaccctccgcagccgctggccgggtgctaagtccctcattgcccggggccggcagggccggccggctgctccgagtgcggggcccgccaagcccacgcccacccggaactccagctggcctgcaagcgccgcgcgcagccccggttcccactcgcgcctctccctccacacctccctgcaagctgagggagtgggctccggccttgcccagcccagaaaggggctcccatagtgcagcggtgggctgaagggctcctcaagtgccgccaaagtgggagcccaggcagaggaggcgcccagagcgagccagggctgtgaggacttgccagcacgctgtcacctctcactttcacttaccttatacgcgccaaatccattctcccctgctaatttggtatccttatatcatctatctgtctaatctatcatctatcatctttctgtgtatctatagatctatgtatctgtctaatctataattgttagatatctgtatttatttatatagatatataccagctttattgatatcccaataataactcacatattgtaccattcacccatttaaagtacaattattcaatgatttttaatatattcagggttgtgcaaccattatcacaattttagaacattttaatcgtgctaaaaagaaaccttgtacccattagcagtcattccccattttcccatggttctcagcaactaataatctactttctgtctctataggtttgcctgtatatctttaaaacatttttttgttacaggtaaaagatacagaaaaccacacaaaacaaatgtatagtttagtaaatcattataaggttaacactcttagcatctactgtcaagattaagaaatagaattttgccagccaggtgtggtggctcactcctgtaatcccagcactttgggaggccgaggcgtgcagatcacgaggtcaagagatcgagaccagcctggccagcatggtgaaacccccatctctattaaaaatacaaaaattagccaggcgtggtagcgggcacctgtagtcccaactactcgggaggttgaggcaggagaattgcttgaatccgggaggcagaggttacagtgagccgagattgtgccactgcactccagcctgagcgacagagcgagactctgtctcaaaacaaacaaacaaaaaacaaaacaaaacaaaaacaaaatagaattttgccagccctccacaaaagcctctcgacagagcccatcctaaactgtctccttttcttcctccaaaagttatcactcttctgacttttatagtaattgctgtcttgcatttctttatgatttttaccatccaagtgtttatttgtagacaccagggtttaattgtttaattctgccagttaaaacaaccacatgcctttttttttttcttttctgagatggagcctcactcccattgcacagtctagagtgcagtggcacgatctcggctcacagcaacctccacctcccaggttcaagtgattctccttcctcaaccccaagtagctgggattacaggcatgcaccaccatgactggctaatttttgtatttttagtagagatggggttttgccatattggccaggctggtctcaaactcctgacctcaggtgattcacccgcctcggcctcccaaagtgctaggattacagacgtgagcctctgcacctggcctcatatgtatttcttaaggtctctttttaatttatagttttttccctccattcctttcttacgtgtcttatccgttgaagatctgggctgtttgacttgtagagttttcacagtcaggattttgttgattacatacttatgatgcagtttatcacgttcctctgtcctctgtatttcctacaaatttgtagctggatccagagacttgttgggattcagattccatccctttggccagaccataggtggtggtgtgttctttcattggaaagtactcaataatgtttctccttttgtaatgttggtagctactgatgctcaatggctacatccattaattcactggggtttgcaaagtggtaatattctgagtcacttctttttcatctattagttgcaatattttcatgagatacttcccctcatcaaccactatttggttatacagtggtacatttcatacaagaaagtcagggtgtcagagaatgcctgattctttcccatttacttatcagtttccaagataacgagttggttccttatcattttctgtaggtgaccaactattattattgttatagactcatggattaaaatatatttagataaatttcaatccattgaaatcactaccattgttgaagcttaaattttctcatctttggtgagtgaaagcctctttatgttgacaaccaagtccttttgatgtgagtccggtaatctttgatagctttctcattatctggtatatcaagactttacaggcttatttcatatatttatttttatttttattttttgagatggagtcttgctctgtcacccaggctgtagtgcagtggtgggatctcggctcactgcaagctccgcctcccgggttcacgccattctcccgcctcagcctccccagcagctgggactgcaggcgcacaccgccaagcccggctaatttttttgtatttttagtagagacggggtttcaccgtgttagccaggtcgatctcctgacctcgtgatctgcctgcctcagcctcccaaagtgctgggattacaggcgtgagccaccgctcctggcctatttcatatatttcttaccccagcagacatgcaatcagccatttctttaagatgtcttggtttctttcagcaggaaattggatttcaagactacaatctgagtagtagacatgttcattgttaataaggtggtcattatttctttagatcttttcagtggacattaaacatcaagttcaaatttaggactataaaacttttgcctaacttctttttttagtttttgttgttgattcattcgttgagacagagtctcactttgttgcccaggctggagcgtagtggtgtggtctcagctcactgcaacctttaccacccaggttcaagcaattctcatgtttcagcctcctgagtagctgggactacaggcttgcaccaccatgcctgtctaatttttgtatttttagtagaggcagggtttcaccatgttggccaggctggtctcaaactcctggcctcaagcgatccaccctcctcggcctcccaaagtgctgggtttacaggtatgagccactgcccccagccctaacttcctatgtattacatcttgacctccttttttccaccccaagactcttggttctcaaaaactcaagggataagataaatagaaaattctacgttttcaactgttctatatctacatcatcaaataatatactctttacataatatcacctctccatttagtcttagttcaacaaataaccatatatttaatgcttactactagttatatcagtctctccacagtcattttgattacctgaaatccattttctaggagattcctgagaaatggcttaaaaaaataatagtctctgagtttgtgcatgttgataacaattttcctttaatacttgaagattaatttttctggctataaaatcctcaactctcattttatttccttaagtatcttaaatgtgttattccattttcttctggtattaagcattgctactgaaaacacttaaagttgatctaactttatttcccatataagttgtgtgctatttttgtctagctgcccaaaagtttttttctttttttaaatttttgagacagggtcttgctctgtcgccctggttgcagtgcagtggtgtaatcatagctcaccgcagccttgacctccctgcctcaagcgatcctcccaccttagcctcctgagtagctgggactacaggcacatgccacaacacctggctaatttatttttcttgaaagcccactcttttatgctgtttattagcgtatgccttggtagtgatcattttgagtcaatattcttaggtatacaatgtgctcttccagtatgtaattctcaaaatgtttttttcttattttattggattatatattttgtattatttcttctatttctttattttgattttcttattcagatacttcagacacttcatgttggattttctttgtaacttcaatatttgtcattttctctcaaatccttttaatccttttcttcatttcttttttaaaaaatggcctggcgcagtggctcacgcctgtaatcccagtactttgggaggccgaggtgggtggatcacctgagatccagagtttgagaccagcctggctaacaggatgaaaccccgtctctactaaaaatacaaaaaaattagccgggcattgtggtgggtgcctgtaatcccggctacttagggaactgaggcaagagaatcacttgaacccggaggcggaggttgcagtgagctgagatcatgccattgcactccagcctgggcgacaagagcgagactctgtctcaaaatataaattaattaattaaataaaaaaataaaaagtttttattgtgataaaatatatgtaacataaaattggccattttaaccatttttaagtgtacggttcagaggcatcaagcacattcacgttgtcgtgcaaccatctccaccattcatctacagaactttcatcttcccaaactaaaaatcattcattcattcaacattcactcctcaatctcccctccctccagactttgacaaccacttattctactttttgtctctgtcaatttgactactttgagtacctcgtataagtggaatcatacagtatttgcctttttgtgaatggtttatttcacttaatgatatggtttatttcacttaaagacaataacatctttaagtttcatccatgttgtaacatgtctttttttttaaaaaaatcctccttttattattattttttcctacagcattatttgccgtgtttattctttcttgtgttcctcctagtttttggtttcatttttcttctcttttttttagagacagggtctcacccaggttggagtattgtggtgcgatcttggctcactgaagctttgacctcccaaggttcaagcgatcctcctgcctcagccccctaagtagctgggactacaggtgcatgccaccatacccagataattttttgttgttgttgtattttttgtagagatggtgtttcgccaagttgcccaggctggtctcaaattcctgacctcaagtaatctgcccgctttggcatcccaaaatgctgggattacagccgtgagccagagcccggccttttctttctttttttgagacagagtctcacgcaggctggagtgcaatggtgcaatcttggctcactgcaacctctgcctcccaggttcaagcaattcttgtgcttctgcctcccaggttcaagcaattcttgtgcttcagcctcccgggtagctgggataacaggtgtgcatcatgcccggctaatttttgtatttttagtagagatggggtttcgccatcttggccaggctggtctcgaactcctggcctcttgagatctgcccactttggcctcccaaagtgttgagattataggcatgagccactgcgcccagactctcttggtttcttatatgttcaaaaatatagtgagttgctttctgaaaatttccgccttttttccctctctctcttttatttggaccttctctttgctttgtttctattcatcttaaccttctccattctgattcagctaccagcaatttctcttcaatatagggtcctgccttggaaggggacacctgactggtcagttttgagaaatcacgggggctagcatccccttcagagctcaccatgggctgggtcactgcagtcactagtttcagcaggtgaaaaccctgtaaacttcagcttctcctctcacatgggccagcacactttgcagtgcaaacctgctgactagcttttggttcttcctctcaggtccattccttcccgctgcgttctcctgcacaggtgcagataattgcacgtcttgcagctgtcagtggtttgctgtcacccaatttgtattttggaatctgtggggataccttgcaaactagctttgttgtaagtgttgtttatagctttctggttttgctacctagttgctctgtttttatgtgacgatttgggaagatctgaaaactgtgcagcctttgtggctgccatttccctgaaattctttccatagttttttatacatacatgtgttaaaaatcatgtagataatataatacatatatatgtagctagcatgtgtatataccatctacacacacacatactgatacgtgtagatttttctctacattaaattatatgttgttgatctggaactattggtagctatgtgaacttaaccttttgatgatagggataacagtagttaaggtttattaatgcctgctttgggttactcaaccccagacctgtgtcagctgccaaaccatgctctcagctaccatccttaacttttttttttgagacagagtctcattctgttgcccaggctggagtgcagtggtgccatctcggctcactgcaacctctgcctcttgggttcaagcgattgtcctgcctcagcctcccaagtagctggactacaggcacaagccaccaagcccagctaatttttttatttttagtagagatagggttttgccatgttggccagggtagtctcgaactcctggcctcaagcgatctacccgcttcggcctcccaaagtgctgagattacaggtatgagccactgcacccactcagtatgaagattcttaaccaataatgtatatcagaatagaagtacagatctataggactgggtggatcaagttgcacgtgaagcaatatatccactgattatttatttgctatttttattgttattaattttgcttagggcactttgggttaggcattctgtctctggcaacctaaagaattataacgaatacaatggatgactgtcatgcacccctagttgaggcttctggatggagcctccctcccggaacacatgctggccacactgaactctccttttcctatgagactctctgtttctctagggcctagccaaacactcctcacatcttcttgccatcgtccccttctatttcacacaatttccaacatgaagcctgtagcctacacatgcttctgctccatgctcctgccacgtggtttggcaggacagactgtggcacaccaacccacctttcataaaggtggcccagctctgctggggatggagggaaagaggaatgagctcttcccttcacataccagtaatgtcattccttcctcccccggggggccccatggctgtcacgagcagcatgtccacgatgtccagcctggttgtgtcttttttgtcaaaccagtaaccatggtcaatccactgcctcaggagctcgatgggtggctgggccccatacacctctttggctggcatgttgaggtcatctggggaaagaaaccacagatacagccattgcaagttcatggcatcttctgctcttacagaggtaacagatggcaattcccctgtaggggaatctgttcccaggtttccattccccattccagttagggcttagtcaatggatgccctgaccagattggaaggggttttcctgagttctgggctctcctgcctcattgagatctctgtccacgtgactataaggatgcatagactgacattaacaaactggcttggccgggcatggtggctcatgcctataatcccagcactgtgggaggccgaggcaggcagattgcttgagctcaggagttcgagaccagcctgtgcaacatggcgaaaccctgtctccataaaaaaaaaaaaaaaaaaaaaaaattagtcaggcatggtggcttatgtctgtggtcccatactcaggaggctaagatgaaaggattgtttgagcctcggaggcagaggttgcagtgagccaagattgtgccactgcactccatccagcctgggcaacagagtgagaccctgcctcaaaaagaaaatagaaaagacgagaaaaacaaaaagaaaacaggcatttaattttttcccatttctgtcaagcaaaatagattgtctactatgtgctagacattttgttaattcctccccatatgatggcaacagtcaagctcccagcaaatagagtatttaatttgaccagcaggtaatagttgaacttcaatgggagcaacagatgatgagaccctaggccttgagctggagttttttgtttgtttgttttgtttttgtttttgagacagtcttgctctgtcacccaggctggagtgcagaggtgtgatctcagctcactgcaactttgtctcccaggttcaagtggtcctcctgcctcagcctccaagtagctgcgactacaggtgtgcaccaccacgcccagctaatttttgtatttttagtagagacggggtttcaccatgttggcctggctggtctcaaactcctgacctcaggtgatccacctgcctcagcctcccaaaatgctgggattacaggcgtgagccaccacacccagcctgagctggggtttttgatgagaaaaccaaaatgacaagaatatattaagacttcccgaagggcagggactcattttccccagtagtatattactcagtcctggcacatcagaggcactcaatgaaatgggggctcttcgagatcgcaccactgcactccagcctgggggacaaagcaagactccgtctcaaaaaaaaaaaaaaaaaaaaaaggggggggctcctttagtttttcttcaacaaacaattgtttgaatgcccagtttgtgtggggtaacattttaggagctttatatacattatctcatataatccgataataactttataaggaagatagtattaactctatgttaaagatgaggaactgagggtcagggacgttaactcacaatatacctagggttaaaaagtaagctttgaagttgggcatggtggttcacacctgtaatcccaacactttgggaggccaaggcgggaagatcacttgaggccaggagttcgaccacctgggtaacaaagcaagacccccgtctctacaaagaatggaaaaattagccaagagtggtggcatgtgcctgtagtcccagcttcttgggaggctgaggtagtaggatcacttgggcccaggagttggaggctgcagtgagctgtgattgtgccactgcactccagcctgggtaacagagtgagacattctctctctcaaaaaagtaagatttgaaaccagatctgtttggctgcaaagcttaccctgtttttgaatataccataaaaatagggagggagagcaagatggagaaaaggagaaaaagaggaagagaaaaggaatgtaaaataaaataggacccctgcctctgaggggctgttagttggcaaggacatgaactcaggcaatatttcctctgaatacatgagttttaaaggcatatcctgaaataatccagaagtgtggggcattactattgctagatgagaacgctacgtgtcaacagcaagatagtggaaaatataatgtatttggcaccaaaaagcctgggtctgggtcacagctccagaatgttctagatatttgatctcaaacaggaaatttaaccttctggagcctcaatgcactgactagtaaaatgacaatgatggttaataagctcacagggttgtggggctcaagtgaccgaagtgaggaaacgctttgtaaatagttacagtcctgggaaaattcactgtgcttatttcacaaatgtttggcaagtattaggttcctccatttagtgataacacatttatctgacagaaaatggaataaggggtttatcacaaggtgtgtgttgcttttggaaatgccagcgggcaaacagcacagcccccttctgaaattactacttccactacaaggaagagaggaaggaaagaaagaaggaaggaaggagaaaaggaggaaagaaggaaggaaggagaaaaggagggaagaaggaaaggagggagggagggagggaaggaggaaggagaaaaagaagaggagagaatgaatactaagctatattaactggaaatatttgatctcccagggagagtaaaggtatgtacagtggcaccacaagcagaagctatagtttgctgcagcttatggtggaagaatctggttgtgtccagacccagcccaatgccttacccacaaacaccactgctttcttccctatgggaggcccgaaaaggcccttccgtcgtcgatccagcttggacatgatgatatcctgggtctgattggctgaggttctggcagagaaattgatgcagttgggtaggtacgtatttttgggaaggtggagaaggaagttgttggtgatggctgatttgccagtgcctgtgggacccacgaacagcattggaatctcatggtctaagtaggttttcaagaagaaggactgccgggctgtctccattgtggggatgatgagttctgagacctgtaccacacagacatgggagagtctcggttgtgggcccaggaagctggaggtcttggcattcaagagacctgggtttacattctagctccatcccttactatctttatgaccttaggcgagtctttaacctctccatgggcctcagtttcttcatctgtgaaaaggggataataatggcacctaattcacagagctggcttgaggattaaacaagatcatgcatgtaaagttgggcattactgtctgtgtgttgtagatgagaagactgggtcgagagcctttctgcaacctgctcaagtaacacagcaagtaagtgaaaatgcagggatttgaataccagcttgtctgattccaaagtctacagtcttcactactgaatggtcatattataaacagttgtggtaaggatcagtccatagctgctgtgctcctagagcattgctctgaaccaacttgtctcccttgtcccaggcaaggtctacctcccctatgccatcatcactgcctggctcagagggcttaagtgtgatcctgaatccccatgatctgtgcttgtttctgatctattttttacaacactcacattcttggttctaagacccacccttactaatcccatgccttttccaatatggggattgtattaatacacacttttcctggtattcaggtcccagttggactcttaaggccgggtctcgggctcctggaatccctatttggacagggcacctgaccttggcttggattctctgagtttgaaccctgtcatcagccatttggctacattttgtccctctatgggggaagatgattatatcatacactgaagtctccttctatgtctaggctgaaagggactagaccttggggccactgtgttgtacaactacagagagtaccattcacaccatggatcatgtcaatggtgccttctaaagcaaaactggaccgtgatgcaaatagcgccacctaggtctgtgcgacataatggccctatgtatactggtagaaaaaggctcagcttctttctacaagcaatttgatcaaaggaaaagaaacagatgagacaagggaattaaagttgagaagaagagaagtaacaggtgcttaagtatgggtgttttgcctgtattaccccctacagtcttcccagtaaccttctaaggcaggtatgtaataacacagatgaaataaatgaggctcgaagaaactggctaacttatccaaagccatatagccagcaagtgaggctaaatgcagaactaggttcaagatgcgtattttgctactaagactgggagtttaaagcaagttgggtttcatagatgtttattttcaggaactaggacaattgtttgacaagggaaaaatctccagaactgaagatattttcttcattggactcttttacttgtgttaattcagcaagattgcaaatccctggagctcaagtgactaagctctttttggagaattaaagtttaggacctcagtgctgggggttgctttacaacactcagcccccaaggtgtgtcctgaagtcagcacacattcaccctgcttgacacatccttacacatacagctgtggtcctgcgtggtgtctgacttggttgtcaatatctgtactttctccaccacctaccactccacccagggcctgaacaatctccagtcacttcagaaagataaactatgcccactagattctactaacagggacataaaagctctctgaaaaaatgttccacaaggattgaaaagagcaggagttgtaggtgtatcattttctaatcagaaaacttattaatcaaaacctacttttcagagaattctgatcaagaaaatctttctctgaggattcaaagaatccttttttgctgagataactgagaagcacactgatgactatctggtgttgttattattattattattattattattattattttgagacagagttttgctcttgtcacccaggctgaagtgcaatggcgcgatctcggctcactgaaatctctgcctctggagttcaagcgattctcctgcctcagcctcccaagtagctgggattacaggcatgcgccaccacgcccagctaattttgtatttttagtagagatgcggtttcaccatgttggccaggctggtcttgcactcctgacctcaggtgatcctcctgccctggcctcccaaagtgctgggattacagatgtgagccactgcgcctggccagtacctggtattactgataacgacaataatcagaatagcaacaaacactgatgtagcccctagcatgtgccatgtgttcatgtataacacctccaacctctgcaaccataaatgttccccccaccgccattttttggttgagtaaattgaagctgagaaaggatgctgtgtctctctgattctaaagcccatgtttttgaaggtccactgcagctcatgtttaaatatttttctaaagaaagcccttaaaactcctcgcaaagactgttaattcttccacctgagagaatatttggatgattctggaaaccaaagttccatggccaatgattctctttatacctttgcaccagctggaactttttcctcctctttggtgatatactgtgtccacgtttcccaatgtccactagcttgtttgataaaataaaaatcatagatgcttcctggacccaaagaaacaaaacagatcattagcacatgaaggctttacttgcctcccatatttgaggattttaagtccctcagttatcagcatatgaaaatgtgtaactaccagtactggcatagttgtggtgaaacttatacattgctggaaagtgtataaactgaaacaacactttttaaagagtagtgactttattatttgtgtaaaaatgataggtgctaattatgcaaattattaaattagttttcataatgtaaacagcaagtattaaaatagaacaaggccaggtacagtggctcacgcctgtaatcactggactttgggaggctgaggtgggtggatcacctgaagtcaggggttcgagaccagcctcgccaacagggtgaaaccccatctctactaaaaatgaaaaaaaatttgctgggcatggtggcacgtgcctgtagtcccagctacttgggaggctgaggcaggaggatcactcaaacccaggaggccgaggttgcagtgagccgagattgtgtcactgcactccagcctgggcaacagagtgagactctgtctcaaaaataaatcaataaatatatacaattaaaaaaaagaacaaaaaaagaagacaataagttagtcaaaatcccacatccagagataacttttgatggcaatccttctagccctctttctagacacacaaacatactgaagatggaaagacagatagatgaaagaaaggattttataagaaggggactcattggacatatactattttaaaataactatgttaaagttaattttacttaaatctagcaaaagaaaaggagattgaagtgaaactgaaggacctgctgactttcaggtacagtttttgtcactacaagagatactgggtcctaaaaggtatttcataattttaagtcattaagggattaaagtcattatgctttataagtcatttaatgttattttgttgtattttaactttctattgtgagaaaaatttaaaaaatgaaagtaaggagaatagtataataaaccgtcctgtacgcattatccagcctcaacatgatcattttgccatttttgtctcatccatttcactacctccaaccagcaacatattcatttttcctttagtctctcttcctttctttctttttcttttttcttttttttagagatggagtctcactctgttgccaggctggagtgcagtgacatgatctcggctcactgcaacctccgcctcccgagttcaagcaattctcctgcctcaacttcccaagtagctgggactacaggcactcgccaccacgccctgctaatttttgtattattagtagacacagggttttgccatgttggccaggctggtctcaaactcccgacctcaggtgatccacccgacttggcctcccgaagtgctaggattacaggtgtgagccactgtgcccagcccttccccgtctctttctttccttccctttctctccctccatccttcctttctcctcttccctcaactctccccactccccttcccttcccctcttccttctttggagtattttaaggcaaatcctgatatcagaccatttcaattgtgaatacaaacgattcaagtttagaccaatttcattgattcctttgtgaactgtgaggtgattaactcttccttccagctccccttctctggttccttttgttgtcattgacactataactttcactttgtcagggttcatattcatttatgtttttttctgcaaccataatttccccattccttagtcttatgtttatatttcaatagattcactgctcaaacttttaaatagattcaatgctcagggcttttaacacagaccacttaagagttctttgttttaattcatctcttagttgactaattttcttcctctttctcttctttctctcgtctctttcttttctttctttctttttctttttctttctctttctctctccctccttccctctctccttctgtatttccttccttccttccctccctcccttcttccttccttccctcccttctttctttctttccttccttgcttccctccttccctccttccctccctccctcccttccttccttctttccttccttccttcctctctttcattctttctctctttttctcttttttctttcttttttgagacaggttctcactcattgcctaagtcaaagtggtgcagtggtgcaatcacaattcactacagcctcaacctcccgggctcaagcaatcttctcacagccccctaagtagctgggaccacaggcacacgccaccgcacccagcaaataattttattttttgtagagataaggtcttgctatgttgcccaggctggtctcaaactcctgagctcaagcaatctgcctgccttggcctcctaaagtgctgggattacaggcatgagccaccatgcccagcctcatttttttttttttccaagaaggggcttataggtgctcaactctctcagctcttacgtgtttgagaatgaccgcctgctgcttttgtattttaacagtgagagtaatagtctatgtcatattttcttgtcttctaaggtatgcagacattgctctattcttttttttttttttttgcattttaaattgctgtgcagaaactgaggcccatcagatatttacctggaagtccaataatttaattatgttatattttctggtcaattattatgtatcagttttccttagagcatagcatactcttacaattggtagaaacaactgttcattttaagagaagtttctgcatctgtatctttgtatatattatttatactattgattggagttcttaaggaactagcattatttggtctccatatcaattgtattgtctctgattacttcaatgtttttctcttctgttgtatgtgtaattatctcaaaccttatttctaagcaatatagtagatgtctagccttgcatactttatttctcgctggttctaattcacttattagatcattaatggcattattttattcccaatctgtttctctgactctgcagttcctctatttctctaatttagtagttttatcacttcatctacaaactttctacagctttactgaaatgtaatttacatatcatataatccaactagttcaagtgtacaattcagttgtacttttagcataccaaaaccacatgtacatgtaaatatattaatattcacagagttgtgaaaccattaccacaatcaactttagaacttttcattacattggatagaaaccccacacctcttagccgtcacctgccaaatccctctcccacccacttcataccctggcaacctctaatctactttctgtctctataaattcgcctattctgcctatataaagggaatcatataatatgtgttcttttgcgactggcttctttcacttaaaaaagtgtttgtgtgtgtgtgtctatttgagaccaggcctagctgtcacccaggctggagtgcagtggcacaatcttgctcattgcaacctcaacctcctggactcaagtgatcctcttgcctcagcctctcaagtagctgggacaacaggcatgcaccaccacgtctggctaatttttgtagagacggggtttttgctatgttgcccaggctggtcttgaacttagctcaagtgatctgctcacaattggattgtataacttttgagttaaattaaattggattgtgtttaactttggaggaagtgtcacagcctctttttcaaagctactgcaccattttacatttccattatggtagatgagagttctgatcttcctgcatcctcaccaatacttgttgtttttcatctttttaattacacccatcctagttattgtaaagtaagtatctcattgtggttttaatttgcatttccctgatggctaataacattgagcatcttgtcatgggcttattggccatttgtatatcctttttttttttttttgaggcagggtctcactctgtcaccccggctggagtgcagtggtatgatcttggccactgcaacccctgccttctgggctcaggtgatcctcctgcctcagcctcccaagtagctgggactacaggcaggcacgcaccatcatgcttagctaatttttgtattttttgtagagatggggtttcgccatgttgcccaggctggtctcaaaatcctgggctcaagtgatttgcccacctcaacttcccaaaggcatgagccccagtgtgcctggcctgtatatcttctgtaaataacggtctattcagatattttgcccattttatatagtgttatttgtctttttattattaaattatcatcactctatatattctaaatttgagtcccttataaggtacataatttgtaataaatttcacccattctgtgggatttttcatttgatgttgtcctttgaagcacgaaagtttttaattttaatgatgttcagtttacctattttttcttttgtcacttgtgcttttgttgtcttaagacatcattgcctactccaaatcataaaaatgtgcatctatgttttcttctaagagttttatagttttagcttttacatttaagtctttgacctattttgagttaatttttcactatagtgtgaggcagaactacaaattcactcttttacatgtataattcagttgttccagcacgatttgttgaaaagatcattcttttcctatttaatcatcttggcaccattgtcaaaaatcaagtcaccataaatgcaagagttttctttctggactgtcaattctattcaattaatctatatttctgttcttttgccagtataccatactattcatttatgaacttaaaaatttaaacttctattattacaaaattctttcaacagaaatattttctggctcttggttcatgttttctgttaaacattctctctctctctcctctgtctctctctctctctgatgtgtgcatgattgccttaccattctgctctgatataattgggtaaattcttcttgacatgtttcccaacattatctggggccagtttatcttatctacagtgttggccactatttaaggaatggtgtgtggctttctttcctatagccttaatccatagggttgggtaaagggaaaagctcagttacccttgctggaaaatctgagcactgtaccctctctctgaaatctgtctacatttcctgaaccatgggtccatctcactcccatcctagctagtgatgtgccccactcccgaaggattcacctcatgtccccacgcagcatagggttctggaagatgcaaaacctggcgttttttcccatccctactaaggtcctccagcatcacacaggggcttccatgatggagagtttctcttagaccttttgtgcagctgcccagccatcatcatggtcccctttcctctccgttggtgatttccagcgagaactcagagtgttgtcaactgacctgctttcctctccccatcactcttagcaagacagaggggtggcaggttctgagttgggagatacgccaggccagaatcttgttttctctccttattcactacttcacaatgcttgtagaattaagttgtaattcattctttggttattgctgggtactttttaggattaaaaaacgtttgttgttgctgattttgttaggtattttaaaagtgagcttctgttattctacgtcactctgcagccttacctagaagtaaatctggtgcaacacttttagaaagcaatctggcacaatgcttacagagcgacgagaatgttctctaagtcagaaatcccatttctgggaatttatcataaggaaataattcacaatgaaaataatctgtatacatgagtatgcaacaccatctgtgatagcaaagaaataacttacatatcctacattaggagacaagtaaaattagctcttataagatggatggaatattctttggtcattaaaatgatagttgcaaaagctaagtattagcatagaaaatgcttttaagaaacaatgatagataaaaatagactacagagtgaaatatataccattatggtaaccatgtaaagagatgaaatcaggtagacaagcaaggaaacggattttttgaaaactgaaatgactgtgatacggtggtatgaacaaagagatacttaaggataatttttatttaatagaatagaatcgcttttacaataaaaaggagatactaaaagactgaattggtaaaatatttttccctcttcctttgctgatgttgagctagagctaatttgtggcttgatttgggaacatttaggctaatgagaaaagatttggctgggtgtggtggcttatgcctataattccagcactttgggaggccaaggtggatgaatcacttgagtctggaagttggagaacaggctgagtaaatggcaaaatcctgtctctataaaaaatacaaaaattagccaggcatggtggcatgtgcctggagtcccagctacttgggaggctgaggtgggatcacctgggcctggggcactaagactgcagtgagccgtgatgagccgtgactacgccactgcactccagcctggacaagagaatgaggctctgtcaagaaaagaaaagaggagaggagaggagaggaggggaggggaggggaggggaggggaggaaaagaaggaagggaagggaagaggagaagagaagagaagagaaaagatttaactagtaaaagtagatttaccagcagtgtgaccttggctaaggttaccatttacacacctgtaaaataggcctgattttatgtcaaactcggaaaatcactacggagagtgagtgagatatatgtatcaaacatctagcatagttctgggcacacagaaggcacttggtaatgtttagctctagctcttcttggttttcatcagaataatggctcctgttctctttgtgttgtgattataacttaaactctggtctgggtgtgagagtagaaagaggagaatagcagaaattcaggaatggattggtaatgaattggtaaatgacttctatcacccctaccccccctaccccagctctgctttcctctcctgcacttgggaaaatgaggtaaacttttcaactgagcagtaagtgacttttcaaaggtcacacaatgaatgagtgaatgaagagaaattaagcactttcgggacaaatggatccctgggttgacaaacaaaggtccatgtcaaacaatgtgagcccaacattgacagaatcccacaagggtctgcttgctttccttagtgtatgcttcccagtgtagttcctccagcacttatttgagagatccatttatgccatgtcttgcatatcatgaaaatcctagaaaacaatgtcccataaagtcagggaaggccttcctggagcactcggcattagaattttcatcatgggccctcatggacaggctagaaaggcattttaagcttttgaatatggttataagaaagtacagggtcttgctatgttgcccaggctagtctcaaactcccaggctcaagcgatccttccaactcagcctctgtgtagctgggattacaggcatgaaccaccacgcccggccaaaacctgtttttttttttttgtttttttttgttttgttttgttttttaaaaaaaacaagctgctgcaaaagaggatatacacaaaagaagtcagtttgcaggacacgatgaaaatcatggtttgttttatgctgcatctgctgggtagggcatggagggaggagatgaggccatcgttgtggacaggagatattataagggaaaattatctagaaactgagtgggagctgtgcacatcacatcattgactctctagctgcagaaggaaaggaaagaggtcaccacaaagtgatctgaaagtgaggtcaagggcaattcatgtaccatctctgcagacagagcataaacagattgattttgaaggatgaggaaggcagaaaacaacatgtggagcctgtgaaaaaaatattgcaatgtaaaggaatgtcatatggagattaacctgaataatttatctctgaactttctttttcttttgagacaggatctcactgtatcacccaggctggagtgcagtggtcacgcatggctgtaggtgcatcacagctcactgcagcctcaacctcctgggctcaagtgatcctcctgcctcagcctcccaagtagctgagaatagaggtgtgtgccatcatggctggctaatttttctttgtattttttgtagagacagggttttacaatgttgcccaggatggtctcaaattcctgggctcaagaaatccacctgcctcagcctcccaaagtgctgggattacaggggcgagccaccgtgccaggctgaaacttgtttttgcaggacttgaagccaaatttcaggaaaactgtttggtatcttcaataaggtgcagaaagacctaactttaaatgaagcaggaacagaaagcaaaaaaggaaaaacaaactaagatgaaaagacaagatgagataaaaagtgagatggatgccctaagagatgatgatgataatagcaataaaattgctcacatttatttaacatttcctacataccatgctttattcaaagtatttttacatgtattaactcatttaatccttactattattattgtccccattttataattgagggaactgaggaggataaagaagttgctcaaagtcaccccagtattaagtgttggagccaggatccgaactctgacaatttcactccatggcctgtactttcccatccttgcactaacaaagcctgccacagaaacaaaagatacaaaggcagaattaaaatcattcaagacagtaaaaagaataattgaagttgtgggtggctgatatcaaaatgaaaagcgcacctcgaaagaccaaagccccaaaacaagaaaaaaggagatgatggttatgggagccagaaaattatttttttccttgctgacggaaaggatgcatcacattccaggcaaaataaacaaaagaggacacagtctgttaaaaacaaaacagaaacaaaacctacaaaaacattaaataaaaaacatatgaaaaacaaactaccactttatatataattcaacctcacttctaatttaaagaagaagaaatttaaattagatactattttcacttttcaaatgtaaacagaatgccaaaatacatgaggcaaaactgatagaactttaaggagaaatagacaaatccaatatcacagtcggatacttcaaccacccctgccaatcagtagttggcagataacagtcagaaaataagtaggaatatagtgaaactgaatagcaccatcatcaattaacaggatcaaattgacatttattactttattcaacaatagaagactacatattttcttaagctcacgtgaaacattcaccaagatagaatgcatcgtgggcaataaaacactttttaatttttttttaggcaggatctcactctcttactctgtcacccaggctggagtgcagtgggatgatcatggcacactgcagcctccaactcctaggctcaagcaatcatcccgcctcagcctcctgagtaggtgggactacaggtgagcgctaccacacccagctaattttcgttttttgtttttgtaaagacgggattttgacatgttgcccagactggtctcaaactcctgtgctcaagggatcctccatcttggcctcctaaagtgctgggattacaggtgtgagccaccgtgcacagccaaaaagaaagatctaaaatcaataatctaagcattcatcttaggaaactaaagagagcaattaaataaaaggaagcagaacagaagaaataaaaattattgcagaaatcatgaaattgacaacaggaaattaatagataaaattaacaaaagctgtatctttgaaggattaataaaattgataggccgggcacagtgggtcatgcctgtaatcccagcactttaggaaggtgagacaggtggatcacttgagtccaggagtttgggaccagcaccagcccgggcagatcccatctgttaaaaaaaaaaaattgataaacctttagacaggttaaccaagaaaaaaagagaagacagcactaatatcaagaatgaggctgggcgcagtggctcacacctgtaattccagcactttgggaggccaaagcaggcagatcacctgaggtcaggagtttgagactagcctgaccaacgtggagaaaccccgtctctaccaaaatacaaaattagccaggcgtggtgacacatgactttaatcccagctactcgggaggctgaggcagaagaattgcttgaacctgggaggaggaggttacgatgagccaagatcgtgccattgcactccagcctgggcaacaagagtgaaactccatctcaaaaaaaaaaaaaaaaaaaaactaaaaaaatgaaagacaggccatcagtactgattcaatggacattaagaggataataaatattatgaacaactttatgccaacaaatttgataaataaaatagaccaattccttgaaagacatgatttacatgattcacataaggagaagtagataatttgaataggcttttatccattaaagaaatttaatcaacaattaataaccttccaagagagaaagtaccaggccaagatgggttcactggtgaattctatcaaacatttaaggaagaaatgatacaaattctctacaatctcttagagaaaatagaagcagaggacacactttataactcatgctatgaggccagcattacgctaataccaaagccagataaagacattataagagaggaaaattacagaccagtatctctcatcaacatagatgcaaaaatattcatcaaaatattagcaaatcaaatccaacaacatatgaaaagtattacacaccacaatcaagtgatatttattccacttgattattattattccaaggtatataagtctggctcaacatttgaaaatcaattagtgtaattcattgcattaacaagctaaagaagaaaaatcatatgatcacgttaatagattcagaaaaagcatttgacaaaatccaacatccactcatgacaaagactctcagtaaactagtaatagagggaacttgtcaacttgataaagaataccaatgaaaaaccttcagctaaacatcacacttaatggtcaagaactagatgctttcctcctaagactgggagcaagataaggaagccctttttcattacttctgttcagcatcatactggaagtcctagctaatggaataagacaagaaaaggaaataaaatattgggaaggaagaaataaaactgtctgtcagtggcataattatgtaaaaaatcccaaagaatccacaaaaagactcctggaacttataagtgattgtagtaagatggctggatacaagattaatatacaaaagtcaattgcttttctatatacaggcaatgaacaagtggaatttgaaatgaaaacacaataccatttatattaactccaaaaaagaaggaactacttaggtataaatttaacaaaaaatatacaagatctatatgaggaaaactataaaactctagccaaagaaataaaaaacagtctaaataaatagagagataatccatgtttatgaatagaaagaccctaaattattaagaaatctgttcttcttgacttggtctaggtaaacacagccttaacattatccagcaatagcatgtctatgtgtttactaaatgaattaatggaaaagttatgttcacaaaaggcctttacataaatgtttataactgctttaagtaccaaaaattgtaataaaccaaaatgtcctttaatgggtgcatggataaacatacatacaatgaaatattattaagtgataaagaagcaatctaacaaggaacaaaaatccatgtaggaacctcaacagcatattgctaagtgaaataaggcagtctaaaaatttcacatactgtatgattccaagaatatcatgtcttggaaaagtcaaaactatagagacagtaaaaagatcagtggttgcttggggatcagggaaggaagggaggatgaagaggtggagcacaggatttttttgggttgtgtgaaactatcctgcatgattctgtaatggtgaatacatgacatttacatctttgtcaaaacccataggacatacaacacaagagtgaaccttaacatacactatgaactttgttcataataatttagcaatattggttcatcaattgtaactataataccacagtactgcaagatgttaatgaaagaactgtgtttgtgtgggtgagaagaagtggcatatggaaactctctgtattttctgcaacatttttctataaatttaagactaaagtctattaaaactttttttaaaggagaagaaagttaaaatgcgatatgattttcatatttcaaattgcttgagattttttattttgttttctgagatggagtcttgctctgtcgcccaggttggattgcagtggtgtgatagctcactgcaacctctgcctcccaggttcaagcaattctcctgcctcagcctcctgagtagctgggactacaggtgcccacgaccatgtccagctaatttttgtatttttagtagagatggtgtttcaacatgttggccaggcttgtctcaaaatcctggcctcaagtgatctgcctgcctcaacctcccaaagtgctgggattacaggtgtgagccactgtgcctggccgagatatgattttcatatttcaaattgcttgagattttgaaaaggcaatactcagtgaggcacaagggaagtttagcaaccaaaagctttaaaatgttaccgatctcttgactcagcaattctattttaggaaatcatcacaaggaaataacaatgaattaagtaaatatcattaacaaccagaatattgttaatgatagtaaaaactaggagataaaagtacagaatgatcttatattttaaaaacaaacctggagacacatacatgcataagaaaatgtccaaaagaattgtcatcaaaatattaattgtggctctctttttatcacatatttttattgtatatttttttcttaaaaaataagaatgaacttcatacccaccacaatggctattatcagtaaaacatacagagagaatacaagcactggtgaggatgtggaggaatcagaacttctgtgtatcgctggtgggaaggtacaatgttgcagcctctatggaaaacattacagcagttcctcaaaaaattaaacatagcattaacatatgatccagattttcacttctgagtatatacaccagaaatagcagagactcaaaagacagtatttgtacacccatgttcatagcagctttattcgcaatagccaaaaggtgcaaataactcaaggatccactgacagatgaatggataaacaaaacgtggtgtatacatgaaatggaatatattcagccttaagaaaggaaattctgacacgtgctacaacatggatgaacgccgaagacattatgctaagtaaaataagccagtcacaagaagacaaatactgtatgattcctcttacatgcagtacccagggcagtctaatttatggtgacagaaagtagaatggttatttccagggtaggggtggagaaggggctttgggggaggtactgtttaatgagaacagttagtttgggaatgtgaaaaacgtcctggagatggagggaggtgatggttgcccaacaatgtgaatgtacttaacaccactgatttgaacaattacaaatggtcaaaatggtaaattttgtgttatgtgcattttactatgacaataaaataagcaaaaatcatccaaaccaaaaactcaatgaatgcatgacaatctgactaatggattgatacagagacagagcctccctgtggttcatcttgtgaaaggagcatatcttgggcccccaaaatcatcaagctaaaaggaaaagtcaagcagggaatcacttagggcaaacctgcctcccattctattaaagtcacccctctgctcactgagatgaattcatatctgattgcctcttttggagaggctaatcagaaaactcaaaagaatgcaaccatttctctcttatctacctatgacttggaagtcccctccccacttcaagttgtcccacctttccagatggcaccaatgttcacctcacatacgttgattgatgtctcatatctcactaaaatgtataaaaccgtgctctggccaccttgggcgcatgtttgttgtcagcgcctcctgaggctgtgtcacaggcatgcgtcctcaaccttggcaaaataaactttctaaattaactgagacctgtctcagatttttgtggttcacaatctgacagatggccatgtatcaaatgaagtgtgcaagctgtgcagagaaagagtatgtggcaggcggtaatagtatctacttgctcattcattatttcattattatgaaacataataatgtttcattattatcaaacatacagaaacatggaagacattgtacagtgaacatttgtatactcaccttctagattttaccgttagctctttatttgttttagtacatacctggtcatccctctatccttcctttaatctatcttttttttaaaaaaaattcaaaattaattttaagcatctacacactttctcataaatactttggcgtgcttcttattacctagtgttcagtatttgtttatatatttttcctttgatataaatcttacaatgaaatgcacacatcctaagcccacatttctaagttttggcaaatgcacatatttgtgtaatccaggtcactcttaagatatgcaacattactatctcccctagaagttctctcatggcccttgatacatgtttttttacaatcacaaaaagtaaagctatttgggaagtacttgtagtatgatcctctttttgttctaggaatatagaaaaaactgaaagaaaacataagaagtgatatttctggatagtgggattaccactgatcttaattttcttctattcctttctctgtattttctaaattttatataatgtcttacttgggtggtagaaaaacaaaacaaaagcgacttagaagaagcatcttccttataagaaatgatgtcacacacataagaatatttacagtcactaagtgatcattttgaagacaatgtatgtagtgaaattggaaacatttcaatatgatattaaaatataactgcaggcccggtgcagtggctcacgcctgtaatcccagcacttttggaggctgaggcaggtggatcacttaaggtcaagagttcaagaccagcctagccaatgtggtgaaaccccatctctactaaaaatacaaaaattagccaggcgtggtggtgcatgcctgtaatcccaactacttgggaggctgagacaggagaatctcttgaatctgggaggcagtgggtgcagtgagccaagatcataccactatactccagcaggagcaagagagcaacactctatctcaaaaaaaaaattataatgacaaaattaaaagaaatattaataccataagtaccctatacgaaggcatgtcaacacacacagaaatagaaaggaataagaaaaacacaagtgtctatatttctcattttgttttggtgatggaattataggtaatttttgcaaaaataaaacagtcatatcctctttttctaaattaaaaaagtggttaagtatcccataaaaccttgacttcaggaccacccatgggccaactctattttttttttttttttttttttttgagacagagtctagctctgttgctcaggctggagtacagtggcatgatctcagctcactgcaacctctacctcccggactcaagcaatcctcctgcctcagcctcctgaatagctgggtttataggtgcatgccaccacacccagctaattttgtttgtatttttaatagagacggggtttcaccatgttggccaggccggtcttgaactgctgacctcaagtgatctgcccacctcagcctcccaaagtgctgggattaccagtgtgagacaccacaaccagccaatgatgatattttaattctgtaattccttacatatttattagccaccgtgcctggccttctgtggcttttgtaaagggctcacctgtctgcacattctggttgtgtttagaacatgtaattccaactattatactagaacataacaaacaggttctaaattacctctttctggaaagatgttgtttttggtgagtttgacgcttttgggccttgggtggttatcatccatgcccatgatcaggttgcggaaaaacacatcaaatttctttctgctgtctgcgttgatggtgccagccacggtccacaccaaggaaaagagaaacagtccttggagccagagaaagatctgttgacttgacaggccttcacctaattccatttcctcctcttctactgccctgatttcatctaaaagtgagaaaagcgaatctcaggacagagtgcagaatgccacagatgtaagggctgtgaactggttggctttgcctttgaagggtctgggccagaagggcgactgatattggcagagtgcctatcacctaccagatcatttcacatgcattttttttttttttttgaaacagggtctcactctgtctcccaggttggagtgcagtggtgcagtcacagctcactgtagcctcaacctcccgggctcaagtgatctttccaccccagcttcctgagtagctgggaccacaggcactagccaccacatctgactgatttttgtatttttttatagagatggggttttgccaggttgcccaggctggtctcgaactcctgagctcaagcaatccacccacctcggcctctcaaaatgctaggattacagccgtgagcaatatttttatttttactgctgtataataatatagtgtgtgtatatatatatatatatataaaatcactatatatatatatatatatatatttttttttttttttttttttttgagatggagtctagctctgtcgcccatgctggagtgcagtggcacaatctcggctcactgcaacctctgcctcctgggttcaagtgattctcctgcctcagcctcccaagtagctgggattacaggcacccgccacctcaccctgctaatttttgtatttttagtagagacggggttttactgtgttgttggccagactggtctcgaactcctgacctcgtgatccacccacctcaacttcccaaagtgctggaattacaagcgtgagagaccgcacccggcctttactgcaatatttttattgtggtaaaatacatgatatataatttaccatctaaccattttttagtgtatagttcagtggtattaagtgcattcatattgctgtgcgaccatcaccaccatctatatccagaattgttttcatcttgaagaactgaagctctttgcccattaaacaataacttctccctccatcctctctcatcccccttgcaaccagaactctccgttctgtctttataaatttggctactctatgtacattaattgtagagaagaatcgcacagtcattttgtgactggcttattttcttagtataatggctttagtgttcatccaagctgtagcatgcatcagaatttatttcctttttaaggctaaatagtatttcattgcaaaattacaatacattttgcttatttgttcatccatcggtagacacatgggttgttttcaccatttgggtattgtgaacaagagttctatgaacatggttatacaaatatctgatcaagtctctgctttcaattctttttggtttatatgctaaggtgaaagtgctggatcaataagtctacatttacttttttgtttttttggaaattaatctcttatcagagaggaggtaagacaggggtcctgctatgttcatctccctctaggatatccctgtgaggtaaaaagggcaggaattactactctcattatgtaaatgaggagccttagactgaggaatgatggggtaatttgcactagaataccacccaaaaatcaatgtcagacaaagactaaacacatggactttgcctaccaaactctactatctgcactccaaaggcttgcttgttctagatcaaacagccagtcatgttgtaattcaatgggggccaaagagaggtgggagcagaaaaaatagccaaggtagcccaggcgctgtggcttatgcctgtaatcccagcactttgggaggcagaggcaggtggaacacttgaggtcaggagttcaacaccagcctggtcaacatggcgaaaccccatctctactaaaaatacaaaaaaatagaagtggtgcgtaacttaatcccagctactcgggaggctgaggcaggagaatcacttgaacctgggaggctgaggctgcagtgagccaagatcatgccactgcactctagccttggtgacagagtgagacttcatctcaaaaaaaaaagaaatagccaaggtagacccaccccccatgtggcttaagaatcatggctagcacttaccaagcagagaagagtacagtctcatcattgagaaggcaaggtggatgggagatgtctggacaacaaatttacaatgaaggcgaccaaattccaggcagggctggacaagccacatgaacatgtcattgacctgagagtagaaacctccatgagacttggagacatgatcaacaagtgagttgacgaccaagagcttggtctaccttgtgaggctagagatgctggttagactgctgatttaaatgtaggtgcattgggggaaaacttataggcaacaagacccctatctcagcatcctccttcagggtcctaagactgttgcccacaggccatgttaactcagtttcccatccgcattccactgcccagagctgatactcagagaggcttggaaatactctgggtcagctacaggatgcataaaatgtgtttagaacccaactagtgtatctgtctttgtttctataaaaagtattaggaattctaaacaattaatttacaaatgactgttatgttagacactggtgaggtgggactcctgtataaattagtcaaagagagtacagagctaatttggggggctcattttcagtaatttaccacacgtatgggtaggtttatatgttcttctttggggttatcatgattcttgcctctagtgtctgttctccagtccatttactcttttaaaaagttatccgacttgcttttcttgtaatgcttttttaaacctttgttatattttttttaaaaaagatttatttatttacttactaaattttttttttttttgagacggagttttgttctgtcaccaaggctggagtgcaatggtgtgatctcagctcactacaacctccgcccccactgggttcaagcgattctcctgcctcagactccctgagtagctgggattacaggcacatgccatcatgctcagctaatttttgtatttttagtagagacagggttctaccatgttggccatgctggtctcgaactcctgacctcaagtgatccgcccacctcagcctcccaaagtgctgggattacaggcgtgagccaccacgctcagcctctttgttatactttatttgtgactttccctatacacattttttttaagaagtaggaaggccatcactaaataaatacagacttaggtgtggatctatatagataatttatgtatgtgtagatgcatttatatgtatatataaaaatacaggtatacatggaaatgtggtatatcaattcagtcaataaatatttattgagcatctactaattgcacggtagtagtgctggggataaacaatggaaaaggtagacaaggagccctcatggagggtcagggaagacaaacaataaataactaatccagcagggatatcagtaaaatacctatagatcatgcaaagttctagcaggaaacacaaacgtgttatggtgaagaataacaggaagggtttaaatagggtaaagaagccttcctggaggaggagatttttatgttgagaactgcatgatgagggtggagccaactctgagataaactgaggcaagagtcccaggaagaggaataaaaagagcaaaagccttgaggtgatgaaacctgggcttgtcttggaaacaagacaggactgctggagactgctaagctgaggctgagaaagagcaggaaatgagattgcagaggcaggcggggccagatcacatagtctcatgggccctgataaggagttaaactttgtgccagggacattggggagtccctaaatgactttacatatatggggacttggcagcttttggggtgtgtgtgtgtgtgtgtgtgtgtgtgtgtgtggactggcgcttgaatgtgcacgtggatatgtacttgcactttacatattatccatgtatgtaggtgatgacagacattcagccgtcctacataatctcccaaagagtttccattgtaggaatagaccatccttggattcctcagtgggagactttcctaagcattctattaacacaggggagggcaagaggaaccacagacaccgctactcccttcctgcttccgggtctgagagtgtggtcaggtacccgcctaacccgaactttcccacctctttagagaagggaagaagggagtggtcgctcacagtagctgcagtgaaagcacttctaactggttccagctccctcaaggtgggaggtgcagagtccaggttacagggatgggaattggcagcaccaaaaggaacacctggcccatctctagagaaacttctacagacatttctgttagtggggcaatgaagaaagaggtgacatttcagcttccacagagaacattcctcagcactgggattctccactggggagccagggagtgatggggaaggaggaagaggaaagagaaattgactgcaccaccccaggcccaccatatggagaagaaagttcgaaaaatggcaggcagccaggaaacaagataactggggacaacaagggaattccctgccccttgttgcctccagggactatgaaggtgaagatgtacctagaagaccctcgagatgaaaagcagggagacagcaggaggggaaggaaagggtctgaggggctcaccaattctttgtgctccttggtgagactggagggcagggtgtccatgtaggaatccttcaggggcttccagcctagttgatggggctccatgtagatcatcccacacctgggaagcacagaggaccagtttaggtgctcgcttctttgttactaatacgggttaacatttattgagcaatctactgcatgtcaggcaccatgctaggcattaatggatcttgacaataacctagtcccctgggtttacccacgttgaatcttgtgttcatctgccccttgatttctttccttcatatacagttttatagcatttctatatgttcctaaaatgtttatttgtttgtttggagacagtgtcttgctctgttgcccaggctggagtacagtggtgcaatcttggctcactgcaacctccgcctccctggttcaagtgattctcatttctcagcctcccgagtagctggaattacaagtgcgtcccaccacacctggctaacttttttgtatttttagtagagatggggttttgtctttagtagagacagggttggccaggctggtctagaactcctggcctcaagtgatccatccacctgggcctcccaaagcgctgggattacaggtgtgagccacctcgcccggcctgttcctaaagtgtttatatttttattttagttgtttttaacaattaaaaaggggtaccatgttatagataatattttgatcttacttttattattactatataataataatatagtatataatagcatataaccatacagtatatatattattatatattagcacataataatatagtatatattagtatatagtataacattatattatatataatatactgtaattatagatataattatgtaattatagatgtaattatagatataacatatttatagatgtaattatagatataatatatttatagatataattacattattacattatctgtgttctatataatattgctaaggttttgtccttaatagagttactaagatttatttatatagttgcatgtcagtgcagttcttttgagtactttattatacatattacaatttctgactctattatactttattaattcactcttttgttgttgttgttgttgttgtttgttttttagatggagtcttgttctgtcgcccaggctggagtgcagtagtgtgatctcggctcactgcaacttttgcctcctgggttcaagcaattctcctgcctcagcctcccaagtagctgggattacgggcacccaccaccatgcttggctatttttttgtatttttctgtagtagaaatgaggtttcaccatgttggccaggctggtctcaaactcctgacctcaggtgatctgcccgcctcggcctcccaaagtgctgggattacagcataagtcatcgtacctggccaccaataactcgattaacaggcatttgggctgtttccaagtgcttgttactgtgagttctgccactatattttttgtacagatctcctgttgcacatgccaaaagttttccttgggcctgtacttaggagaatggctggctcttgggcatacggagattcaactttaggagataatatcaaactgtttccaaagtacttgctgggttttagactcccaccagtagtgtggactgagggctgattttatgacaaatctaaatgaatgacaaataatataatgctaagcaaattaacgcaggaacagaaaaccaaatcccgtatgttcttacttataaatgggagctaaacattgagtacacatggacacaaagaagggaacgattggctgggcacggtggctcatgcctgtaattccacactttgggaggctgaggcaggcagatcacgatgtcaggagtttgagatcagcctggccaacatggtgaaaccccatctctactaataatacaaaaattagccgagggtggtggcgtgtgcttgtagtcccagttactggggaggctgaggcaggagaatcgcttgaacctgggaggcagaggttgcagtgagtcgagatcatgccacgggactccagcctgggtgacagagtgatactccgtctcaaaaaaaaaaaaaaaaaaaaaaagaaggaaatgatagatatgggagcctacttcagggtggaggagggtgaggatggaaaaacaacctgattaactgggtgactaaacaatctgtaccccaaacccccatgccatgcaatttactcatgtaacaaagctgcacatataccccctggaacctaaaataaaaattggaaagaaaaataataataatgtagatgatctgcgagggcttcatcacatttgtgaaatttgagagctttctcttttgcttagggtgagtggagccacactgtcccccggggtgccagtgagggctgcctcacctgctcacagtggctggagaggcttgctcgaggtcggcgggctcgaagatcaggctcatcttggagttcatctggataatttccccactcatgagacacagctaaaagtgcaaagcagagggtagcagacaggggaaaggcttaaattccatctgcaagtaagaggtctcagtgcagacaaagctggtttgattcattccataaatatttcttgagcacttatgatgtcccaggcactgttatgcactaactcctaggtgcataaaataaaacacaaaatttcctatcctcttggggtttacattcttctgggagatgacagacaataagcaaaatatatagtgttcgaagtggtgaaaagtgctctggagaaaaatttagtagaagagggggttgcatctacacatacatatatctacacatacatatactatatagatccacacctaagtgtgtatttatttagtgatggccttcctacttcttaaaaaaatgtgtatagggaaagtcacaaataaagtataacaaagaggctgagcatggtggctcacgcctgtaatcccagcactttgggaggccgaggcgggtggatcacttgaggtcaggagttcaagaccagcatggccaacatggtaaaaccctgtctctactaaaaatacaaaaattagctgagcatggtggcacatgcctgacctcagtcagggttgagtgagctgcaattttaataggaaagccagggaatcactgaccttagatgcaatctcagatgaagaatcgagaagttatcagacctcaccaagtttcctggtccctttctcaatatttaacatagaacttaactgcaaagccacatcctatttttatttgctcaattctttcacaaaagacccatatttgaacacccgcatggactaatccatagcaggagggacaaaagcctttccataaattctttttatttttaatttttatttgcttttgagacaggtgttgctctgttacccagactgaaatacaatgacacatttgcaatcactccatcctcgacctttggggctcaagcgatcctcccacctcagcctcctgagtagctaggattacaggtgtgtaccttcacacgtggctagttttttattttttgttttttgtttttagattaaatcaatgtttccataatatattttttaaaattttttttgtagagacaggatctcactgtgttgcccaagctgatctcaaactcctgggctcaagcaatcctcctgtctctgcctcccaaagtgctaggatcacaagcataagccaccgtgcctggcccataaatcttttttagaatagagtgaaagaagctaggcacagtggctcgtgcctgtgatcccagcacagcactttgggaggccgaggaaggcagatcacttgaggtcaggagttggagaccagcctggccaacatggtgaaacccaatttctactaaaagtacaaaaaaaaaaaaaaaatagccgggcatggtggcacgcatctgtaatcccagctactaaggcaggagaattgcgggaggtggaggttgcagtgagctgagatcgtgccactgcacttcatcctggacaacagagggagactttgtctcaaaaaaaaaaaaaagaaagaaaaatcatcagaatttctagtgtgtagcaagtaaaaccctgtaggaagtagtgcaattacacaggaaagccttggaatatatactaagtcaatgacactgtttcctactcacgaaaatggattccagtgagatgtttaagttataagaaaggcctgaggcccttgtctcccaggggagaagaggaaatacgactgattcattctgctcatcctaatttgtgattaaaaacttccctgcatcttacttggcctgcatcaaacacaacttgaaacaggtcactgcctgcatccccaggaagatcacagctgttacaaggctgacaccaccaaccgcgtcatctctgaatataaagaaagctaaaacagacccacacctgtgactgtagtttcatttacatccagagcagaggaaaaccattaggaaattcacttattatgactctcttgatacttctaatctcaagaccaaccgatacatctgtacaattagtttatataatatagtccatatcatgtaataaaacatttccatttttgaatattatataatcaaaattatgcacatgctataattagtggatgtgtataatttggataattagccctttcgttgttgagcatgactcactcttagtcttgtgacatttaaacacagttagaaaatatattttgatttgataatgatgtatatccagtgaaggaattcttccttgagatgatgataaattttattttaaacagttatatagcacttgctatatgccaggcaccatcagaagaggtgtataaatagtaacttatctaatcttcgtaacagtataaggtagacgctatcgtccctactttacagatgatgaagttggggcatcaagagactaaatagcttgtctgaggttacatagctggaaagtggcaaggccaggatttgaacccaggctctctggctccagagtccaagctcttttagccaccatacatactgtggcgccatacttactgtgttatcactctactctacttatttttccaaagattggtggtatttttgcaaagattgctatattttccaaaggtcctggcatcagtttggactcctaactctactattgagctgtgttgtgttgggcaagttacataaattccatcccatatgcccccactttttttttgagacaaggtctttctctgttgctcagcttggagcacagtggcacaatgaaggctcacagtagccatgacttccagactcaagggatcctcacacctcagcctcctgagtagcaggactacacgcacttaccaccatgcccagttaattaaaacaaattttttttttgtagagatggctcactgtgttgctcaaactggtcttgaactcctgggctcaagcaatcctcctgtctcagcctctagaagtgttaggattacacgtgtgagcctatagggcccagcccatatgcacttttgcaatgtgacctgtctgcctccatcaagaggtgaagtctatttttccacttcctggtcaggccttgtgagttccttgaccaacagaatgcagagaaagtaatgcttatcagtttcaagcatagctcttaatatcttggaaacttccacttcctgactcttggaaatcacccaccacataggaagcgccactaccaagacaccaccaagtgaaaagcccaagccatgtgaagtggcctggaagaggaggtattatttttagagagaaagaaaaagagagagagaaagatgggccaaatatgattgtgccaccaggcattgagtgaagacgccatcttgaatgcggattttctagcctgagctgccccagctgacatcaaaagagagaccaactggccagctgagccctttcaaaattcccagcccacaaaatcatgaggaaaagaaatggttgttttaagccgttaagtattagggtagtttgttatatagcaataagtaaccaaaacatatcccgcaggtactatgtgcaatctcatttaagtatcaacaacctcattttattactacctttctacaaatgagaaaactgagattcagagaagtgatgtgacttgctcagtacaacacagctcagttgcagggctaggagtccaaactgatgccagcactaaggctcactattcaacgtggtctctaaacatgcttagcttaccaactacaagtacaaacagagcataattcatgaattgattactataatcctcctgtggggcatttattcttaatgtatacagaatacatacataataaatgtatgtctctatatagttttgatcaatcacttacttcaataaaagagtttatgtctcactcatggaaaagtcatatcagggtcaatacttacctttttattgtcatccagaacagtgttcatattttcaatccaaatagcatccactggcccatcaaatataatccacttgcgatcatcagagagtgaagacgcttgctcccggaaagcattggcaaggacaccatccatccactcgtggctcacttggtcaaagcacccatacagctgccccatcgtgatagccttggggttgatgatcttgtactccacagcaaactcctccatctgattggctgggcaagaaggttcaacaccagttataaaggctctggtgagaccagaaggttaaacaagagatgatgtcatctcaacaaccaatcaacttttataaatatgccatatgagggaagtccttcttataaaacatgtgctcagtttttatagagattgggatctggggccaggagctgtagtagctcacacccataatcccaatactcagggaggccaggatgggaggatcacttgaacctgggaaatggaggctgcagtgagctatgattgtgccaccacacttcagcctgagcaacagaatgaagccgtctctcaaaaaaaaaaaaaagactgactgagacatctggataggcaatgccttacattattgggttattatagcctttgatttctcaccatactttcttccaatcctcttttcaaatagggcaaatgtgccagtcagatccaggactacttgctgggcacagtggctcacgcctgtaatcccagcactttgggaggccaaggcaggtggatcactagaggccaggagtttgagaccagcctggccaatatggtgaaaccctgtctccactaaaaatgcaaaaattagctgggcgtggtggcgcatgcctgtaaacccagccattcgccacttgggaagctgaggcaggagaaacacttggacctgggaggtggaggttgcagtaagctgaggccatgccactgcactccagcctgggcgacagagtaagactctgtctcgaaaaaaaaaaaaatccaggactaaagaaatctgactgccctcacagaactcaagcaggaagggagagtgacgcctattatcagccctctatgtacctgctctcacagccaccctaagaaccttggcttttcaaactcaaacaggctgaaggaagaaattaaaaatgaaaagaacagatcagaaccttggctttgatttgaaatgaggaaacgggaaacagctgacaggtaaaaaggttctgaaaaatgatggttacttttctgtctctgaagggctagtttggccccgaaatcgttcttgactgctcagtgagtgtcatttgttcccaagaaatacacgctggagtattaaaactcaattggaacgtacaggctgatggatggcacagcatatgtatttaataacaaaaaaaaatcacaatgcttttatggaatccttcaaagtagggaaaagttgaagtgcttgagtcatgaactaaataaagaaccacctctgggccaggtgttgtggctcatgcctgtaatctcagcactttgggaggctgaggcaggaggattgcttgagctcaggagttcgagaccagcctgcgcaatatggcaaaaccccatctctacaaaaaatacaaaaattaggcgggcatggtggtgcatgcctatgatcccagctacccgggagcctgagataggaggattgcttgagcccaggaggcagaggttgcagtgagccgagactgtgccactgcactatctctaaaaaccattaaaaataattaaataaataaaaaagaactactctgcagcatcctgaggcaaacacagtggtagcctcctttttcttcactcagtttcttaaggtatattaaaatggtatattaaaggtatatttctttaaggtatattaaaatgctaaaaatattttatattttattatattctattattttattttgagactggatctcactcacccaggctgcaattgcagtgcagtgcgcaatcatagctcactgcagccacaaactcctgagctgaagtgatccgcccgccttggcccctcaaaatgccgggattatgggtgtgagcccctgttccctgcctcaaaatttgtatctaaatttgagatgcccaaattagttattaaggctaggataacccccaaaacataacctcaaaaacccaatcatcaaatgttattagaaaaaaaattttaaatgaaaaacttgaagcaatgcatgcacgaaaaggaaatgcttttatgaaactataggtttgtgttttataaaaacaaaacaaaacagacacacacacgaaaaaacccacaactgtttctctggcaggaaacatagtttccatttgttgcgtaggcactgtgctcagttatttacctgcatgctgttacttaattctcataacaatcccattttacagctgggaaaacagaggataacacaggtttagtcatttgcccaagtctgagtctgattcaaaagcaggagctcctatccttgactttaaaaggaaggaaagaagaaaagaagggaaggagggagggaaaaaactaaagggaagggaacaggaaaagaagagaatagaagcaaagaagcaaaaccatgcagtgatttgcttttagactaattttaaggccaatgacaagagtttctctttcactgggggacctttggagaaaccactgctcagcatttgagacaattcctccaggccttaatgatatgcacatgaaatcccttgttattatagaagcaccccgcccccaaccctttattttctgcttgcagacatctgtgtgccatgttctatttctagctctgacgtcacgatcgaggcctgacaagactagcagcctggcattatctccatggagccagccaactgagcgaggagttctgtcctccctggaagccagggatgtgagctttacctgcgtgtaaatcgccgagagctgcagccaacactttataagcagaggtcttgccgcccatggggtctcctacaatcatatagccatgtctcaccagcatcatttcgtagatctgggaggagacatcattcataaaagaagctaatcattgcaacgctcccccattgtgagttagtcagaagtcaatgaggaatgaggggtcagaagaggattctcacagttgcttctacctctggagaacttcggttcttttcatggtctattgtttacatatctttcagacgaaaaaatatatgtgtgtgtctcagattatttaagggatgggaactaccatttgctctgtacttgtctatgtgttaagaatcaactgataacccaaattatttaatctactccaatatcattgaccaccttttacaaagggtaagactgagcccaagagaggttaaatacttgcccaagttcatcagtgatggagccagaatttgcagacagggctatttgactttaacgcctctaatattttcatgacactattgccatttatttttaaagagaaaaagaaaatggcggtcattttagcaaattgtgtttctcctggaaactttctttcttgagatctaactgctttggtcatttgcatttatgtgaattttatggtttaaacaaatttgctcctttagactgtgactccctcagagaaagggaacacaagcagctttgtattttaaagattaagttcttattatttttcaccttggaggtgagtaataagaagcatctaaatgaaggtagtgacaacgggagtggtagagaaaggaacacatgtaattcagcaaatattttttgagcatctactatgtgccagacactgttctgggtgctgtagacagagcagagaacaaaacaaacaaatccctaaccattaagtagggttgacattcaggtaggtttgaaagctactgtttgaaagttacagagcagagaacaatacaaaatccctaaccattaagtagggttgacattcaggtggtttgaaagcttgactgtgcatcagaaataagagaggaaggctgggctgggtagctcacacctgtaatcccagcactttgggaggtcaaggtggggggatcatttgaggtcaggagtttgagaccagcctggccaacatggtgaaatcccatgtctactaaaaatacaaaaattagccgggcatagtggcacatgcctgtaatcccagctactcgagaggctgaggcagcagaatcgcttgagcctgggaggtggaggttgcagtgagctgagatcacgtcactgcactccagcctgggtaatggagggagactgtttaaaataaaaaacgaataagagaggaaaacattaaagattcaatagcctctcacattcttcctcacattgagacatcaataagtaaaagggcaggtagctccagaacccttgtttttgaaaatattaccttgtttttgtaaattggtactaagctacatgaaagttcatctgtagatccgcaaattactttgaaatatatcaaaaagtaagatggatggatggacggatggataaaaaataaaacaaatagtataaaatattaattgtaaaatctgggtggtgagtacatgaatgttctgcgtacgtttcgttcaatttttctgcatgtttaaaatttttcataataaaatattgaaaattaaagttcatgcctagttaaagaatggtccttctgcaaaatctcaatcataaattggggttcaaaattgggttaaatgagttgtgtcaaaaattagctcacttgctaatacagtaggaaaaagaatgattgtttttaccacaaggcagtgtgatctcagaatctggagacctgggtcctaacttcacttgtaactcacattgtgactttgggaaatgatgatgccaatggtgctgctgatgatgacggagatggtggagttgataatgatatagtatcaggtactatgtgtagcactttacacacctcttctctcaaaatgactccattttacagaggactgaggataaaagaggtgaactaatttgcctaaaatctcacagcaaaaaatgatgggatttgggaggctgaggtgggtggatcacctgaggtcaggagtttgagaccagtctgggtaacatggtgaaaccccatccctacaaaaagtacaaaaattagctggggggtggcggcacgcacctgtaatgtcagctacccaggaggctgaggcaggagaatcgctggaacctgggaggcagaggttgcagtgagccaagattgcaccactgcactccagcctgggcaacagagcaagactgcatctcaaaaacaaacaaacaaacaaacaaacacaaaaactgatggagtaagtaagtgggttttttggttttggttgtttgttttacctccatttctttcttcttttttttaagagtcagggtctcactctgtcacccaggctggaatgcagtggtatgatcatagcccactgcagcctcgaactcctgggctcaaacgatcctcccacctcagcctctcaagtagctgggactacaggcataggccattacgcccagctaatgttttacttgcatttctacacaggcacctctgattgctgtcacttcagttccaatctcctataagactttactgtttgctgacttcagcaaacagtaaaacaggcacatttatatgggctaaggaaccaacctggataattttccctataaaccaaggtactggctggagtttcatctttttgatgttatcattcagcactttcagaaaaacttcatagtctggctttggaagaacaactccaggaaataaatcagatataattccctgttaaaaagaatttaaaagaaagtggaaaggataaagtatcagatatatgacctcaacattttcctaaaatgagatgtatcaacaacagagatctttgaaaaattccagaccttatttttcttgcaccaaaacttttctacaattacaaatgaaaatgctatttataaaacataatttctggctaggccagaatccctgtgtaatccctgcactttgggtgaccgaggtgggtggatcacctgagttcaggagttcgagaccagcctggccaacatggtgaaaacccgtctctactaaaaatacaaaattcagctgtgcatggtggctcatgcctgtaatcccagctattcgggaggctgaggcaggagaatcacttgaatccaggaggcagaggttgcaatcagtcgagatcatgccactgcactctagcctgggcgacagaacaaaactccatctcaaaaaacaaaacaaaaacaaaaaaaccgtgtaatttctcccccaaataattttaaaagtcagcaaatatttaataagtctggattatcttccagtcactgtactaggaatgaacaagatagtaatgacttctgtccttatgaagctcagagcctggcaagtaagattaaattaaattacaaaaggaaactaattaaactggataaaaacacatatgtatacccaagagcaaatattatcctatcagtgaaaccatttttattaaaaatcaggcagagatgtttgctatctatcactcttattatttaacatttgcagggagggtatcaggtggcagagatgctggccaaagaatggaagatggaagagggtatggggaaggcaccaaacacaacatttcatcttccaacattgagccttggtcctcggccaaggtcctgaaccgctacatacctgaaacagagggacatcttgcgctaagaacttggccagattgacatcaagcaatgcccggagcagcaggacactttcattctcctctggatacttgagcttcaggtttcctgcggcagtaagcacagacttgacagcgcgcataccgtagtcatagtgatgctgagaggacagttgttccgagcacaggcggtaggtcgcaacgatcttctgggcgagactagaagggcaaagacatgtatgcggacacccagagaggactacgtcctgcccagcagacattcccaatatccttgtccttgccccgtcagcaaccaggcatgcccatggacttgatggagaagccctatcctttaaggatattttaatagagttaccataatgtggtatggaagcatgaaaaaaagcaagtgaacatatatgtataacatgtatggtatatgaaatgatacgtttttggccaagtgcagtggctcatgcctgtgatctcagcactttgggaggctgaggcaggaggatcgcttgaggccaggagtccgaggccaggagtccaagcccagcttcagcaacatagcgaggctctatctctacagaaaaattaaaaaatgagctgggcatggtagcatggcacctgtcatcccagctactcggaaggctaagggtgggaggagctcttgagcccaggagttcaaggctgcagtgagctgtgattgcatcactacactccactttggattttcagatgagattggctgcgttcagtgtggtatggctgtagactcattttggattttcagcgagtaaaaaataaactttgttatggtaagccattgagattcaggggtcagcgttaccctaactaatacacttatgcacttttctctcaaggagatcctctttacagaactgatttcctttaaaaacaaagactttgtgttgttcaccagcacccagcacagggctgggcataaggttggtgactcaataaaggtttgctaattaaataaataaatgaattgagtgagcaaatcaatgcaatcctggttactatagaaaacaaatgagttaaatgtcatatgactgaggcagcctcttggcctaggaagggtgatattctattgagaatttctgtagccccttggattataaacaaagacatccaggccataaagacattcattataacagaaagtcaattgacatgataaaatttggaatagatcaatacaagccattttgcaacgattattcataactcttggtgcatgtgttatatgtatgtgtgtatacacacgtacacacttgaagacactgatccgtgtataactgtgtgtcttagaaaactggacaatacttgaatgagatataacctagttaattggaggcaataaatgttatattaataatttttcctcttcaattctggaataattgcatatgttttatagtgttgcttttttttttttttttttttttgagacagggtctcactccgtcacccaggctggagtgcagtggtgaaatcttggctcactgcagcctccgcctccacggttcaagtggttctcctccctcagcctcctgagtagctgggattacaggtgcacgccaccaagcccagctaatttttgaattttttggtagagacagggtttccccatgttggccaggctggtctcaaactcttggccttaagtgataccccgccttgcctgccaaagtgctgggattacagacgtgagccaccacacccggccttatactatttgttgccttaagccatttagtaatgtgggtatggatgtgttagagtgagaggtgaggaagatatgagtagctactttctttaacagaactcaggtgtatgtaaagagacagcagggttccgccctgggaatctgggccatttccccgtcagaaatggggcaagaccaaggccagggctatgtgctctcagaccacccagtaagcagaagcaagtttctcaagcttctctctcttcttccaatgggcaaaccaccttgaatctgccacgcaaaaagccgctatttaaagtcctttagaatgcactggaaaacccatgtaacacaccttctggagtccagaaaccccatggagtagagggagatttctccaatgagggcgtaatctgggaccatcatggccactgtccggaacaaggcctggaaaagaaacaacaaatcagaatcggaacacgtgcagtgaatactgagggaacgcacattcacagaagcaaagggaagtagctttgcttcattcaggccactccagtgacaataaaggcaagaaggactgggggacaagtgagtgcagatggaccatcctcggtgggccaatgcatggctcaaccaacctccccactggccctatgcgggtacatgttgttacttacattgggtccctcaatggttctgtggaaggccctaggtgctggtacacctcattctcctatgccaaatgaggacacctcatagcatcactcaactgttggagcttcccagtgttcaacatggacatcagaagtcatttaggaatgcagaaccaatatgcatcagaagaatcccaaagccagacagattttttttttttttttttttttttttttaagacagagtctctgtcacccaggctggagggcagtggcacgatcttggctcattgcaacctccgcctcccaggttcaagcgattctcgtgcctcagcctcccaaacacctggggattacaggtgcccaacaccaggcccagctaatttttatatttctagtagagatggggtttcatcatgttggccaggcttgtcttgaactcctgacctcagatgatccaacagcctcagcctcccaaagtgttcagattaaggcgtgagctaccgcgcccagccagacagatcttgatttgagttcttgttttgctaccgactagcatgggcaagttatacaacccttgtagatctctattctttcatctcaaaacagactaactttaccctcttcatagagttatcatgagaataaatgatagaatgcaactgaagtgcttgcaagagtatgtggcacatagtaagtgttcagtatgcaccagctattgcattattatcttagatcttagaggagaagtaacttgcctgagtcacccagttagagctagagccagggctagaatctaggcttcctgacaccatgcctgggtgctttctactatcccatggcattgtgaaagctgcttgtgacgatctaatatggctgttggctgggatggatgcagggggtgcttacaaatactgggcagtaaaaaatgagaaatgtggctgggactggtggctcacacctgtaatcccagtgctttgggaggccgaggcaggcaaattgcctgaggtcaggagtttgagaccagcctggccaacatggtaagactctatctctactaaaaatacaaaaattagctgggcatggtggcgcatggctatagtcccagctactcaggaagctgaggcaggagaatcacttgaacctgggaggcagatgtggcagtgagccaagatcatgccactgcattccagcctgggggacagaatgagactccatctcaaaaaaaaagagagagagaaatgtggatccaaattctatcttggccttcactggcctatgttgacctagatgggaggagccacttgaagcatctctctgactcttttctcttctcagagagaagtggtccatctgagtaagtttccagggcaccagtcagaatgcattagtaacagggggtagaccatgtcctaaagtccgtggatatgggcgtagctgggtctctcttatcacttccacccaaggggatggaggaataaatttacccccaggtaggtacctccagaggtttcttttctttcgctttgttttttttgagatggagtttcactcttatctcctaggctgagtgcaacggcgctatctccggccaccacaacctctgcctcccacattcaactgattcttctgccttagcctcctgagcagctgagtgggattacaggtacatgccaccatgcccggctaatttttgtatttttagtagagatggggtttcaccacattggacaggctgatctcgagctcctgacctcaggtgatttgcccaccttggcctcccaaagtgctgggattataggtgtgagccgccacacccggcccagaggtttctattctaaaaagcacaccccacatgtatatctgctggcatttaccttgagattgtcgggcagttcagccctgccagcatacccggggttcatggtgatgaacacagcgcaggttgggttcagagagagctcagtcccttcaaagatgaatgtctttagcttccgaatgatggcttgttggatgctgaggatctgctgagcgaccacagacagcacttctacctggggtgagaatgcccggctgataagagcatctgcttctgtctgacaaccaccctactctaccggagtcctcccacatagcaaagaaagaacccaatcacccaaaaaccgcacctgcacattcaaaattaggagcatgatttggggttttggtaagaaaaaagaatataggtttgtgcatgtgtgcatgtgcgtgtgtgtgtgtgttaatagtttccatagtactttatctttgtttcaacacctagcatagtacttgacacacagtaggtattctgtgtttattggttcaaagatcagggatttttatatttcctgatctttattcatcatccaaagagaattatacactctttgtgatgcatcttttgtacttctactatagacttttagcacgttggtatttgtttcattaaattttttatttccctttactagatcgcaacagtctagacagcaagatcttttttcttttttttaattattatactttaagttttagggtacacgtgcacattgtgcaggttacatatatatacatgtgccatgctggtgcgctgcacccactaactcgtcatctagcattaagtatatctcccgatgctatccctccccactcccaccaccccacaacggtccccagagtgtgatattccccttcctgtgtccatgtgatctcactgttcagttcccacctatgagtgagaatatgcggtgtttggttttttgttcttgcgatagtttactgagaatgatgatttccagtttcatccatgtacctacaaaggacatgaactcatcattttttatggctgcatagtattccatggtgcatatgtgccacattttcttaatccagtctatcattgttggacatttgggttggttccaagtctttgctattgtgaataatgctgcagtaaacatacgtgtgcatgtgtctttatagcagcatgatttatagtcatttgggtatatacccagtaatgggatggctgggtcaaatggtatttccagttctagatccctgaggagtcgccacactgacttccacaatggttgaactagtttacagtcccaccaacagtgtaaaagtgttcctatttctccacatcctctccagcacctgttgtttcctgactttttaatgattgccattctaactggtgtgagatggtatctcatcgtggttttgatttgcatttctctgatggccagtgatgatgagcattttttcatgtgttttttggctgcataaatgtcttcttttgagaagtgtctgttcatgtcctttgcccactttttgatggggttgtttgtttttttcttgtaaatttgtttgagttcattgtagattctggatattagccctttgtcagatgagtaggttgcaaaaattttctcccattttgtaggttgcctgttcactctgatggtagtttcttttgctgtgcagaagctctttagtttaattagatcccatttgtcaattttgtcttttgttgccattgcttttggtgttttagacatgaagtccttgcccatgcctatgtcctgaatggtaatgcctaggttttcttctagggtttttatggttttaggtctaacgtttaagtctttaatccatcttgaattgatttttgtataaggtgtaaggaagggatcaagtttcagctttctacatatggctagccagttttcccagcaccatttattaaatagggaatcctttccccattgcttgtttttctcaggtttgtcaaagatcagatagttgtagatatgcggcattatttctgagggctctgttctgttccattgatctatatctctgttttggtaccagtaccatgctgttttggttactgtagccttgtagtatagtttgaagtcaggtagggtgatgcctccagctttgttcttttggcttaggattgacttggcgatgcgggctcttttttggttccatatgaactttaaagtagttttttccaattctgtgaagaaagtcattggtagcttgatggggatggcattgaatctgtaaattaccttgggcagtatggccattttcatgatattgattcttcctacccatgagcatggaatgttcttccatttgtttgtgtcctcttttattttgttgagcagtggtttgtagttctccttgaagaggtccttcacatcccttgtaagttggattcctaggtattttattctctttgaagcaattgtgaatgggagttcactcatgatttggctctctgtttgtctgttgttggtgtataagaatgcttgtgatttttgtacattgattttgtatcctgagactttgctgaagttgcttatcagcttaaggagattttgggctgagacaatggggttttctagatatacaatcatgtcgtctgcaaacagggacaatttgacttcctcttttcctaattgaataccctttatttccttctcctgcctaattgccctggccagaacttccaacactatgttgaataggagtggtgagagagggcatccctgtcttgtgccagttttcaaagggaatgcttccagtttttgcccattcagtatgatactggctgtgggtttgtcatagatagctcttattattttgaaatacgtcccatcaatacctaatttattgagagtttttagcatgaagggttgttgaattttgtcaaaggctttttctgcatctattgagataatcatgtggtttttgtctttggctctgtttatatgctggattacatttattgatttgcggatattgaaccagccttgcatcccagggatgaagcctacttgatcagggtggataagctttttgatgtgctgctggattcggtttgccagtattttattgaggatttttgcatcgatgttcatcaaggatattggtctaaaattctctttttttgttgtgtctctgcctggctttggtatcagaatgatgctggcctcataaaatgagttagggaggattccctctttttctattgattggaatggtttcagaaggaatggtaccagttcctccttgtacctctggtagaattcggctgtgaatccatctggtcctggactctttttgattggtaagctattgattattgccacaatttcagctcctgttattggtctattcagagattcaacttcttcctggtttagtcttgggagagtgtatgtgtccaggaatttatccatttcttctagattttctagtttatttgcgtagaggtgtttgtagtattccctgatggtagtttgtatttctgtgggatcggtggtgatatcccctttatcattttttattgtgtctatttgattcttctctctttttttctttattagtcttgctagcagtctatcaattttgttgatcctttcaaaaaaccagctcctggattcattaattttttgaagggttttttgtgtctctatttccttcagttctgctctgattttagttatttcttgccttctgctagctttcgaatgtgtttgctcttgcttttctagttcttttaattgtgaagttagggtgtcaattttggatctttcctgctttctcttgtgggcatttagtgctataaatttccctctacacactgctttgaatgcgtcccagagattctggtatgttgtgtctttgttctcgttggtttcaaagaacatctttatttctgccttcatttcgttatgtacccagtagtcattcaggagcaggttgttcagtttccatgtagttgagcggttttgagtgagattcttaatcctgagttctaatttgattgccctgtggtctgagagatagtttgttataatttctgttcttttacatttgctgaggagagctttacttcccagtatgtggtcaattttggaataggtgtggtgtggtgctgaaaaaaatgtatattctgttgatttggggtggagagttctgtagatgtctattaggtccgcttggtgcagagctgagttcaattcctgggtatccttgttgactttctgtctcattgatctgtctaatgttgacagtggggtgttaaagtctcccattattaatgtgtgggagtctaagtctctttgtaggtcactcaggacttgctttatgaatcttggtgctcctgtattgggtgcaaatatatttaggatagttagctcttcttgttgaattgatccctttaccattatgtaatggccttctttgtctcttttgatctttgttggtttaaagtctgttttatcagagactaggattgcaacccctgcctttttttgtttttcattggcttggtagatcttcctccatccttttattttgagcctatgtgtgtctctgcatgtgagatgggtttcctgaatacagcacactgatgggtcttgactctttatccaattttccagtctgtgtcttttaattggagcatttagtccatttacatttaaagttaatgttgttatgtgtgaatttgatcctgtcatgatgatgttagctggttattttgctcgttagttgatgcagtttcttcctagtctcgatggtctttacattttggcatgatttcgcagcggctggtaccggttgttcctttccatgtttagtgcttccttcaggagctcttgtaaggcaggcctggtggtgacaaaatttctcagcatttgcttgtctgtaaagtattttatttctccttcacttatgaagcttagtttggctggatatgaaattctgggttgaaaattcttttctttaagaatgttgaatattggcccccactctcttctggcttgtagggtttctgcagagagatccgctgttactctgacgcgcttccctttgagggtaacccgacctttctctctggctgcccttaacattttttccttcatttcaactttggtgaatctgacaattatgtgtcttggagttgctcttctcgaggagtatctttgtggcattctctgtatttcctgaatctgaacgttggcctgccttgctagattggggaagttctcctggataatatcctgcagagtgttttccaacttggttccattctccccatcactttcaggtacaccaatcagacgtagatttggtcttttcacatagtcccatatttcttggaggctttgctcatttctttttattcttttttctctagacttcccttctcgcttcatttcattcatttcatcttccatcgctgataccctttcttccagttgatcgcaccggctcctgaggcttctgcattcttcacgtagttctctagccttggttttcagctccatcagctcctttaagcacttctctgtattggttattctagttatacattcttctaaatttttttcaaagttttcaacttctttgcctttggtttgaatgtcctcccatagctcagagtaatttgatcgtctgaagccttcttctctcagctcgtcaaagccattctccatccagctttgttccgttgctggtgaggaactgcgttcctttggaggaggagaggtgctctgctttttagagtttccagtttttctgttctgttttttccccatctttgtggttttatctacttttggtctttgatgatggtgatgtacagatgggtttttggtgtggatgtcctttctgtttgttagttttccttctaacagagaggaccctcagctgcaggtctgttggagtaccctgccgtgtgaggtgtcagtgtgcccctgctggggggtgcctcccagttaggctgctcgggggtcaggggtcagggacccacttgaggaagcagtctgcccgttctcagatctccagctgcttgctgtgagaaccactcctctcttcaaagctgtcagacagggacatttaagtctgcagaggttactgctgtctttttgtttgtctgtgccctgcccccagaggtggagcctgcagaggcaggcaggcctccttgagctgtggtgggctccacccagttcgagcttccaggctgctttgtttacctaatcaagcctgggcaatggcgggcgcccctcccccagccaggctgccgtcttgcagtttgatctcagactgctgtgctagcaatcagcgagactccgtgggcgtaggaccctccgagccaggtgcaggatataatctcgtggtgccccgttttttaagcccatcagaaaagcgcagtattcgggtgggagtgacccgattttccaggtgccgtctgtcacccctttctttgactcagaaagggaactccctgaccccttgcgcttcccaggtgaggcaatgcctcgccctgcttcggctggcgcacggtgcacgcacccactgacctgcgcccactgtctggcactcccgagtgagatgaacccggtacctcagatggaaatgcagaaatcacccgtcttcttcgtcgctcacgctgggagctgtagaccggagctgttcctattcggccatcttggctcctccctccttttttttttttttaaacagagtttcactcccagcctggagtgcaatggttagatcttggctcattgcaacctccgcctcccaggttcaagccattctcctgcttcagcctcccgagtagctggggttacaggcactcaccaccatgcccagctgatttttatatttttagtagagacagggtttcaccatgttggccaggctggtcttgaactcctgacctcagatgatccacctgccttggcctcccaaagtgctgaaataacaggtgtgagccaccgcgctcagccaagactttttttttttttaagagacaaagtctcactctcacccaggctggaatgcagtggcggcatcaaagctcacttcagcctcgaactcctgggctcaagcaatcctcctgcctcagcctcttgaatagctgaggctattttatttttgtagagacagggtctcaactgtgttgcccaggctggtctcagactcctgggctcaagtgatcctcccaccttggcctcccaaagtgtcaggattacaggtgtgagcctctgtgcctggctatacaaccatttcatgctcatctctgttgcatgaacttatgcagaatctctgatgtatagtagctgctcagtagctactatgggcaagtgaatgaattaatatgatggggagatggggctatgtgtataaaacatgcatctgtctccttgagagtccttttgtttagttcactgagtacctgctttggaggttcttgtgtctgccatacaagagatataaggccctgttattaaggggtgcagagccaagaaaaaagcccctccatgcacagcttctttgttctgcagcctagaggcagagttacctcgatcctgttgaactcatcaaagcacgcccatgctccagcctgtgccagccccttgaagaacttccccatagctttgtaatccaaaccatcggagcagttgaagaccacacactagaaagagggaggatgtgggtatcattcagggtggattccatcccatctgaattaccccgcaccattcaacagcagtgggctcctctctccttgctctgcttgaaggagctggggcccatgctgcctgttaatgctaaaccatcttaaagttgatgcctacttcccacaggaggggtgcagagagggcctggaagagagggaggggatagatggcatttgcttacctgcttagccaaggctttggccaaatctttggtggtttctgtcttgccagtcccagctggaccctctggagcacccccaaggttcagcttcaaagctcccatcagtgtcctatggggaagaaaatagaacttcagtgcttgaggtctaagacacaggaaagaaaccggcttttcatttattttgactcatacaaatatttaggttagtgcaaaagtgattgcagtttttgccattgaaagtaatgctaaaagccgcgatgacttttgcaccaaccaaatagttaaaatttttcccaattatatgagcaatacaatatcactgtattttactcggcattgtaacctcagagcccagcacagtgtccagcacatgagtggcacccatgaatatttgtttgaatgaataaatgaatacatgcatacctatataaatgaatcaaataaaagtgagaatactcataaactctacattccaaagatcaccagtgctaatggaatggttaaaatatatttctccaactagattatgaattcttttttttcttttgagacaggttctcactctgtcgcccaggctggagtgcagaggcatggtcacagctcactgcagccttgacctcctgggcccaagtgatactcccatctcagcctcccaagtagctgggacttacaggcacacaccaccacacccagttaattttcatattttttgtagagatgggattttgccatgttgcccaagcgggttggtctcaaacttctgggatcaagtgatccacccaccttggccttccaaagtgctgagactacaggcgtgagccaccatgcccagctagattatgaactctaaagttcaggaatcatatttgattccatttcataacctcagtaaattaatacagctcctggcatgtaataggtgcaagataaatgttagaaatgaatgatgtaataactgtggttccatggcccatggtatgagtttctatgttttcatttagcactctatcttgtaatcatttgaatatgtctctcccgaccccccagttagatttagggtttcttgaggtcatgcatggtgcacaggaaacctcaaaaaatggttgttgaataataagtggaataaataaatgaatgaagagcaaaaatcatagaccataaaaaacaagtggttgaggattttgaagggagaaaatactcccaagtattagttttacaatctaaaaaactctcactgtaaggaaatatataaaagcaaagaacatctaaacatcacaaaaccgacaagttcacaaaatcccgatctcaaaggctgagttccacagaaaatgtcagaggactttgctgagcacagaatggccagcttttttcatgagactggctggcagagcatagagaccccttggctacgttcttgacctcacttcttgtctatcttatggccataggatctccaggcaccatcttgattcctgccattggagagccctctacgttaagtcctgtgtcatgttcacggatgtgcaccaatattccacttgttggttcaaatacattgatttgcactagaattcctactgggttctcatgtctagcctgaagacctagtttgcatgcccatctttgggactatggagaatctaataatctgaagtgtgaagggtaaaggtaacccaagacatccctaactttcctccccagagtcttcttcccctggagttctccgttcacccctcagatctaggagctccagagtgtacctgtagcagcggtcggtgaggggtgtgatcaccagccggggggagtttcccaggtactcatagccatacaaggcttctgtggtgataatctgcacctgcacatccttggccacccagtagtagcgcagctgtgagatccattggaaatcattcagatcggagaccctgtcctcagataacttggccaccacgtcgcgggctgttgggacacagatgcagaaacacgcacacagagccatcagaactctccatctttgtaagctcctcagttacaagtggatgttatcaaggtcccccattctccaaactattttattttattttattttatttattttttgcgatggagtctcgctctgtcccccattctggagtgcaatggcgcgatctcggctcattgcaacctctgcctcctgggttcaagcgattctcctgcctcagcctcccaaatagctgggattataggcgcacgccaccacacctggctaatttttgtatttttagtagagatggggtttcaacatgttggccaggctggtctccaacttctaacctcaagtgatccgcctgcctcggcctcccaaagtgctgagattacaggcgtgagccaccgtgcccagcccaaacaattttagatttcacaagcctccttgcccacccccaacctgcaggcagcaatatctgttagaagctggtctttgctttctcccaaagccaggcagagaatctgctgcactatcttctctcagacagcacggcagaggtattaaaaggtgcgtgctctgaaatcagactggctgcgttcaaattctgattccaccatgacctagctatgtgactttgggtaagttccttgacctctctgttcttcagttgtgtaatctgtaaaatagggataacatagtacctacattatagagttatcatgaggattaaatgaatatataggtacatacatacatatctacagctagacacaatagagagagaaagagagctgtccttggcatatgaaaatgttatacaggtattagctattgttatcatccccaaattcttggaagtctgagccagagagctttgcaatgcatagtgactccaaattccatcctatttccagtataacccttttggtcccatttcaggcccctaggatatcctaggagaatgcaatcagcgtggccttatatagcaggggaaggaagcccgagaatccatggttagatgtatcctttccatctgggggcctgagaaaccagctgggagatacatttctagctcttcttttttctctcatgggaacgtaagccctgatttaattttatccaagtgacaggggccttgaagttgaagagtggatctaggctgatgagaatcattcattacgtttttggtaactcaggtggagagctatggagatctcagagctagtacagccgactcaaaattaggacctcagaaacgtcacttttcaaagggttgcttccattgagcctttccttcctctctgtgacagagtcttctttattacagtaaaataaaaaaccctgcagggaagagtccttgaagaagattatatccacagctttttcttccttcccaaggaatttaattcccctcctggctcttgggtgaatatataggggaaccacctgatacattctcccaaggaagagggtatagggcaggagtatggtatgcctgagggatccaagaggaaagcgaatttcaagggtttgagttggggatgccttcgctatacagtgtgtgtatgtgcacttgcatgtgtgtgtgtatgtgccattgtgtacatgtgtgcatacatgcatgcttgtgtttgtgaacccaaccacactggggtaccctgggcagtataaccacatctgcaccaattattcctaacagctgagtatgtggccgtgtgaagagcacattttcccttctccctccctgatgttatgctggtctacctaatgaaatcagattgaagtgagcattaacctgaggggagtgagatgccatgaaatgccaggagggagctgggagtgtgagcaagagactctgttcccaagcaaccagcctggtccagccctagtttccttggtgatggagtgagggtgtgggggtggtttgttttatataaagaccccagtttttcctcctcctcctcctcctcctcttcctcctcctcttctttttaaaggaggagctggaaggcatcctctctcaccacccactgcttgcaacattgcccatttccagtcccttaggcttggaagcagacagacataggcgattctgttgcttactattatagctgtatgcctctcagcaagttagttacctctctaagccccaggttctgaatctgtgaaatatctatgaaaatgagataatgtatgtcaatcacttagcacaaagcctggcacctagcaagcattcaaaaatattatctacggctagccaaggaaatgattccacgttggtgaagctcagaaatgactttggccatcattgtctcagtacaagccctgcttggagggtccctggaaatcaggttgcggatgggagaggaaacacaggtggagggatgcagagccctttggctctcatcttactctcagttggagaaagctctccctaatgaggaaggaaaccctgaattattccgtccaggagaactgagatgagcaagactagactgcttctcctggatagtcagtaatgacaggggaagccccctggcttaccgtggacatcgatgaccgtgagggccccgagagtgagtcgagctccactgctcagcttccctcgcaccagctggacaatctgcgcaatctgatcattgctctttttcagaaaatcctggaaggggcagaggaggggacaactggttacatttgactctcctctggtaatccccatgtcaagaaatggtaccatggaccaccggatggctcaagccagactcctgggtgtcatccctcaagtccaacttttccttaccccagtccttaatctctgaatgaattcctaatgcattatgctgaaagaggcaagatttggaaggtttcatactgcatgattttatttttatagtattgtggaaaaggcaaaattataggagtgagcagaaaataccttggtaattactggaggcttggagtagagaatgcaactgactacaaagggcctgaggacattttttttgggtggtgtggaactgtcctatatattgattgtgatggcctacacaaatgcatgtgtttatcaaaactgagaaccgtatgctaaaaaaggtgaatttcactgtatataccataaatcagaattaacctcccaaactggaaactttttcacattaaagagacaaaggagctataaaaacaaaatgcaacatgtaatcctagattgcatcctggaccagaaaaaaaaaaaaagacagtagggcaattggctaattttatttatttatttatttattttgagacagagcctgactcagcctcccaaatagctaggactacaggtgtgcaccaccacactcagctaatctttgtatgtttagtagagatggggttttgccatgttggccaggctggtctcaaactcctgacctcaagtgattcacccaccttggcctcccaaagtgctgggaatacaggcatgagccaccacgcccggcctgtcatttctttttcaagatgacaaaatttaaattagccaatttagaaaggtctatagagtagagaataaaatcgtatcagtgttgatttcctgatttggataactgtactatggttgtctaagatgttaatatatgaggaatctggatgaaagatatatggaaattctttgtattatatctttgtattatattttcagcattatttataagtttcatgttatttcaaattaaagaggcaaaaaataaaataaaaagaaaacttaaaaaggaaaaaaagtaagaccaccctaggttaaaatcctaccttccctactttctagctatgtggctcttggcaaatgattttatgcttctgagtctcagtctcctggtgtgtgtcaaatgcagattttttttttttttttttgagatggggtcttgctctgtcacctaggcaggagtgcacaggcacaaacatggctcactgaaacctcgacctcctgagctcaagcaatcctcccacctcagccgcctgagtagctgggaccacaagcacacaccatcactcctggctaactatttgtagagatggggtctcactgtgttgcccaggctggtcttgaactcctggcctcaagcaatcctcccgccttggcctcccaaactattgggattacaggcatgagccaccgtatcctgccctgaatctagatgattatagctgcctcttcaagctgtgttgaggattaaatgaggtagtgtatgtggtgttggggcttctccccacatctctcctacccacacccattgctcagctattatagaccgaagtgtcttcctgctggaatacaccatgctgttcatcttcaggcttttgcatactccagttcttctctctggaacactctccctcctattttctgctcagctaatccctacttatatttcaggtcttttcttagacaccacttttctgggaaatcttccccaatcctaacttccctcccctcactctcttactctttccttccttcttttttcctccctccctccctccctctctcccttccttccttccttctttaaaccctccctccctccctgcctccctcccttcccatacttactggatgtctgttctttccttatcacagttctgtaaaagagcctttttctctctcccactagactataaatccatgaggagagggactatgtctgtctcattcacatctaattaccttcgttagcagcagtaccagcacagagcagatgccaaatcaatatttgttaaatgaacaataaatggttggaggaagggaaggatgattattctgtgtcaacacctgcttcctttaggatacggagacacatcacacagcatgcatgcacaccagggcctggatgtatgacgggaaacattctccctaactatgggtgggaaaactggggcacatgaatccacctccatcacaaaaagtcagagataccatcacaaaagtcagaggattttagtttctaaagtttgaaatgatgtacgtgaaagcagtttgcatgtgtacagtgcaatatgtctattaggatttatcaatatggaatctgtataagtttaaacactggccaaatattaatgttctaatttcaatttatacagcaaaatataggaaattaaaacatattctaatccacagccaatcctctaagaggagtaacaggaggtctggtgagatattcatggagaatcaaaccatggaagaaaggctgagtatgaagttttcattcatccatttaacaaatatttggtcaggcatggtggctcccagcactttgggaggctgaggcaaggaggattgcttgaggccaggagttcgagaccaccctggccaacatagtgagacccccgtctctagtttaaaaaatagaaaaagtttaaaaacaaacaaacaaatccccaaatatttattgatcatctactctgtgctgggcactgtattaacccctggaaatataatagtgagcagagcagacatagcttcttccccgtagggtttacagcctcgtgtctaagtaccgaatcatttactggcatctcatttaaccctcccacaatattatgatgtgttgtgacaattccttgcatgttacagacaaggagcttgagagtcgggttaagttgctcatggtcacgcagctaacaagagacagtgtcaggatttgaactcaagtccatcaggtcttaacagtcaagcattggcatcatttggctgggaatatgtgtatttggatctgaggataaacagatgcttgagtatacttggtcacaagagaaagctgaaggcaggacgggaggtgggttcattcgggagggagtaggggtgatgagaaggaggctgtaaaggagaaggagaggcagatggtggccccttggcttaggaagaatataggaggtctcccctggtggaaattctgccaggttagcccccagaagccaagggtataagacttagaatcctgcagtccagaatttctgtctgggaaggactatgagaggtctcgtaccatagaattgcaggacagctcgaatcccaaattctccatcccactgtcctcatgggaaccctgatgtctgtgatgctgagaccaaatgatttttgtttagacaacaaaacatggctactctaattatacgtcattcaaatcctaattgatgcttggatctcttctgtaactttgcagcaagttcacttaccagtaaggtattttccgccagggcttgggacacctcctgggtccaaaagatggaggagacacagataaccacctgtccaggccactgtaagacccagtgatttcgagggacctggaaaagcacagtgggcatgttataggatcagttcacgtgtggtttaaactgagtttacgaaaacatgccccaaccacctcaccaccgcaacaaaaacaaaatcttcccccatcctcagacgctacaaggcttgacatctctggaattactgatttatgtcttcctttctgagttttatgaaaaagaaaaagaaaaaacaccaatcatctcatcaactttgcattttttccatgctcccatttatcaaatttttccatagttataatcaaggtgatgttcagagagttctcataactactgttttttaatggctacataatattgcagtgctgagtcacaatttttttagctgtttctccaccccacaattctttccctcaagctacagatcaggagcgggcaaactatgtatataaattttttcataaataaagttgtattgaaatacagccgcagcatacaaaagaatgagttcatgtcctttgcagggacgtggatgaagctggaagccatcattctcagcaaactaacacgggaacagaaaaccaaacactgcatgttctcactcataagtgggagttgaacaatgagaacacatggacacaaggaggagaacatcacacactggggcctgttaggaggtggggggcaaggagagggagaacattaggacaaatacctaatgcatgcggggcttaaaacctatacgatgggttgataggtgcagcaaaccaccatggtacatgtatacctatgtaacagacctgcatgttctgcacatgtatcccagaacttaaagtaaaataaaataaaatttaaaaaaatttaaaaaaaagaaatacagccatgcccatcatttaaatattgtctgatgcttttgtgccacaagggcaaagctacagtacccatttactatacatatgtgtcttataacattatgttgtataccttaaatatatgcaataaaatttattttaaaaaatagttgcattgggaatgtggcctgcagagttgaaaatatttactatctggctctttacagaaaaagtttgatctgaggataaaatttgatagatttgatttggatgaaataatttcatactggtaactgcttttctttaatttttgattcagagcatgtcataggaaaagggactggtctttcattttacaatgcaaatactgtgtcaagggacagcagggtcagtccccaggactttagtgtgagggtgttgagtattgctttgttctgtgggtgctgggaataagaaagtaagaaagttagagtcagtcagccgggcacagtggctcatgcctgtaatcccagcactttgggagaccgaggcaagtggatcatttgaggtcaggagttcgagaccagcctggccaacatggtgaaaccacatctctacgaaaaatacaaaaattagccaggtgtggtggtggttgcctgtagtcctagctacttgggaggctgaggcaggagaatcgcttgaacccaggaggtggaggttgcagtgagccaagatcgtaccactgcatttcagccctgggagacagagtgagactccatctcaaaaaaaaaaaaaaagaagaaagagagctagagtcgctcaacgtgaatgtgactacaggctgggtaccaagttattctgatagattcttttgtcttaagccttacgtcatacctatttccctttaagctttgggaacacaatgagttatgccactcagggcatctgtaaggtaaatgaattattaattggaagggactctaaatagacttcgtgccattaatcccatttgacaaaaaggactggtccgtggcaaccagagggttccagctaaccctcttctcttgcatcacctgcttctaactgccagtatttcaccaggaataggttcattgccccagggttcacaagtgaaggaaagagaggtgcagagggacaggttttggtagaaagcagagggtccagccaaactactgacacatgaaccttctccccaatgttctctttagtgcactagtgtcctggcatgtgtaccccggttcttgtttaccttgacatatgcttcaatcccaagtccaatgacttctcgcatactggccagcatcatctgctccacctgctggagccacttttccaccatgccctatggagcaagacagagagagggtgcagcagtcaaccaaagcccagagggagggagagtgggcagaacacagctttctctctggacacggctggagggatgccaaaggcttggcaccttttcaagtcaatattctctgtctccccgttctttttttctttttttttttctttttttttttttttttgatacagagtctcgctctgtcaccaggctggagtgcactgtcatgatcttggctcactgcaacctccgactccctggttcaagcgattctcctgcctcagcctcccgagtagctgggattacaggcgtgcaccaccaccgcggctgatgaattttgtatttttagtagagacggggtttcaccatgttggccaggatggtcttgacctcctgacctcgtgatctgcccacctcggcctccaaagtgctgggattacaggtgtgaaccactgcgcctggtctcttcttttttttttttttttttttatagagagagacagggccttgctctgtcatccagactggagtgcggtggcacgatcctggctcactgcagccttgaactcctgggcccaagtgactctcctgactcagcctcctgagtaactgggactacaggcacatgccaccatgcccggctaacttttaaatttttctgtagagccgtggtctctctatgttgcccaggctggtcttgatttcctggcctcaagagatcctcctgcctcagcctcccaaagtgctgggattacaggtgtgagccatggcacctggccttggccccagccaatattccaatattctttatctgcttgacacttattttctgtattctcagaagcatatgccttctaaaggggcgataggccttttttttttttttttttttgagacggagtttcactcttgtcacccaaggctggagtgcaatggtgtgatctcggctcattgcaacttccgcctcctgggttcaagcgattctcctgcctcagcctcccaagtcgctgggattacagcatgtgccactacacctggctttttagtagagacagggtttcgccatgttggccaggctggtctcaaactcctgaccttaggtgatccacccgcctcggcctcccaaagtgctgggattacaggtgcaagccaccacgcccggcccatttttaatacgcattactttcatgtcattttctgaaacagacaacttctcagaaggcaaatgaaacatttatgtcagttcataaaataaattgcatcttttaaatgaacagctctgattcatgcattattccagtgggtctcaaactttgctgttccttgaaatcacttggagatcttttaaaaaatactgatgactgactcccacccctagacttcctgatttaattggtatgggatgcaacctggtcatttggattttgatcaaaactccatagggaaattcaaatatgccccaaattattcagtgttagaatttcaggtaactgtagctattgacttcaggtgcttgtaagctagctggtgtctgcattggtaatgtgactcctggttgctgcagtttatacgcgtgggtggcaaaaacagtcaacaaagcaaggctcagcttgcttgtctatttccacttgagggtgctgtcactgagcagaaatggaagtaatttatactttactcattatataaggacatatgtatgaaaacctgagttaagttgcattatagctctcattgattctatgatgttttattgatctttaaaatgaatgccccaggaagctacctgtctaactgaatcactttcaactgaactctgcacatggaaatctaaacagcatcggctgtttggatctgattcctgcaattgactccacatcgagttgggttaaaatccacaaatttaatatgtcatgtggattgcagtggaatccccatcttagagatgggtacactgagactcagaaagattgagtaacttccccaaatcttcagtcgttacatcgtagaacccaagtgttccataccccaggcagtctggtgcttagtcccagtgcttagccaatacgctctctgatttactctgttatggagaaaagaaccaaaaatgggtaagaggagttaccttggcattagctgggtagattttctgtatgaatggaacagtttctttttccgagctgatcatgcccacaatttccagattgtctgtaaactcaagcttggcaattccttcaaagcacttcttcaagtgcggctgcactcggagagggtcctttgtctcggacaagatttccagcagctcatcgtttgataggaagaagaatctatttcaaagcaaagaaagatggtaactggaacctcttccaagaactttttctagcaaggtgatactttctgacaggtagtccgcacctacgtgaataccagttatgtcttgcggtcttcacaaaggcccactctcttttatcacttttcatctggggcatggaaggtggagttttgcttttcttaagagatgaggtcttgccatattgcccaggctagacttgaactcctgggctcaagcaatcctctctcctcagcctcctgagtagctgggattactggcatgagacattgcacccagcttggagatggttttgactctgagataccacacttgatcttagtcaaaagaccaagaagcgatggttttgagtctgacagcaagagaacgaataaaagctggcatgtgtgggtttaataggactgggggatgggtgctatcagttgaaaggagcccggatagaacagcaattctcagctttggctgcactttagaatcacctggggagcttatacaaaattccagagccacagtcccattgtccagagattctaatagaattgatctgggagtgcggctgatgaaatttgtatttttttaaatttcaggtcattctaatgtgcagtcagtgttgagaaccactgggtaggggcaggagagagagacttccttgtctttccttctctccatccgtgcaagaacattgtataggcatgatacaagaaagtaaatgttaataatgagcctatttacatgcagaggcctctaccaccttttatttattttatttatttttttattttattttattttattattttatattttattttattttattttatttttatttttatttttattttattttatttgagacagggtctgtctctgtcacccggcctggagtgcagtggtgcaatcctggctcactacagccttgacctccagggctcaagcaattctcccacctcagcctcccgagtagctgggactacaggcgcatgccaccacgcacggctaatttttgtatactttgtagagatggggtcttgccatgttggccaggctagtctcaaactcctgggctcaagtgatccatccacctcacctcccagagtactgggactgtaaatgtgagccactgcactcagccctttactatcttttaaattagagataataagacaatttcatctcttgttcaggcctaaaagcagcaacaacaaaccttcagaaaatgtccaatattcaaacctgtactgtgaccatcaggctgaaagttctatgatggagggattgtgtgattatggtctttaccaaatatggtggattacaaaaatggccacgatatttacagttcctctcatcaaggggtggagtctgttttcacatttctcaaacttgagctggctctgtgtcttgctttggctaatagaatgtaagtgaacatgagtctgtgcacgttctaagcctaggcatcaagaggccatgatgctttcactcttgctgctcttaggaaccctgtgaccaccaccatataaataaacccaggctagtcttctacaggataaaagacatgtggcccaaatacctgttgtccagccagtaggaagccaatgaccagacaagcaattaaggatgctgactgatggctgactgcagtcatgagtgagccccagtgaggccagaagaaccacccagccaagcccagctcaatctgccaacctagagaattctgagctaaactgatcatgtgaaacatgattgttgtttcacacttctaacttttggggtcatttgttactcagcaaagcaaacgaatacactgtatctacagtgttgagcaagtacaaagagtaataattatttgttgctgatcaactaacaaatatccagtgagatgtcaatttctcccactcccaagtgaaattcaaatgggtgatctctatggatatacactccctctatctccatcatgtgctataatgaataaggctcaatggccataagagtaataatacattcgtataatttaaaattaaaatctttttttagcaatctgtattttcaagatgaaattaacttaaattatgtgactatcaacaacattctcaaagtgtttgctgagagtgtttaattttattttataaaaatgcataaatattgaggtaggtgtgtgtgtgtgtgtgtgtgtgtgtgtgtgtgtgtgtgtgtttaacttagggtaaaaatgtggctcagagaggttaaatggctgaatatcttatccagacttcctgggtatcaattctagcttgatcattttaccagtcttgtatctttgggcaaatcattattttctcatttataaaacagggacaataataatgttcccaaacccataagagtattacaaagattaaattagttagttagtaagtgtaaagcacttagagcagggtcctggtgtaaggaaatgctatattagtgctattattcatatttttttttgagagagagtctcgctctgtcacccaggctggagtgcagtggcaccatctcggctcaccacaatctctgcctcccgggttcaagcaattctcctgcctcagcctcccagatagctgggattacaggcacccaccaccacgcccagctgatttttgtattttcagtagagacagggtttcatcatgttggccaggctggtctcgaactcccagcctcacgtgatctgcccacttcggcctcccaaagtgctaggattacaggcaggagccaccacgcctggtctattattcatattttaattaggaataacaggagtgggtctagaactagaagcccaaacctcaggtgtttcctgagtttaatctcttcccaagccttatgtgtcaaaaccagggttccttccactatactgtgctgtccaatacaaaagctattagccccatgtggctatttacattaaaaagtaatattaactaagttaaaaattggcttcctcagtcacctcaaccacatataaagtgctcagtggccactggcagctaagggctactatattggacagtacggacaaagaacattcctatcattgcagaaagttcattggataatgctgaattgaataaataccaaagatacttctgagtttgtttatttatttatttatttgagacggagtcttgctctgtcacccaggctggagtgcagtggtatgatctcggctcactgcaacctccacctcccaggttcaagcaattctcctgccttagcctcccaagtagctgggattacaggtgccccccaccacacctggctaatttttgtatttttagtagaggcggggtttcaacatgttggccaggctggtcttgaactcctgacctcgggtgatccgccccctcggcctcccaaagtgctgggattacaggcataagccaccgtgctcagtcatacttctgagtttctaacaaatcattttttgtttttttttttgttttttttggtaaacagcagggaactaactttgtctccatataaagaaacgctaaaatttatgtttcttaaaggtaaattaggatcaaacatcctaagtggggtcaaatgacatggagtgaccatcaatggtgaactagtcatggatagattatcaggaatgtcaggagtgagaattcacctttccgaaactaaccttctcctttttttttattttgagacatggtctgactctgttgcccaggctggagtgcactggtgcaatcttggctcactgcaacctctgcctcccaggctcaagcgatcctcctacctcagcctccagagtagctgggaccatgggcaaacaccaccacactggcttattttttgtatttttttgtagaggtggaatttccccatcttgtccaggctggtctcaaattcctgagctcaatgaatcctcccaccttggcctcccaaaatgttgtgattataggcgtgagccaccatgaccagcctggaactaacctaaaactcccttgacttttatgcagaagattggttcttgtgtggaaaaaaagagtcaaatatgtataagcatacctatcagaaactacaaaatttgatggtataaaaaaattgactggtgtttcttaaacacataggctaggtgctaaatgtttttacatgtgttagttcattaatgtgtacaacaaatacatgaagtaggggccattattatatcccaaatttacggtggagaacctgaggcttggatagatttgctggaggcctcaagaccactaggtagaaaagctgggatgccaaaggaggtctaattaactccaaaatccaggctcacagtcatgaatactctacccccgtaattaggaaaaataacagtgttggtttggacaacgtgtgcatttgacacccattgctgtccattcaacctcacgctaagtaaagatggtgaagccatgccccattcctgaaaactgtcttggagaatggaaaaccaggaaagagtatggactagattggttgaagccaactcttggcatgaaaaatgtaattctacctacatatggggcaagaatgtaattccaaataaaagaacaatgctggatacctggggaagaatagtctcttcttctccaagtaatcattcagccctttctggatgtcctccaagagaaagttggcttcttgaagcttctctgccatccgtggctggtcggctgccaccagaatcctgttatctttcacctgggttccatcaaaaaaagtgagactcatcataaggttcccaagttctgagattggtcattgtattgaatgtgtgacctatcaactgacagcactccttgtccagctaactgcctcctgatccccctcctaactgcacaggggtgaatgcttatggaacatgaccttgttcctctgatcatggttgactgggcagggattgggtactaaaaccaaccaaacccaattatattttaacccaaggagtttagaatccaaaccatgacattctatactagtttgggctgagtgagaattatgtttctctgtgtgacggagtgatagagaaagccagtcttgggggggggggtggggagggagagagagagagagagagagagagactgactaaggcagggccaggaaagaggagccaagatcagagagatggaaggagttcctaagagaagaggcttctgggttctagatccatcttttgtgaggcttggctgtgctatttggccttgggttccatgagacacccatttggtcttctcgtttcagctatcctgagtcagtttctgtcacttgcacccaaacaaccttaactaataaagaattggcttatgctggctggacaatctaaattccatttatctcactcccacaaacaaagcagggaagacaaattgctttgcagcaaaatctttttaagtgcaccccagtttgatcacacttgacttaagaaaggaaaatgatttgacctcataaaagatccctctaggtgccttgcacgcccagtgaacttaccatccttcaaggcttgatcccaacgttcctgctttagaggccttccttgacacgctgagacaactaaatcactcttctgcattctaataactatttgtatattacttttttttgggtggggggggggacagagtctcgctctgttgcccaggctagagtgcagtggcgcaatctgggctcactgcaacctctgcctcccaggctcaagggatcctcctgcctcagccttggaatagccgggattacaggtgcacaccaccatacccagttaattttttatatttttagtagagacggggtttcaccatgttatccaggctggtctccaactcctgaactcaagcaatccgcctgccttggcctcccagagggctggaattacaggcgtgagccaccgcactcagccaaggcagcaaattctatgaagacagaaatcatattcttgccaccttcaagtattttctgatttctagtataacacctgggtcattgtaggtactgaataaacatttgttaaataactgagtaaccaaatgtgggtaattgttggaattctaaaaggattcactataaaactgttattgcattatcctgtaacaaatacaaccttgtaagaaatgacagttaaataatacaaactgcctatagttactgcttgggaagtgggatttcaaaaggcttctgctttctatgttacatatttgtatttgctttttttttttttaattttttttgagacggagtcttgctctctctcccagcctggagtgcagtggcacgatcccaggtcactgcaaccgccgcctcctgagttcaagcgatcctcccacctcagccctccgagtagctgggattacaggcattcaccacaatgcctggctaatatttgtgtgtgtgtgtgtgtgtgtgtttttagtagagatgcggtgtttcaccatgttggccaggctggtctggaactcttgacctcaagtgatacccccgccttggcctcccaaagtgatgggattataggcatgagccatcgcactggtcatatgtttgcatttttaataataacaacttctgaaattagaagaagatataaaaagattgattttccaaaactctagttcatttacaagtttcaaggaaggtgactagaatgcataatgaggaaacatttgtatttctgctggtaagagttattagggtataaaaacttaccgcttgggacataagtgatttccagtaactatcaacaatgccaaatttcctcccctcttctggcatctgggctatgatgtcctctgaactgaagattggttccaggtacagccaggtggcttggcatttcaaccaggcatccaaattgtcttgtatgcgaattagcttttcttcccatttctgtgaatttagcatttcatatctggatcattaacctgccactctgcatcacaggcccatggagagagcaaatggatggagccgtacatttattcattcattcagtctgtcacttgtttaacaaatacttattgagggctccctatgctctggtcactgctccaggtgatgagaacatagcaatgaatgaaacacacaagagctttgccctttacggagctcacgtcctagcagaataattacaatagttatacacgtaatctgtgagaagtgatggtctgagtgctttaagtatatggaaccaattaaatcccacagccttacaaggtagatgtgattacaaaccgtgttttccagatgtagaaactgaaacacaacagtttagtaatgtgcccaaggtcacaccactagtaaggagcagagccagaatttgaacccaggtaatctggcttcagagtttgtgtccttagcctatgtcactgctacaaacaatgagcacaggaggccaaacccctatcttcgggtagcttacattctagattactaccataagatgcttcccaaatgcatgtgtatttggtgcattcaaatgccatcttctcttttggcagacagttgcaaaggctcagcatgccatatgctttcttggatggttattgctttcagccttgtgtcattaattaattaattaatttacttatttttgagacggagtttcactcttgtcgcccaggctggagtgcaatggcgcgatctcggctcactgcaacctctgcctcctgggttcaagtgattctcctgtctcagcctcccaagaagctgggattacaggcaccctccactatgcctggctaatttttgtattttcagtagagacggagtttcaccatgttggccaggctggtcttgaactcctgacctcaggtgatctgcccgcctcggcctcccaaagtactggggttacaggtgtgagccactgtatcatttatttatttatttttccaattaggacaaagtgactttctttgttaactgaacgtgaaaacctttcccctcctctgagaaacccagagctaacgaaacacctcaaagcattcaacttcatttcctcttacccggcattctgcttctattggtttgatgaatggggagccacacatggtctgggtctttatcacgtgatcatcaagtagcatttgaatgtcatcaattgcacacaagatgtttgtatcctgtaaataaagatgccccaccctgtcaagattgtgaaacctccccatttttcttttccttttttaaaaatttatttatttgagacagggtctcctcacccaggcctgagtgcaatggctcaatcctagctcactgcagcctcaaactcctgggcttaagggatcctcctgcctcagcctcccaagtaggtaggactacaggcatatgccaccatgcctggatttttttttttaagacagagtttcactcctgttgcccaggctggagggcaccagcagaatctcggctcactgcaacgtccacctcccaggttcaagtgattctcctgcctcagcctcctgaatagctgggattacaggcaaatgacaccacgccctgctaattctgtatttttagtagagacagggtttcactacattggccaggctgctctcaaactcctgacctcaggtgatccacccgcctcggcctcccaaagtgctgggattacaggcatgagccaccacacccagcctggatattttttttaagagatggggtctcactgtgttgcccaggctggtctcgaactcctggcctcaagtgatcctcttgcctcagcctcccaaagtgttgggattacaggcttgagccactgcatccagctacctccccatttttcatgctgatcccttaggacctcccagctcagaactccactctcatggagtaggaatctatgtcttgcagggaataggacttctactttcttccttgaaaatgttattaaagatatttaggctggacaaggtggctcatgcccataatcccagcactttgggaggctgaggtaggaggatcgcttgagtcccagaattcaagaccagcctaggcaacatagcaagaccccatctctaaaaattttttttttaaaaagacatttattgtccacctcctttgcagaagtcaaatacagtctaatccaagactcatagacataatctgctggggaggaagatttcttcccctttccctatattcctgcttcttcacttgctttcctggctctcctttcccttgggtaggaagatcggctgctaatctgactggttaggcctagacctgcggtttccacactgtgaactgatgtgccccggggcaccgcagccaactcagagtgaatgattctggttatttaaaaataaaatacagctattagtttttctttcattgtaggtgtatttttttcaaacagtgcctaagttgttagagcataaatccttattaagttgtttggacctaattactgcataaacaaagctattaggtatttcttttggcctaagggcactgtgaaaaaagtacttagacacaaagccattgtgaaccaagaaagtttggggacctttgtttaattaattaattaattaattaattttaattttattattattatactttaagttttagggtgcatgtgcacaacgtgcaggttggttacatatgtatacatgtgccatgtatttatttatttatttttgagacagtcttgctctgttgcccaggctggagtgcagtggcatgatctcagctcactgcaacctctgccttccagattcaattcattctcctgcctcagcctcctgcgtagctgggatttcaggcaagcaccaccacaccgggctaatttttgtacttttagcagagatggggtttcaccatgttggcaaggttagtctcaaactcctgacctcaagtgatctgcctgcctcagcctcccaaaatgctgggattacaagcatgacaggcacgagccaccatgcctggcttgttttatacatttattgggtcttttttgagacagggtctcactctgtcacccaggctggagtgtaatattgcaatcatagcttactgcagcctcaaattcctgggctcaagcaatctccctgcctcagcttcccaaatagctttccaagtagctggtgcacatcaccatactcagctaattattattattattattattattattactattattattattattattttgtagagagggggtgttgctgtgttacccaggctgttctcgaactcctgagctcaagtgatcctctcacctggacctctcaaagtgctgggattataggtgtgaggcaccaagcctgaccaagtggtcctgttttacaagtaggtaaggtctaaggtgtgccttaaaggccaggccctgtgggtggcactttttctcctgggccattgtggcaagcaagctgacaagggtctgaccctggggcaggtttggtctttctcgctctgttctcacttctttcaagtctaatctaggaggctaaatttgggcctagcatgtattctcttatctatgttttaccagtagctcagcattgggaggtatgttgggctattaataaagtggtttcttgatccccatttagctactgatccttgtctgtagttactttaggcaaaaactctgcagattggccaggtataagtgagctgttccccaggtctcctagcttatactcctcttgtcaccccaacagcctctatagcagtgtctaatccaagctgatcatgcagccacgcttctgagacccatggtggctgggtcacccttgctgggagaggctcagtaatgaggccctgtgccctcagctctcttccctctcatcagatcatgtatagttctgttgggtctcagaacatgataccccgaagcattgcaccttgatttgctgagtattttgaactgaaggacattggaaggccttggaagcaagatctttctgtccatctttttctgcctttctcctgctcctttatctttcccctaagacagtccatagaaactaaactcctcttgcccgaagcaagcataaaatcctgaaatatcactctgaccaagacagccggccataaggaaattctctgagcaaccttgtctgatagtgggtcacaagactgtcgttcctgagggggtcttgccctatgcctgggaggaaggactgctacacagagagaccaagaagaatctcaacagcaggtcttgctaggcttcccatggagtctagaccattataccatacgcttttgttcaatttcatttccatacagctgtccattcttcatcaaacctaagccccaaaacacagttttccctgggtcttcactttcgatggttccaaagtcatgtaaaactttgattaaataaaattttaatgcttttctcttgttaatctgtcttttattataggagtattggcggtgaatgaccttcatgctaggtgaagaaagggatcacaccttttcacccctacagctcttccttgagtgaaatcaagacactccaaccatttaaactgaatagggaaagaagtcacaagtagataacatgcagcctggggaaggagggaggcttgggagcttttggttctcaatctacattgcacatgagaaaaaccaggggtgcctgaaaaatacagatgcccaggcattctgggaggggaggagccaggaagaatccattgggagattttaaagcattccagatgattctacaatgcaggtttggaagcactgctttaggaatcaatggttgggcctggcgtggtggctcacacctgtaatcccagcaatttgggaggcggaggtgggcagatcacttgaggtcaggagttcaagaccagcctggccaacatgatgaaaccccatctctactgaaaatataaaaattagctgggcatggtggcgggcacctgtaatcccagctactcgggaggctgaggtatgagaatcgcttgagcctgggaggcagaggttgcagtgatccgagatcacgcagttgcactccagcctgggtgacagagcaaggctccatctcaaaaaaagaaagaaaaaaagaaccaatggtctgcaggatgtgtgtatcaacctgttgcctccatgatttacagctccccaagagctgcaaccctcatccctacctcacaccctatcccaaaagcaagccagaccctaacgacagctgagcaaatgctttgggtgtgtagcaccttcgcatgcactgtacaaactcctgtgttttctacaagtgcaagtgaaaagaaagaaacctacacccttactattcaaaattgatcaatattatctgggagcttgttagatctgcagaatcctagattccatcccagacctgctgaatcagaacccgcatttcaacaagatctccgatgattcctgcatgcattgacatctgagaaacactagtcattgtctgcccctgtgcttctgacgggactgggaagctttggaatggtgtacaagcctgcaccttcactgggaggtgctgatttagaggcttgcttggttcctttgcactgagaaagcctcttgctctgaatcaaaagacttgtctgatttgaagaatgaatctcttcggtggtgctgacaggaaaggtgactgacacagaaaggcagacagtaggaaacaatcaagacatgagcgattatttctctgtgagttctgttgccattctgaatgaatcgtttctgtaatctattgcataataaatggggctgctttcaaaaggggctgcggttgcagtgagactcacagtgtccctgtatttcacgaagctgaacgtcacgttaacccaatccaacttcattctatccaagtttttctccagagagtattccttgctggcagctgcaccaatgggctccaatctaaagagagaacacagcaacagcaacatcaacaggaggcagagaagacacatcaaaggaggaacttcaggccaggcatggtggctcatgcctgtaatcccagcactttgggaggccgaggagggaagattgcttgaggtcgggagttcgagaccagcctgggcaatatagcaaaaccccatctccactaaaaacacaaaaattagccaggtgtggtgtatgcctgtagttctagctactcaggagactgaggtgggaggatcgcctgagcctgggaggtagaggctgcagtgagctgagatcgtgatttcaccactgcactccactctggaaaacagagtaaaccctgtctcaaaaaaaaaaaaaaaaaaaaaaaaaagggaggaatttcagctcagtcttaggagaatctccaaaagcccttaatttgaccaaaaggtttactatcctgctctaagatctgccagctaccgccagtgttttgcagggtttctcacccttggcaccgttgactttttgggctgtgttatgggttaaatattgtctcctcaaaaattcatatattgaaattctaacccctaatatcttggaatgtaactctatttggagaaaggatctttaaagaggtaattaaattaaaataagtcatgagggtgggccttaatccattataattggtgaccttataagaagagattaggacacagacacacagagggaagaccatgtcaattcataggggaagacagccatctgcaagccaaggagagaggcctcagaagcaaccaaccctgcctacaacttggccttggactttaagcctccagaattatgagacaataaatttctgttgtgtaagccactcagtctgtggtatgctgtaagagcagcctgttcaacaaaaattatgagaggtcattattccggactgagctcctgcactagaccccagcagaccagaccaaaccaaaatggagtcactcacgctaaatggcatgtaatcaaactgaatctttaaggaaggagatagatcccagaacaggacagtttttcctgaaaacaggagattccagtctacctgactcagagaataaggaagttccctctgcttgaaccctcataaaaaaataacctgacattaattaatccttttttttcatattgttctgtttccttataaaacttaccattgtgctactgcccagtgggaactctcattctattttggaaaacagaggctgccctgattcacgaatcttgattaaaagccaattagactataactcaatttgttgctttgtcttttgatgagacctagcaaactcacataggctgaaataattgtcatggggagctgtaccgtaccttctagggtgttgagcagcatccctggtctctacccactagacaccagcagcagactccccagccctgccccatcttttgccagtcatgacaaccaaaaatgtctccagatatttccaagtgtcccttaagggtgggaaatggcccccagttgagaaccactgttgtaaggtcactaaaataagacctcttctttccatctttgtttatgccttatttgcccatattctgatttcttttatttttttttcccccagatggagtctcactgcgatgcccagggtggagtgcagtggcatgatcttggctcactgcaacctctgcctcccggattcaagcgattctcctgcctcagcctcgcaagcagctgggattacaggtgccctccaccacacctggctaatttttgtatttttagtagagacggggtttcaccatattggccacgctggtcttgaactcctgaccacaagtgatccgcccgcctcggcctcccaaagtgctggaattacaggcgtgagccaccatgcccggccagtattctgatttcttattcagattttgaacctctgttaatttatgtgatggctcttgctctacttcccatcccttcccttttcaaaaacacctactattttcctgatactgggtccacccgtccatggcccctctattccacagaaaggggcatagagggagagagagaagaggcaaacaaattcctttcttcttgtttccacatggagatctgggtcctaaaaccgaggtgtggcaaagaattggaaagccaagttcttggaagtggaaagagggactgttctctctgcctcagccctgtctttcattgcatccttgagtgtagaagagaccatctgatatttactcataggtcaggaaaccaacgctcagaggaagcaagtgacatgtccaaaatcacagagccagggagtcctggaactgggtattgacaccaattcctcctaatctgactcctaccctggtgtttcttcttccacccttatgatatgccttctcccttctcttacttagaaagagcaatagaactaggccaggcacggtggctcactcctgtaatcccagcactttgggaggccaaggcaggtgaatcacctgaggtcaggagttcgagaccagcctgaccaacatggtgaaaccccgtctctactaaaaatacaaaattagccaggcatggtggcgcacgcctgtaatcccagctactcaggaggctgaggcaggaaaatcgcttgaacccgggaggtgaaggttgcattgagccaagatcatgtcattgcactccagtctgggcaacaagagtaaaattccgtctcaaaaaaaaaaaaaaaaaaaagagtaacaactaatagaactgttcatatgtgttcaatcaaataggaccaattaaatagagcggagaaccctcatttagcctctagaagggaggaagattaggagcagaaaattacaaacaaggactgatcaggacctcagcagcgtggtcactgacttaaatatggcctgtgagaggtgaccaaaatgagtgtgcatatagggaataattaataaaggcaggtgccagcccagattagtatgagacaaagagtcacaaggcccagcctccagtactcactggctgtgtggctgtggccaagtcacttgacaggcctcaggtccccatatgcccctatcacaggctttggggttcaattaaataagaccaaatgctggcaccaggcctcatgaattaccctagggtatgacttagaatgcaaatgattgaacagatgagggactaatcagtctgggaattcatgaaatatatcaggagttgacctcacccaaaatgtgctggagaagctcattaactatgggctgtgatgaagctgcattaactatggtgtgggtggaatacatgcaatatcacacctccctaaatggtggtggctgagtccccagacatggaatcagttcaggtgacatgccttttctcctaatcctaactctaatcacctagctactctcccatgttacaaatggaaccaaggcgcacagaaggaaacaacttagccaagatgcttccacttctgaattggtcacagttgaacatgtgtgcatggaaagtataagaatagctgtatgtttatttgctcattcactgtctctggagaggggtttactttttcagcagtgaagggtcatggttaaggcctgcctggtaatggaagcctgcttatgttcaaatcttgattctttcctaagtgaaatgttcattctttcggttactagtgtgatcaatggctaataatctgaagtttatttcctcatctgtaaaatgagaataatattaggacggtaggacctaggacactaggtttttgtgatggataaatgtgttaaggtcgggcatggtggctcacgcctgtaatcccagtactttgggaggccaaggcagatggatcacctgaggtcaggagttcgagaccagcctgaccaacatgatgaaaccccatctctacaaaaatacaaaaattagccaggcatgatggcaggtgcctgtaatcccagccactcgggaggctgaggcagaagaatcacttgaacccaggaggcggaggttgcagtgagctgagattgcaccgctgagattgcaccattgcactccagcctgggacacagagtgagactctgtctcaaaaaataaaaaataaataaataaataaaaagggttcaggtatataaaatgctgagtgcagcataagtgttcaatagctagtgtctcttggaaacatcttactgggggaaagtgaggccctttggccaaaaaacctaagggtttttatcctaaacctgataaaaaacatttgcgtctctaggcctgctcgttaatgaggaacatagtggtggtattggagaggcatcacagtattcaggtggcagaaagattcaggagctgggaagtgccttaaattagacctgctctggtgcagtatgagtggggaattctcagcctttcatgtatcagaatcgcctggagcagtgctgtccattagaaatatagagtgagccacatatgtaattttaaagtttctcgcctgtaatcccagcactttgggaggccgaggtgggcagatcacctgaggtcaggagttcaaggccagcctggccaatgtggtgaaaccccgtctctaccaaaaatacaaaaattagccaggcatggtggcgggcacctgtaaccccagctactcgggaagctgaggcaggagaatcacttgaacctgggaggaggaggttgcagtgagccgagattgtgccattgcactctggcctgggtgacaaagtgagactccgtctccaaaataaaataagataaaataaaataaagtttctagtagccacattttaaaaatattaaaagacacaggtgaaattagttccaataatgtatttgactcaatatatccaaaatattatcatttcaatactaatcagtattaaaaattgttaggtattttgcattcttttttcttgtagtatgtcttcgaaatccagcctgtattttatacttacagcacatctaattcagactagctgcactgtaggggctcaatggccacatgtggccagtggatgctgctttggacagtgctgacctgaaggatttgttaaaatgcagactgcagggcccatctgcagaatttgattatgtgggttgggtggggcctgaaaacgtgcattctagctagttcctagctgacgctgatgcagcagatctgggtgccacactcacctaacagggtctccagtccaggcaatgcaacatctccccacccatcgccctgaaggaagtgtgaaaaagcaagtagggtcctgagaagctctgttctagaggtagcatccaaatggtaaaattctcacacacaaactccaggggaatttggagaagggaagaaagcaagagaaaagacttctttttttttcttttttttaaattaagatggagtctcacactgtcacccaggctgtagtgcaatggcgctatcttggctcactgcaacctccacctcctgggttcgagcgatcctctggccttagcttcctgagtagctgggactacaggcatgtgccaccatgcctggctagcttttgtatttttagtagaaacgggggtttcactatgttggccaggctggtcttgaactcctgacctcaagtggtccgcctgcctcggccccccagagtgctgaaattacaggcatgagccactgtgcccaggcgagaagagacttcttattggaccaggtttcacacaatcttaaagctcagagacggttgttgctttgtttgtttaaagaagaggaaaccgaggcacagaaaggctgaatggttttgcccccaatcactgagagctgggcttgaagctcaggttcaaagaacattaaaaaaaaaaaaaaccctttgaaataaaatccatgactcaattttctagtcacaacccatcagcagctctgcagctaaaaaacagaagcttcaccaatacgagttggtagctgcaggtaattaaatagccttaagccaccctacgccacaaggaaaaaaaaacaaacagcccgatatggagccaatcagatcactgtgggaacttacagatcctttgaccaaaaccttatctgaaggaggggataagcccttacttttcaacgaatttgccgaatccaaattcgagcatatttgagaggcaggtcgtttcggtgggctttatctcatagccaacaatctcactgatctgcaaagaaaagaggaaagcaaatgtttgttgtccgaggcagtgctgtccagtagaaccttctgtgatgatggagatgttctttttatctgcactgctcagcataacagccacgagtggcaggtggctgttgagcaccagagatgtggctagtgtgactgaggaatttatttttaaattaaattaaaaaaattttttgagacagtctcactctgtctcccaggcaacacagtgccatcatagctcactgctgctttgacctcccaggcccaagcaatcctcccacatcagcctccccagtagctggggccacaggcacacaccaccttgcctggctaatttttaaatttattgtagagatagggtcttgctgtgttgctcaaagtggtctcaaactcctggcctcaagcgatcctcccaccatagcctcccaaagtagtcacattacaggagtgagccgccacacccagctaattttaattagacagggtcctgctttgttgcccaggctgaagtgcagtggtgtgatcatgactcactgcagccttgacctcccaggctcaagtggtcctcctccctcgacctcctgagcagctgggaccactggcatacaacaccatgcctggctaacctttttctttttaaaaatttttttgtagagatggggtctcgctatgttttccacgctggtcttgaactcctatactcaagcaatcctcgcaccttgatctcccaaaaatgctgggattacaggtgtgagccatcatgcccagtcccttttactttgtaaaatgtggctactagaaactttaaaattattggctgggtgcagtggcttactcctgtaatcccagcactttgggaggctgaggcgggcggatcacttgaggtcaggtgttcaagaccagcctgtcaaacaggtgaaaccctgtctctactaaaaatacaaaaattagctgggcacggtggcaggtgcctgcaatcccagctacttgggaggctgaggcaaaagaacagcttgaaccgggaggtggaggcaggaatcagccgagatcgcaccactgcactccagcctgggcaacagagtgagactccatctcaaaaaaaaaaaaaaattaacacaaatggctcacgttatatttgtactagtcacagagggccagttttggcatctatcagtgcagtttctccctaagatcaaatgttaccttgttccatcttgctttttttttaacagttaaatttttattattttttaaatttttattattttttaaatttttctttttccatacttttttttttttgagagagagtctcgctctgtcacccaggctggagtgccatggcgcaatctcggctcactgcaacctctgtctcctgggtccaatgattttcctgcctcagcctcccaagtagttgggattacaggcgcatggcaccacgcccggctaatttttgtatttttagtagaaatggggtttcgccatgttggccagactgctctcgaactcctgacctcaggtgatttgtctgcctcggcctcccaaagtgttgggattacaggcgtgagccactgcacctggccagaccaggagatttttttataatgactcagaaagcacaaaagcaaggaacccagaagtagttaccgttgaaataacggtcttggaagaccaagagtgttataggcacatgatgaaaaaataaccaaaataacactaattgcaaataggacatcagaaatgcaccttagtgtagtgatccaaaaagccttttagatttgtggcttccatttcgtttgaaaccacagtagcaacccctttgctgttatctataaagtctgtgccccaaacgtaaggctctaactttttctacctacgttctgtaaatgaccagaacccccagcacagccatggccttgcttcagaagatccagcttctagacttgagtgctacagatggctcatccttcagatccccctgccagagctagcatctgtggcagtggatctcctaagttaggcatcagggcagagaatgacatccccaggcctggggctgtccccagggcggcctgtggtgtgacctacatacactgcagggaggaatgggctctgcctaggggcagtccggagagtatctaggggcctttgtcctttctgaacttgcctcttaactgctcagcccactgggcttccatttaggggctcactccttgggagccactgtcctagggctgtgctccccggccctctctcactgtggtttactgccccctactgcccgctcccttcctctgaccggaccttttttgcctttttgacttttccaggctgagtcaaacagtgtagaaaaattccaatcccctttcccaccaccaactagccatctgacaattcatctctccaagtctcagttttccaatccgtgaaatggagataataataatctccacttcaaaggcctgttttaagggtgaaatgtgagaatccaaataaagtatacaacacagtacccagcaccatagctggtactcagtacattttcaatatcatcattattattatggttagaatttttttactttatttatttatttatttatttattgagacagggtctttctctgttgcccaggctagactgcagtggcgcaatcacagctcactgcagcctcaacctcccaggctcaagtgatgctcccaccttagcttccctagcagctgggactacaggcatgtgccaccacgcccggctaatttttttgtatttcttgatggggttttgcagtgttggcccgggctggttctcagactcctgggctcaagcgatccacttgcctcggcctctcaaagtcctgggattataggcgtgagccacggcacctgactgggattttttaaatttaaattaattaattttttaaatagatgggtcacactatgttgcccaggttggcctcaagctcctggcctcaagtgatcctcctgtctcggcctcctaaagtgctgagattagtggtgtgagctacctcgcttggcctggttgggattttctgagtgcccacatacaagaatagcatcatagaggaagcaccaggtggagcagatggctttcccggccccgcggcatgttctccaaatgccatcgacaaggacactcttgatagtgccatctcatagagaaacctggcactaccagaggccacctgtcccacctaagctccctaacccccccatccccccgatgcaggtcaaagtcctagttaggctgggtccgtagagagaggcaccccgtgagcaccagctgacagcaactcctcctctgcggatccctctgctggggcgtttcaaaaccagaagtcatggccaggcactgtggctcacgcctgtaatcccagcactttaggaggccaaggcaggaggatcacttgaggccaggaatttgagaccagcctgggcaacatagtaagaccccccccatctctattttaaaaatcaattaattaaaattacaattaaaaaatatcccagccaggcacggtggctcatgcctataatcccagaactttgggaggttgaggcgggtggatcacttgaggtcaggagttcaagaccagcctggccaacatggtgaaaccccatctctactaaaaatacaaaaattagcagggcatggtggcacgtgcctgcaatcccagctactcaggagactgaggcaggagaactgcttgaatgtagtgagccgagatcatgtcactgcactccagcctgggtgacacagtgagattccacctcaaaaaaaaaaaaaaaaaaaaagaaaaacagaggtctactcagacagcctatctcttgtctatacatcaccccatcctttggttaggtctccagttcaagactttttgggaaactgaaagtagcttctccctacaaaaagaccctgactctctcatgtattaagagagtcttcctctctcttcctagggagaacaaagtgctccttgtcactgtgttgtcattgggtcctttcagagagaatttcctcagtcttatacgtggcttttttgtccccccgttacccaggctggagtgcagtgacacgatcatggctcaatgcagccttgacatccttggcccaagcaatcctcccacctcagcctcccaagttactggaccacaaatgtgcaccactacacctagctaatattaattaattaattagggagagatgggggtctcactatgttgcccaggctgggctcaaactatcctcctgcctcagcttctcaaagtgttaggattatggtcttgagccaccgtgcctggtcttgaatgtggttctgagagggggaattacaggccaagtcagagaagaatcttcccaaagaaagccattttcacttctaattccatacagagcgactcctggtaaaggatgtttcaaggccattgctagcccttggaagtgacaattattttagaaacacagtgagttttcttttttctgcttagtgttcacaccacacttatcaccctcacacttggttccttataaaaatcccagctatttttaaggagaatatttatttttctaatttgtaggcccaaagggctgaaagaggagtgcaaagttatttctgaacctgtttgacaataaaatgccacaccaaagtcatcctaagtgggaatcatctggtattattagcaacccccagggagagatgtgactttcttttttgtgtatcctaggtcaaggagcaaatcaaggtcctctcactgtattgaacatccctgttgcaccttggaggctcttggcctccaaaagcccatctgcttaggaagcaggaaggagaccctttgtggtcattggctcgaacaacactcaacgaaccacgaccaatgggggttccaaggaaagggccaacctgtccagggggcagggagttcattctcttccttcagaagtcttgccactctcatttgctatccctttgcccttaaatagagtctcctttcggaaaggagaagcttgacctagtaatgtttcctgccttcccaaggacagtcagggccaggcctgggctgcgctgcttgggggcgggcagtgattgatagaaacctgctgccagtgtcggtctttcattcctgggttgcaggaaatactgaggatgggaatgtactgcttgaacttatcgatcttgatcttcacattctctgctaagcgcctgggtgcaggcacatcagacaaggtcttgatcagtttatacgttgtcctccacatattccctatctcctccgcaatttgctcagcattcagtaagaagaggggtcctgaaatagaagagtgagggaaaggtcagaccatcatgtggatgttagtcatgcgtacctttaattccctgaacttagagctgtgcctcctgtcgtttggagattggaacacatacaggctttgaggatctgaaacctgcacttagccagtggaaccttagatatgatacaggacttttctaagcctcaacagtaactcctgtgacacaggggtaataatggataccctggaaggtgattgtggaaattcagtgagataatatacagtggctaacataatgcctggcatataatggatgtacaattagcatatcaatagctttttgttttgttttgtttttgaccagttgcaatggcttacacttgtaatcccagcatttggggaggccaaggtgggaggactgcttgagcctagcagtttgagaccagcctgggcaacatagtgagaccccatctctacaaaaaatgagaagaaaaagaaaaaagaaaaaaattgttattattggttttagaatctgctatagtagtaattaaaagtgcttcacaaaagccatgaaatattaaccatcggggaaaggtgaatggagatatgagagggaggctgaggcaggcagattgtttgaggtcaggaattcaagaccagcttgtgcaacatggttaaacctcatttccactgaaaatgcaaaaaattagccaggcatggtggcatgctctgtagtcccagctatttgggaggctggggtgggaggatcacttgagcctaggaggtggaggttgcagtgagccaggatagtgccactgccctccagcctggacaacagagtgagactctgtcaaaaaatatatgtattttaaaagcaaaaagtaacacctcattgtttaaacttactccaaaacactaatttccttccccttcctttattttgctaagaacctttagcatttgggtttcacatccagccaagacctttccatgctgctgcccctgcttggatatttcaaattggtattaactcttgctatgtgatgttgctaacttactcaaaaacacttcttcaggagtgctgaaactaaatctaacttcattaatttcacatgcttcatcaacccaacatttttgttgcgtgattaaaaatttaaattaaaaaaaagtatccttcatgcaccaggaaatattgtaggtgctgggctagaatagaaaggcacctacgcaacaagtgagtagcctgtacttgggagggtttggctgaattatcacggtgactttcccagtaggatgaataaagtaggtaaggctaacacttcattgttcccactctatagttgtaagagtgaagcacaaacagagtgacttgcctgggttatttgcaatcactcaggcaaagaggagtagtagtagcatttctattagaagcaatttccctctggttatgattatctagagacagcctgaactgacaaatttatatctacaacaagagagaagaacataaaataatccagggattttagacactgctatttgaagagcagttatggatccctttatccacatgacgtggtagcttctcacctcatagcttatggaaaggctatattctgaaattctaactctgatcttaaaggatgagacagcaggtggaaatttttgtagccctgtggatacagtcaactcagtcaagattcaaatatggaggttgcaggaaatattaataaattctagggtcctgtccagtccagaaattccagagttctaagaaacattgctgaagtcattcttcaaggttaatgatcttcagccccatgaatgtaaacaaataacttctaggcaaagaagcaatgtgaggccatgcaattaaccacgtctgcctattctaactccccactaaatgatcaaaggcagataataaagggaaaaacatgtgtctctactggaaattaaagaaggtgccatcaaaatgtgagctatagggagaaatttctgtaggatattcacagtagttttccaagtttagcaggcatcagaactgccaggagggcttgttaaaacacagatttctgggccccattcccagagtttctgagtcaggtctggagcgagggctcaagattttgcatttttaacacattctcagttaatgagaatgctgctttgtcctggaaccataccttgaaagccactgcaggggaaaagtggaagcgacactcactaggaatcccattgcagaacttgctgcttatccatggagagggatatgtctagcacagtaacagccctgccaaagctgacttttaacaaaggcagcttgatcccttgataaaatattccactcaataacagcagagtacacattcttttttattgcaaatagaacacttaccaaggtgaatcttattctgagtcataaaacaaacctcaataaattgaaaagaagtaaaatcatgcaaagtgtcttttatggccataatggaattaaattagaaataacaataaaaacataacaagaaaatctccggtgactagaaaattaaacaacacacttataaataatccataggtcctagaggagtctcaaaggaaattagaaagcactttaaattgaacaaaatttgtgagggacaactataaaggataaatttgtagcattaaaaaaggagaaatttctaaaataaatcatccaagtttctaccttaagtaactagaaaaagaagagcaagataaatcaaagctagcagaaggaaggaaatgataaaaataagaacagaaatccattgaaaacaaaaataataagaaagattattgaaacaaaaagctgtttccttggaaaactaaaattgataggcctaaaaaaaagataaacttctagcaagacaggcaaagaaaaaagaaagaagatgcaaattaccaatatcaaaaataaaagatgggatatcactaccaacctctcagacattaacagggtaataagggaatgctataaacaactcaatgtacataaattagaccatttttttttaaaatgaagccattcttcaaaaactacaaacttccaaaaacttattcaagataaactagaaaacctgaatagttttataactattgaagaaattgaatttatagataaaaaatttccaaaatataaaaacttcagaatcagatggtttcactggaaaattctgccaaacattagaagaagaaaaaaataacagcaaaacctgtataatctcatctaaaaaatagaagaaaacatttcctaacttattttaacaggtcagtgatacgctgatacaaaaaccacacagatacattacaaaaaaaaaaaaaaccctacagaccagtatctctcacagacactaaaattctcaacaaaatattaggcatggaaactgaatccagcaacacatgaaaataataatacaccatgtccaagtagggtttatcattggagtgcaaggctggtttaatatttgaaaatcaaacaatataatatacagtattaacagcctcaaaattttctgtaatttgcaacaacatggatggaactggaggacattatgctaagtgaaataagccaggcacagaaagacaaatactgtatgatctcactatttgcagaatctaaaaatgtcaatttcatagaaacagagagtagaaaggcagttaccagaggcttggatgaggcaaagggatggggaaggaaaggaaagatgttgatgaagggtacaaagtttcagttatactggagaaataaattttagtaatctattgtagtgcatggtgactgcagttaataattattgtatatttcagctgggtgaggtggctcatgcctgtaatcctagcactttgggaatcagaggcgggtggattgcttgagctcaggcgttcaagaccggcctgggcaacatggcaaaatcctgtctctaccaaaaatacaaaaaattagctgggtgtggtggtgtgcatctgtagtcccagctactcaggaggttgaggtgggaggatcacttgaacctaggaggcagagattgcagtgagccgaggttacgtcactgtggtccaacctaggtggcagagcgagaccccatctcaaataataataataataatgtcttgtatatttaaaagttcttaaagaatagattataaatgttatcatcagaaaaaaaatgataaattggtgagggtgtggatatgttaattagcttgatttaatctttctatgatgtatacatagatcagaatatcacattgaaccccataaatatacataactacttgtcaactaaaaataaataagtaaaaattggaaaaaaaaaagaaatagaaagaaaatccaccagaatcaacaaaacaaactcctggaactaataagtgattgcagcaggatcacaggacacaatattaacattaaaaagtcaatcactttccaagatagcatcaatgaacagtggaatttgaaattaaaagcatagcccaggcacagtggctcatgcctgtaatcccagcactttgggaggccaaggcaggtggatcacgaggtcaggagttcgagaccagcctgaccaacatggtgaaaccctgtctctaccaaaaatacaaaaattagccgggtgtggtggcatgtgcctataatcccaactactcaggaggctaaggcaggagaatcacttgaacccaggaggtggaggttgtagtgagccaagatcacaccattacactccagcctgggtgacagaataagactctgtctcaaaaaagaaaaaaaaaagaaattaaaagcataatactatttacattggcaccctaaaaattaaatttgtacttgggcaaaaatctaccaaaatatttgcaagatctgtatgaggaaaactacaaaaaactctgatgaaagaaatcaaagaagatataaataatggagagatattccataatcatggataggaagactcaatattgttaagatgccagttcttcccaacttgatctatagattcaacacaatcccagtaaaaatcccagcaagttattttgtggatattgacaagccgattctaaaatttacacagagaagtaaaagatccagaatagccaacacaatattgaaggggaagaataaagtcagaggactgatactagccagcttcaagagttactataaaactattgtaatcaaaaaagcgtggtattggcaaaagaaagtcacatagatcagtggaacagaatacataacccatccaaaaatagaaccacacaaatatagtcaactggtctttgataaaagagcaaaggcaatataatagagaaaagatagccttttcaacaaataaagatgaaaaaattggacatctatatacacacacaaaaaaagaatctagacacggatcttacacccttcacaaaaattaactcaaaatggatcatagacttaaatctaaaatggaaaactataaaattcctagaagataacataggagaaaatatggatgaccttggatttgagaatggctttttagttacaacacagaaggcacaacacatgggaaaaaaatgataaactaggaatgaaaagattctcccctgtaaaagatgttgtcaagagaataaaaaaggcacagtctggaagaaaatatttgcaaaaaaaaaaaaaaaaaaaaaaaaaagatctgataaatgactattatctaaatatacaaagaatttttaaaaattcaacaataggaaaacaaaaacctgaaacttaaaaataggcaaaagctctgaacaaatacctaatctaagaagatatacaagaggtgaataagcatatgaaaagatgttcaatatcattgccattaaggaactacaaattaaaaaacaatgagtggctgggtatggtggctcatgcctgtaatcccaacactttgggaggccaaggtgggaggattgcttgagcccaggaatctgaggccacctggggcaaattagtgagaccctcatctcaatttaaaaacaataacaacaacaatagccaacaacagataccactacacacctattaaaatggtcaaaactcaaaacactgacaacactaaatgctggcaaggatgtggagcaacaggaaatgtcatttatattggtggaaatacaaaacggtacagcaactctgaaagacagtttggccgtttcttacaaaactaaacatattcttatcatataatccagcaattgtgcttcatagtacttacctcaaaaagtgaaattcaaaaacatacatcatttacaatagctccaaaaaaggaaatatttatgtataaatttaacaaaacatgcataggagctgtatgctgaaacctgcaaaacactgataaaaagaagtaaaaggagaactaaataattgaagagatgtaaagtgtccattgattgaaagactcaatgtaataaagatgtgaattctttccaaatttatctatagatttaaaacatttccaacaaaatcccagcagagttttttggtatgtatagacaaactgattctcaaatttatgtggaaaaataaagggactaaaatactcaaaataaaattttaaaaagaaaaatgaagttagaagaatcacactatgtgattttaagactttctataaaaatacagttgtcaagttgatgtggtatcagtgaaaggcttgacatatagattggcagaacagaatagagtcaagacatcaacccacgaagatatggacaactgatttttgacaaagatacaattaagtggataaaaatttttttttcccaattactggaaccattggacatttatatgtaagacaatgaacttgaactaagcctcgtattttaaaaaaattaactcaaaatggaccataggtctaaatgtaaaacataaaaccacaaaaaatctagaagaaaatataggagaatatcttcatgaccagggttaggctaagagtccttagagatgataccaagagcacaatccataaaagaaaaattgatacgttggacgtcatcaaagttaaaacctttttctctgtgaaagacactataaagagaataaaaaaacaagccatggacttggagaaaatatttgtaaatcacataatctcacaaaatttataaagacctcacaaaactcaacagtaagaaatcaaacaaccaattaaacaaatgggtaaaagacttgaacagacacttcaccaaagaggatatacaaatgacaggtatgcacataaagaaatgttcaagatcattaggcattggggaaatgcaaattaaaatcataatgagacatcacaactacttatgagaatggctaaaataaaaaaatacaggccaagcacagtggctcacacctgtaatcccagcactttgggaggccgaggcaggtggatcacctgaggtcaggagtttgagatcagcctggccaacatggtgaaaccccggctctacgaaaaatgcaaaaattagccaggtgtggtggcatgctcctgtaatcccagctaaatgggaggctgaggtgggagaattgcttgaacccaggaggcggaggctgcagtgagccgagatcacaccactgtacaaagtatgacaaagtgacactccatctcaaatatatatatatatatggacaataatacccagtggctggttgatatggtttggctgtgtccccattcaaatgtcatctagaattatagttcccataatccccacatgttgtgggagggatctggtgggaggtaactgaatcatggggtcgagttttcccatgctgttctcatgatagtgaataagtctcatgagaactgatggttttataaagctcagttcccctgcacatgctctcttgcctgccgccatgtaagaagtgcctttgctcctccttcaccttccaccatggttgtgaggcctccccatccaagtggaactgtgagttcattaaacttctttttctttacaaattacccagtctcaggtatttcttcatagcagtatgaaaatggactaatacactgatgaagaggtggaacaactggaattatcacacattggtgagggatgcacaacggcacagccactgtggaaaacaaaagtttggcattttcttataaacttgcaaatatactttaaatataattcagcaatccactgctgggcatttaccctagagaaataaaaacttacattgacacaaaaacgttgacataaatatttacagcatctctatttataatagtctgagagtgaaaacagtgggtaaatggttaagctggtgtatccatagaatgggatactactcgcaataaaaggaaatgacctattgctacatccaacaactcggatgaatcttaaaggcagtgtgctgagtgaaggaagcagtcttgaaagattgcatactgtatcattccatttgtaggaggagcctcaaaaggacaaaactataggaacaatgaagagatcaatagttgccaggggttacaactggggggaggatttgaccacaaggagacagtccaaagaaatttattgagttgatgaaattgctgttttctgattgtagtgatgtttatatgaaagtcaacaactgttaaaattcatagaaatgtatgccaaaaatgtccattttaatgtatataaatttaaaaataaaatgtaaaatgtttttaaaatacaatacctatttctaataaaaacacttggtaatttataaatactgttttttttgagacagggtctcgctctgtctcccaggttggagtgcagtagtgccatcacagctgattgcagcctcaacctcccaggttcaagcgatgctcctgcctcagcctcctgagtagctgggactataggtgcacaccaccatgcccagctaactttttcattttgtttttagtagaaataaggtctcgctaagttgctcaggctggtcttaaactcctgagctcaagtaatccttctaccttggcctcccaaagtgctgggattacaggtatgagccaccatgactggctttcttgtgtttataaatactgaagcactagaaacttgctaaaggctcaaacctaagggtctctgatttttttttttttttttgagacaaggttttgctctgatgcccaagttggggtgtagtaagcagatcatagcttactgcagccttgatctcctgggctcaagcgttcctcccatcttagcttctcgagtagctgagactacacgtgcaccatcacacttggctgattttttattttttgtagagacagggttctcactatgttactgaggctggtctcgaactcctgggctcatgcaatccccctgcatcagcctctcaaagtgctgggactacaggtgtgagccactgcacccagacaaggatctctgattttgtcctctgttcttcaacaccctccacaggtgttatcattcatggctttgattgtaatctacacatcaattattccccaacataaatcccacccgccaaatctctctcctaaaatccacactgatacactcaattgctatttaatattcccatttgattgtttccaggtgcctcaaactcaatgtattcaagttgatgggtttttttttatttgtttgttttgttttgtttttttcccaacaaatctgtcacttctctttttcagtgatggtaataccaaccaaattgcctgagccagtcatctggaagttggttctttgctgttattatcctcactcatccctgaagtaagagaactaagtcttggagaagctaagtaacttttcccaaaggtcagctagtaagttctttaagcattaaaattcttacctctgaggcaataaaattcttacctttgagaggatagtaacctcttcctccctgccccttaacccatatcggatcaatcattaagtcctgttgattccaactcctcaatacctttctggaccccagatcctagagtaaaaggtagtttacaaatgtctatggcaccctggcaccctggtctttcctgaagcagcaccatcgtgaaactgccatctgttctcctaccatctgcaaatctaagtcgtgactctgggtggctgcctattgtgttttaccctggaaatagatctggctctttctccaccttccatttttattatcacatcagataattttgactgtggctgccttaatctggagtgtcagaatctgattaaaagtccagccagattcttaagtgcaaaccatatttcagaagtgactgggtggatcctccacctcatccccatctgtcccagcagagtgagatcaccacataccattcatccattcctctgacttgatgctgaactcataggctgtcgaccacagctgctcataaggtactttgttcttcagcatggcctgcagaagagggtaagtactcttctccttttccaatagctcttcctccttattgatcaactgcagggcaaaaggagatgctgtttatgggatgggttgttctcctaagccctcgaagacaccagggcaaattcctcagtgccttgaaaaccaagtggagggaaatgcttattcatctggagagtaagagaggaaactaaagcatgaactcaagcaagaatgtccctctgccacctccaaggaccttggcagctgaggtctgtctggttgaaactgtaggataatcagctacttgccctatcatctctgtttccactctatgacagccatatctccgttttcataattttcatatgtactttagctacatatatgatgttacctccttgtactgacttgcctcagaagtaagaattttaatggttattaaagaacttactagctgatctttggggacagttacttagcttctccaagacttagttctcttacttcagggataagtgaggataataacagtacctaacccaaagatgtgttacaggcattaagtgaaatattgcatatgaagctcttgaccattgctaagcacataataaatgttcaataaatgtgaacaattaccttactataatttcttctttggatgctcagtaactaataaagggaaaagtctggtgtcatgaagggatatgggaaaaggtagttgaaagtaccagtgagccaggtgtggtggctcatgcctgtaatcccagcactttgggagatgaggcaggtggatcacttggggtcaggagttcaagaccagcctggccaacatggcaaaactctctattaaaaatacaaaaaatgagctgggcatggtggcacacgcctgtaatcccagctacttggaaggctgaggcaggagaatcacttgaacccaggaggtggaggttgcagtgagatgaggtcacattactgcactccagcctgcgcaacagagtgagaccttgtctcaaaaaaaaaaaaaaaaaaaagaaaagaaaaaagaaagtaccaatgaaagaactggccaatgagttaaccaatactatccacctagtagatgctattaggaaataggaaattcacaaccaaggatcagaaccaatagaccagtacagtgtcataagtccccatctcaagatcccaaacctcaaactctgcaaacgcccgatttaggttctttgaaagctcattaagcttttcaacattgtgcttcatttcttctgtagtcatcacttcgcgcttcctaaaactttccagttctctgtggtagccctcaagtctcaactcaaattctgagcatctgaaaataaagacagcctggttacctttggactttgcattttgtgcactttcaaaacatcagcactgcttgcccatatttaagcctgcagacaatttgatcagttacctgcagatttcctcccccaatactcccaactccatctttctctctctctctcaagataaatgaagatgaaaaaataagttaaactacctataagaccacctcccagaaatcgagctgttgtgagcctgttggtggttaaacatttccagatattttcctgtacaggtaaatacgtataagatatatgtacacgtatacatactgtttattcattcagccattagacatttattattgagtgcctaatatattctataactgccctaggcatcaggaatatatttgcgaagtatgctattaagttctctaccttcatggagcttctattttaactgagggagacctagacaatagacatggatggatggatggatggatggatggatggatggatggacagatggatggatggatgaatggatggatggttggatgaatggatgaataaatccatagacaggacaaacaataaaatatttctgttagtaataaatgctctgaagaaaataaaatagggcagaatgactagcagacggaagtggagggctactgtagctacagtgaccaggagagacctttccaaagatttatcaacttcatccatattatcaacaaagcaggtctcaatgagaactgctccctttttctaatgaggtagaataatatagtgtgaagtggacagggtcttgagacaaacaagctagcttcaaattcccaccttgccacttagtagctatgtagtcttgggaaagtcacttaaactctctgtgcctcgggtagataaaacaaggatagaaaaaatgccagcttaatagttaaagtcaataagaacaacaataacaaaaaaaagctcagaattgagcctggtatacaatagtcaatacataagtgtttgctcacattcactaaaatgtaaactctataaatagttgatttttacttatttattaatttttacccagccctgttcaaggaaataaatatgtttcttgtctccttaattccttttagtgtcttcagcagttagaccatctgatacatggcaaataatcaatactcttcaaacaaataagggaacttgtcattgagatcagctatagtgacatttcataaatttggttatcctaagaatgcttaattctgttatggcagttttaaagttgcttttttcttaaacatgatttagagaattaattttcaagtggtttgagtctctctctctctctttatctctttctttctggagtgcagtggcacaatctcggctcattgtaacctctgcctcccagttttaagtgattctccagccacagcctcccaagtagctgagattataggtgcccgccaccatgcccagctaatttttgtatttttcatagagatgtggtttcaccatgttggccaggctagtctcgaactcctgacctcaggtgattcgcccaccttggcctcccaaagtgctgggattacaagcatgagccacatattccggcctccattccttttctcagctttttatttttgttttgtaataagctgtaattttagactctggtcagtgttcattttcaagaatatccttagtgtaaaaacatttcattcattcactcattaaaatggtgaacatccactataagcaaggaaccgtgttctatctgaatccttaggctttggtgaaacacaatgtcgggtgctctccctaagatgtcttcccttcttcctccagggtgccaaagtgttttcctttgcccttttatggcagagagcagcagctcacatccctgagtcatccatcgtgtaaatatcacataacttccagaaccacggaacctaccactgagttggatgaaatgatgggggagagaggcaatgcttattattcttctgttgtacatgcaattaggtgctgctaagtgccttttcacatcattaaattctttttgaagctccaaatactatactcacatagaaatctctgatgaaagcagttttgaattcctcccagagggcaactgcatgtaagctcagtgattaccttaaaatattactattattattgtttctaatttcttataattgctaagtacattatagtttccaaagtactttcatgtccccacaacacacacacatacaaacaactgctccttgacttacaatggggttacatccctataaacctattgcaatttgaaaatactggaaattgaaaattcatttaatacacctaacctactgaacatcagagcttagcctagcctatcttaaatgcactcagaacactcacattagtccacagttatcatctaagacaaagcctgttttataataaagtgttgactatcccatgtaacttattgtataccgtactgaaagtgaaaaacataatggttgtatgggtactcaacatatcactttcacaccatcagaaagtcaaagaatcgtaagttgaaccatcgtaagtcagtgactagctgtgtgtatgtgtgtgtgtatatatgtaaattccatacatatttcatataaataaattcctatatatatatcccaatatattatattccatagaataatacaatcattagcaaatagtaggcactcatgaaattaggttgaataagagttgtatttgtgggaccatttagagtgtaaggggaggattctggcaggaaatagaattcactcccatgttcaaagaaagatactttaaggattacttgcaggggtgagatatggataggattaaaggaacaaatagcagacagtgaggcacccagagactagcatcagagggaagccattaggacccccaggctggggacaatggaaactggaaccatggaggaggaggcattgacatcagagggatgcagctactgcctctgagccccagggccaggcagggagggagaggaggaaaagcttgctagctactctcccacctcctgcagggctctgtggacagggcccagcccggatccaacagacaagagaatccaacactgcagattgggcatcaccttccaggtgcagagccggagggtggggtaggaacagcaaatggagaataatcggcatggaaccccaaaaccattaatgtggactgggaaaataaagccagatttcttgcagaggaagcaagattgttttctcatgagatggatggatgcatgaatatggcttaatccatctcacaggctgttctcaggattaatgcaacatgatggacataaggatttaaaggttcaccgaagagaggggtgagcccagggctgccctgctgagcctcttctagagccgccctctgctggcccctgctgttaagagctggggaaccagcggatgagatcaagctgagagtcacccctcagaaggagacaaggacactctactcctctcgtcataaatgacaattgttcccattcctcacagagccacccctcactcctcctaacttcaacagcatttactgtctctaattggtcttggagtaatattctaaaatcatgcatgcaaaattgatgccttggaagttgagaagcgtttttctccccacagaggtccctgttcaaagggagaaggaagctgatagttttgggattcctaccacgtgctgtttaccacctaagcacaatctcagatcatctcatttcatccttcagcaccatgagagagggtctgattctatcccgttctccagatgaggggcacagagtctcaaaaagatgagccttctgtttatttatctaacaaaaaaagtgattttgccacccaagttgtaagtttacttatataacaaacctgcacatgtactcctgaacctaaaataaaagttaaaatatattaaaaagcaaataaagaaattgctgggggaaaatgattttactttcctggttagacataaaaaagtggtagatatatagagtggatactactcagccataaaaagaatgaattaatggcatttgcagcatcctggatggattgaagactattattctttttttttttttttttgagacagaatctcgctctgtcaccaggctggtttcagcatgttggtcaggatggtctcaatctcttgacctcatgatctgcctgcctcggcctcccaaagtgctgagattacaggcatgagccactatgcccggccaggagactattattctaggtgaagtaactcaggaatggaaaaccaaacatcgtatattctcactcataagtgggagctaagctatgaggatgcaaaggcataagaatgatacaatggactttggggactccagggaaagggtaggaggggggtgagggatacaagactacaaattgggttcagtgtgtactgctcaggtgatgggtgcaccaaaatctcagaaatcaccactacttactcatgtaaccaaataccacctgttcccccaaaaacctatggaaaaaaaatcagttccatagaaaagggtgtagagggtgtgtgtgtgggggggggcagggtgggggagttgggaggtatatgggaattctttgtactttctgctcaattttgctgtgaatctgaaactgctctaaaacatagtctattaatttaaacacaaatcaattccttccatcaggctaagttctgggctccagggccagtatccatccaggtggaggcaggaaaatacacacacactcacaaacacacacacacaaatgttttgcactccctggggagcacacttaggccacattttccaggtagcaactacatgggttgacccttcagccaaaactctcccatttggtgtagaaatccctgcttttatctattcttgtcctttcttgtaagtatttgcaggaactatggcagctcaagttgggagtgggagtttcttatgtgaaggggacagggtaattgatatgaatctgcaggtcataatcaaaacgtgaacctggagtgggtgtgtgtgtgtgtaaaaccatgtccatggcactggcccacttcacttgacattattggatttgtcagtatgtctatattttctatgtcgctggattaaaatctttatttagcagccaaacacacatagatgtctagaacagagcatagcacatcatgaaaatccgcaataaataccaactgaattgacaaataatgaatgaataagtgattacagccacattagctctgaataagaccagctgcaaaataggcaatttctcagcccccctgccatgcctttattatcttgatatcttgatatcttacagatctgtggtctccaatgtaaggctgacaatttcactattattattggggaggccgttataacatgccactagttttgcgtttttctctctgcaccaccaaattccaattattcaaggcaggaagggaagacattagcagaggttattacagtgaagcagtcttaaagaaaacatccctcagtgggaaaccaaaggaaatgccttctccaccaattgttttcagacttcgcccacacgttgccatggagtgagctgggggatggcttagacagaaccaggaacctgcagcatgggtgaagaagtcaggtctcatttccaagacaatcccagactctcccggtaccttttaatcagatccatttctgcctgatccctcttgtgaaggagcaagttccggctgttgtcaaagatatcttcaatctggtctggccagaggaacagagtgctgttcaatttgatgtcctcatctgcaaaacacatactgcctgctccaggacactgtttagcataggtcgggtcagcatgtggcgaattaattagacagaacaagaggtcaacaggagtggtgtgggggtggcaatgaacacatggatgagtgacagtgacatttgttgagcacttactaagggccaggctagaaggtagatgatattatcatccttgtttgcacagatggcaaacacagccattgagcctagtggtcaaggttacactgctagaaggcatcagagaggaattcaaatccaggtctaattccaaagcctgtgttctaacctctctgcttgattgccttcctaggctaggtctgagtcaagtcagaaacccagattgatgctctcgttccacagttcaaactatttcacttcatctgcatgtcggtttccctttaggttaaatggcagtcatggtatcaaagccaaatgccctacccattttatgactctggtgaattaaaatgtccaccctgggtttcctttgtgaatttcgggaggcagagcccacagtgagagtccacggtgtatccaggggtcgagggcacagctcgtgaacatgcaggtggatggttagggaaccacttttcactcccagtccccatctctccctcccatcaacctccccctgacatccatacattgtgaacaccaagtaattcacaggtattttcagatagaaaatggcttgttgagaggttattaacttttccttcagaatctgcttctcactttaaaactctaacttgacccaacaaactttcaaggagccctgactatttttttccttttacaatacacaggagcatgaagaaaagtgtctcggcctcttcaaaagtgggattgatgaagattacagatgggcggccaggggctgtggctcacgcctataatcccagtacattgggaggtcgaggcaggcagatcacttgaggccaggagttcaagactagcctggccaacatggagaaactctgtctctactaaaaatacaaaaattagttgggcgtggtggcacgtgcctgtaattccagctactcaggaggctgaggcatgagaattgatggaccctgagaggcagaggttgcagtgagccgagggtggcactgcactacagcctggatgacagagcaagactctgtctcgacaaaaaaaataaataaataaaagattacaggtaagtaaaatctactcatttaaaaaaatgattctgcatttggaagtgacttttccaggaacaccagacacagatgccaagacagggatctaagaactggaggtcggccaggccccatggctcacgcctgtaatcccagcacttgggaggctgaggcgggcggatcatgaggtcaagagatagagaccatcctggccaacatggtaaaaccccgtctctactaaaaatacaaaaattagctgggcatggtggcacgtgcctgtagtcccagctacttgggaggctgaggcaggagaattgcttgaacccaggaggcggaagttacagtgagcctagattacaccacagcactccaacctgatgacagagcgagactccatctaaaaaaaaaaaaaaaaaaaaaagaactggaggtcaagtgtctatctatgtctcctttgtgtctaacaagattccttttgtgtgattcaaattactgtggatatgagtataaaattcgtgcctctaacatatgggggcacttgaaaggcagctcttttatatttagtggtagaattcatataactatccttttgctcaacactttacccctaaatatataaatacatatagactatttgaaatgttatatatacaaatataaaatatacatataggtatgcatttcgatggtcacacatggcattggacttacacggcaagtctgcatagtccatcaggaactccagccgttcacttgcatctctaagttgcctcctgagtttgaacacagtgacagcactggatttctttaggaattcaatgagggataccagctccttagtgttggcaggaacctcactgactttgtctgcgatgtggctgtactgattacaaatgctacagaaaagaaacagccattgttatcatcatcatcatcaccatcatcaccatctaaaatgactttcttgtaagactccatgttcaaaatacataattcctatttgaaaaaaaaagaaaatttttttttaattttttccctgcctgcaaatccttgatggataatattcacatgcacactaaactccaggaataatagcagttgtaatgataataatacctgttatgtattaagccattatgaagtagcacaccccattctaatcatttacatagattaactcatttaatcctcacaacaattctaagaggtagatactactattatctatactttataatggaagaaagtgaccctgagtaacattatcgaaagcaacatggtatgtgggtgtcagagccaagatctgaacctgggttaattgactccaaagctcatactcttaacaaatacaccatactacctctcatacacagaacctagatttagaccaaaacaccaccaccaccaccagcaattcatcacattttgtgttgaaatagagcactaaattaatttttaatctttttttttttttttttttttgagacagagtcttgctctgtcacccaggctggattacagtggtgtgatagctcactgcaacctctgcttcccgggctcaagcaattctcctgcctcagcctcccgagtagctgggattacaggtgcctgccaccatacccggctaatttttgtattttaagtagagatggggttttgccatgttggccaggctggtcttgaactcctgacctcaggtgatctgcctgccttggcctcctaaagtgctgggattacaggcatgagccaccgcacccagccttaatcattgcttttaacagaacaacagtaagtttatcctcatgggctacaggtaatccctcttggcagagaaaatgttccattactgggactaccaggtctaactggccacttttcaaacataagactgaaaaatgatgttattatacagataatttgaatatgctctaatttatgcaaaagcaaatgactgacggtcttggcatcttaactacaattagaagcaaatcatccgcaatacgtccactcctagcacagagtggccctcaacaaatgttagcaatgataccatagttttgttattattacttgatcgtgacatgtttttttttttcttttttgagatggagtcttgctctgtcacccaggctggtgcacagtggtgtgatctcagcttacggcaacctccgcctcctcccaggttcaagcaattctctgcctcagcctccctagtagctgggattacaggcaccgcccccacccaccaccacacccggctaatttttgtatttttagtagagatggggtttcaccatcttgaccaggctggtcttgaactcctgacctcatgatccacccgcctcggcctcccaaagtgctgggattacaggcgtaagccactgcgcccagccctgttgatgttatttttaaggcagacagaaacttcagaagtcagccaccaacctggagttcagctgccaacctggggtgtctgcattcttagatattcctgggttcagaatgaggctcttattttcacttatattaaaaagacctaaggacattatacatttatttggataaggatgaatgcactgatcaactaaggcaccatgttgctttgatttgacaggaacaaatggatgattgcttaagggaaaaaaatgcatggctcaaactttccaaagaaagtctccaagtaggccgggtgtggtggctcacgcctgtaatcccagcagtttgggaagctgaagtgggagtattgcttgagccagggagtttgagaccagcctgggcaaatggcaaaactccatcactacaaaaaatgcaaaaattagccaggtgtattggtgagcatctgtagacccagctacttcgggggctgaggcaggaggatgacatgagcccaggaggtcgaggctgcagtaagctttgatcatgccactgcactccagtctgggcaacagagtaagaccctgtctcaattttttaaaaagtgtccgagtagtgtgaaggctgaaaaccttttgctgtcctcgtcccaaacccatatcctataggcaaagaagctgaagatacaggctgggtgcggtggctcacccctgtaatcttagcactttgggaggccaaggcaggcagatcacctgagatcaggagtttgagactaggctgaccagcatggtgaaaccctgtctctactaaaaatacaaaacattagccgggtgtggtggcacacacctgtaatcccagctactcaggaggctgaggctggtgaatcacttgaatctgggaggcggaggttgcagtgagccaagatcatgccactgcactccagcctgaacaacagagcgagactctgtctcaaaaaaaaaaaaaaaagaaagaaagaaaagaaaaagaaaaagagaaactgaagatccaagagacaaggccagctattctggctccaaaaccaagaatctgacctcttcatcaatgaatgagaaagctgcttgcacatggactttgaggtcaaaatgggttaattcccagatatgccactgcctaacctgtcagagtctcagtgtcttcatcaacacgatggggaaaataatgaacaacctcttagggctgttgtgagttcctgattagatctattctgtgcagggtacttatatggtgcctagattataccatgtgctgggaagatggtcactagtattattattaatttgctgatgattttctgatatgtattttgtaaaacttatagtactataaaatgctaaaattacacatatatgaataatacagtatacaatataatattaatagcggtgattattactaaatcattttattttacatttatttattctgaggtagggtcttgctctgtggcccaggctggagtgcagcgcctcaatcataactcactgcagccttgacctcctgagctcaagtgatactcctgcctcaacttgcatacctctctcttttttttttttctttttttttgagacagagtcttattctgatgcacaggctggagtgcagtggtgtgaacatggttcattgcagcctcgacttctggggctcaagtgatcctctcgcctcagcctcttgagtagctgggaccacaggcacatgccactatgcctggctaatttcttaatttttatttttgtagagatggtatcttcccatgttgcccaggctggtcttgaactcctgggctcaagcaatcctcctgcctccacctcccaaagtaaacccaatctcatgttgggactatagacgtcagccatggcacctggccactaaatcattttagtctatagtttaaagtgctttgaggaagagagctaggataacatggaataaccattttctaaccttcaaatagagacacagtagaaggcagttgccatctcagccaagcatccattacctctttctgtaacaacacctatgtattatcggggacccccacccctttcagctcatgtggtttaggtggtgttgacacccatcccagagatgggaacacccagccagatctaagccatcctcttggccagtgtttgattcaatgttgtacaaacgacctaagtcaggccaacctcacatgggccaggacttttccaaggatgatagaaaaagaaattttttgcctcctctggataggaatccgggaggatgtaagcctggagctgcagaagcccataaactggagagaacctgttagagaatggagccaacgtggaggaaagccaagcagagagagaggaattgcatcctaattgcagcattgagggcctgaagctagaaaccctaaacttttcaacatgtgagccacaaattccctttttaacccaagctagtctgtttgagcttctatccattataaccaaaaacatcttgtctaacacgtagttgtcagtaaaataaaggcataatatagagtttaagattgaacaatggaaccaaacatggtggctcacacctgtagtcccaacagacttaggaggttgaggcagggggatcacttgagcctgggaggtcgaggctgccatgagctatgatcgcgccactactgcactccagcctaggggacagaacaagaccatgtgtctaaaaaagagaaagaaaaatgatatgcaaatagaggcaggaggattgcttgaatctaggaatttgaggctaccgtgcactgtgactgtacctgtgaataaccactacaatccagcttggacaacatagcaagaccctgtctctgaaaacaattagaaaattcgccagccatgatggtggatgcctatagtcctagctactcaggtggctgaggcaagaggattgcttgagcccaggagttcgaggctacaatgagctatgatcaggccactgcactccagatagagtgaaacctccttttgaaaaagaaaaagattgaacaacagaattcccggacctatacagcagaattctgcctaggagtgattctaaggaaaatgcgcctgtaagcactttgtgtttcaaaatatgtgctagatgaacagtgagaagggcctgtgacctcagacagacaagcccaggaagcagtttgcattctcctgaatttgcctgcaagaagacaaaagcttcaggatcagagacaaactgctaacaaatgccctccacccgcctactccaacccccatgtcgctttctcttgactgttcacctcctagcctgaacctgaattcctcactacccttacttaggggcagaaaaaacttgatctagaaaataatctgttcattgctggaaggtgcaagttctggtcactttttcgtctccagttggtgccaaataccattgctatttgtctgcacagaattacaatacctggtattggtgtctcggtttacatccacttggaattgaatcagatggtctttaagattttgagctcgctcacagagatcatgatttagggccgtagcatcaaggcagaacatggctaaaggcacggtgatgttcatggatgcaatttcatttctccgtttctttatggcattgatcttctgcagaaaggagcacattcagtagcttgatttgcccttgagcctctcccacttgcccccagcctaacccctggccaaccctagtccaatgctgagcatggtctatgcaccaaagagacactaactgctcattggattgtctgcagcacatgtcaccaaggtataaaatctcaagtggcatttcctaccgtcacaaaatcatcaatgtcatgattttctttcaggaacgcagcgatgttttgctctgccgtgttatccaataagtcaacatactttttgtagacatttaaatatcttccatattgaagggtgtgaaatcaaacacacaaatataagtcaaccaaatcagatgagtcagagtggcaaatgaagacatagtagcattttaaaaaatgtagcccaagccaggaaagagaactataatgtggcaaaagtttcattaaacagagaactcagaattttggctctgattttcagtttcaccacttcctagcagtgtaaacttagacaagatatttcagtttttcaaggatgggtgttgtattagtccattttcatactgctgatagagacatactcgagactgggaagaaaaagaggtttaattggacttacagttccacatggctggggaggcctcagatcatggtgggaggcaaaagacacgtcttacatggcagtggcaagagaaaatgaggaagaagcaaaagtggaaacccctgataaaccatcagatctcattagacttattcactatcatgagaatagcacaggacaaaacagcccccatggttcaatgacctccccctgcgtctttcccacaacacgtgggaattctaggagatacaattcaaattgagatttggtggggacacagccaaaccatatcattctctccctggcccctccaaatctcatgtcctcaaatttaaaaccaaccacacattcccatgctgcccaagaccatgggaacccacctcttgcatcaatataacctggatgtgagacctggagtcaaaggagatcattttggagctttaaagtttgactgtcccactggattttggacttgcatgggccctgtacccctttgttttagccaatttctcccatttggaatggctgtatttacccaatacctgtacccccattgtatctaggaagtaactaacttgcttttgattttacaggctcataggcagaagggacttgccttgtctcagatgagactttgcactgtggacttttgggttggtgctaaaatgagttgagattttgggggactaatgggaaggcatggtttgatttgaaatgtgaggacatgagatttggaggggccaggggcaaaatgatatggtttggctgtgtctccaccaaatctcaacttgaattgtatctcccagaattcccacttgttgtgggagggacccagggggaggtagttgaatcatagggctggttttttcccatgttattctcatggtagtgaataagtctggtgagatctgatgggtttaccaggggtttctgcttttgcttcttcctcattatctcttctggcaacacctacacaaacatacccaggattaatactttgtatccctcaatccaatcaagttgacactcagtattaaccatcacagttgtctttaattttattttattttattttttgagatagactctcactgtaacccaggctggagtgcagtgctgtgatctcagctcactgcaatctcctcctcccagcttcaagtgattctcttgcctcagcctctggagtagctgggattagaggcatgtgccaccacacccaactaattttggtatttttaatagagacagaattttgtcatgttggccaggctgctctcaaattcctggcctcaagtcatttgcccaccttggcctcccaaagtgctaggattacaggcatgcatcaccaggccgggcccaatgtctttaattttaagtggaaatgatcattaacacctcataggattattgtaatgcttaactgtaataaagcacacacaaatgaattaatgctgtgcctgacatacaatgaatgtgctacaaatattacgatagtccctccttacccttggggatatgttccaagacccccagtgaatgcctgaaaccgcagatagtactgaaccctttatatactgttttttcctatacacatatatgtatttatgataaagtttaatttataaattaggcacagcaaaagattaacaataactgaaaataaaatggaacatataacaatataatgtaaaaataaaagttatatgaatgtggtccctttctctgtttttctcaaaatagcttgatattttccaaccttagttgacctcgggtagctgtaactgcagaaagcaaaaccgcagacaaaggggacgcctgtgattcctatcccttcttcaagtcccaaaattctaagcctaaatcttaagatgaaaatctaggactaattaacctaaaatctattaaataaaatcaaaattttctctgcctgtaatcaaatgacacaaaaatggctggacagtttccccaaaattggaggatgtgtttgggatggtctggtttaaaataagtttgaattaaaataaagatgatagtgagtaagcagaattaactttgtgggactcagtggcatgcttccaagaggtgatcaacactttagagactctgaaactgagatgcaatgagaaatccgtggaactgtcaatccagaaagacaaacaaccccatcaaaaagtgggcgaaggatatgaacagacacttctcaaaagacatttatgcagccaaaagacacatgaaaaaatgctcatcatcactggccatcagagaaatgcaaatcaaaaccacaatgagataccatctcacaccagttagaatggcgatcattaaaaagtcaggaaacaacaggtgctggagaggatgtggagaaataggaacacttttacactgttggtgggactgtaaactagttcaaccattgtggaagacagtgtggtgattcctcaaggatctagaactagaaataccatttaacccagttgatcccattactgggtatatacccaaaggattataaatcatgccgctataaagacacatgcacacgtatgtttattgtggcactattcacaatagcaaagacttggaacaaacccaaatgtccatcaatgatagactggattaagaaaatgtggcacatatacaccatggaatactatacagccataaaaaaggatgagttcatgtcctttgtagggacatggatgaagctggaaaccatcattctcagcaaactatcacaggcacaaaaaactgaacaccacatgttctcactcatagatgggaattgaacaatgagaacacttggacacaggaaggggaacatcacacaccggggcctgtcatggggttgggggatcggggagggatagcattaggagatatacctaatgtaaatgacgagttaatgggtgcagcacaccaacatgacacatgtatacatatgtaacaaacctgcacgttgtgcacatgtaacctagagcttaaagtgtaaaaaaaaaaaaaaaagtagaaagaaagacaaaacgtgccaggcaaggtggctcacacctgtaatcccagcactttgggaggccgaggtgagtggatcacctaaggtcaggagtttgaaaccagcctggccaacatggtgaaaccttgtgtctactaaaaatataaaaatcggctgggcgtggtggcacatgcctgtagtcccaactacttgggaggctgaggcaggagaattgcctgaacccaggagatggaggttgcagtgagctgagatcatgccactatactccagcctgggtgacagagcgagatgccatctcaaaaaataataaaataaataaaataaaataaaataaaataaaaataaaataaaataaataaaataaaataaaataaaataactgtgtgtctaagagtccatgaatagggaaaacagaggtttcaaatagaatctcccaaatcaaattcacgagggcagggcttccaaatatgaggccatgattttttgactaggttagcagttgttctcaactggtggggacttttggccacacctgaagacattcttggctgtcacaaccaggggattcctgccggcatgcataattcctacaaggattctgctaaacagcccaccacgcacaggacagcccccacaatataattttccagtcaaaaatgtcagtagagctgcagtccaaaaactctgggttagcgtgaccatatctcttggtttgcctgggacagtccaggtttatacctgttgtcccatggtaattgttaacaacactcttttcactcgtaaattgtctcactttggaagctatttacaggatcaccctaaactagtgtgatatggtttggctgtgtccccacccaaatttcatcttgaattgtggttcccataatccccacgtgttgtgggaaggactcggtgggaggtaatttaatcatgagagcggttaccctcatgctgttctcgtgacagtgagttctcacgagatctgatggtttataagaggcttttccctcccccttttgctcagcacttcctcttcctgctgccacgagaagaaggatgtgtttgcttccccttttgccacgaccgaccgaccataagtttcctgaggccaccccagacctgcagaattgtgagtcaattaagcctctttcttttgtaaattactcagtctcaagcatgtcttcattagcagcgtgagaacggactatacatagtgactgctcacgtgtgcagctgtgagatgttttacagtgtgatgattaaaggacatggcctgtgggttcagataactgattctcgatccccaaatccaaaaagttctgaaaacagacagttgcctcaaaattcacttggtagcaaaagttggcctgaacagatatgaggctattatgtgaatatttataggtttccctgcagaaatatcaacatgttgccccagacctcacagaaactgcaggataatatatgatatacgcattatgttacttttatataacccagaaattttgaagtgccaaaacccatctggcttcacaactatcagataatggaggtggatctgtaattgaatttgaatcctggctctactaactatttgctatgtaacactgggacagttagagtttcctcatttgtaaagtgggaataaatagtaatactcatgtaagtattggctattcttactatgtatgtgttcaggtgtttgggaacaggaataccttattggatgagagttaagaacaccaaatcaatcccaaaaagctacatagctaataaatttataactcaacttacttgcaggggccaacttgatttttctgaaataccttgaaagtttgaatcaaaaaatcagaaacaagtttttcttctgcgttaacagttccaaggagcagattatatcctttcagctctgggaacaggacagattccacctgaagagtaaacaccacttttgcatgttgcaagacttaagaagggagatggtacccaaatgcaaagccttctctaatgcactcatttccagggctgccagctgcatttttactctatttcctcttagatagtgctggaatcaccctgctgtttcctctacctctgttctctctcctttccttcttgcctggattactcatctttcaaatccctgacctttcaagggtcttgtcctttgagagtcccccttgtcctgctcaccgccccacaacgctccagtggatgttggtttccctgtttcaggctcaccttctgaacttttcctgcttagcactcatcacaattgcaattagatgaatgtgtaatgagatgttctaggtgtgtcatagaatacaaattccatgaaggtctggatcatatttgacttcttcactgttatatccccagggcctagcaaaagcttggcacttggtaagtgctcaaaaaatactgggtgagtcaatgaatactatcgtagtgctcccctcctcccctactacccagttttcctctctaatgaaaattctggagacgtggattctaattctgaatctgccactgagggacaatgtgaccttaggtaaactacttctctcgtgggtttttttttgttttgttttgtttttttgagacagtctcactctatggcccaggctggagtgcagtggcacgatctgggctcattgctacctctgcctcctgggctcaagcgattctcctgcctcagcctcccgagtagctgggattacaggcatgcaccaccatacccagctaatttttgtatttttagtagagacagagcttcaccatgttggccaggcttgtctcaaacctcaagcaatccacctgcctcagcctcacaaagtgctgggattacaggcatgaggcaccacatctggcctaaactacttctctgaatccccattttctcatctgtaaaaaagaagagatgtactagattctcctctaagcccagagaaaacaaacgatggctttatgatcatgaggcactgaaagtatcttctgagagaattcatactctctaacttctttttatttatttatttttttaaagagatggtctcactctgtcacccaggctggagtgcagtggcaccatcatagctcctatgctatgtgactcctcagctcaagcagtcttcctacctcagcctcctgagtagctggagctacaggtgcctgcgaccatgcctaattttcttatttttatttatatttttgtacagacaggggctctctctatgttgcccaggttggtcttgaactggtggtctggcttcacaactttcagaaaatggaggtggacctgtaattgtatatgaaccctggccctcggctcagcctccaaaagtattgagattgcaggcttgagtctccacgtctagtcactctaactccctcatggcacgtgtgtgtctctgagaatgttctcacttgcatggctcatgcaggctgcaaagttcctgcctgggacccattgtcttccattgtcctctctgctaagaaagattttagtggctggtctcagaaaaggtcttcagagtgtttcagtgagttacatgggttatatgcctttgatggaaatgcatcaatttagaaagggggaaaatcaagtgcaaatgatctgtgtcttgtttggccaatccagaggttttgaaaccagtggaggagcaacttctttgctgcagccatactacagacagctgccaaaggcaacgagatggagggactggcactggtcaatgcgtgaatgaaatggtttagggcagcacaattggtgcccccaggccatgtgacagatcacaagtgggcaggataatggatcgtctcatgggaagaagtcttcaaacttaagaggatgaaatacctcttgctgctctttcaatgtggtggattctcttatgccctgtagagcagtctgtgaaatggagtcaagaacaatcgcattcggccgggtgtggtggctcatacctataatccccacactttgggaggcagaggcaggcagatcgcttgagctcacgagttcaagaccagcctgggcaacgtggcggaaccctgtctctacaaaatacaaaaataagccgggcatggtggtgcacacctgttatcccagctacttgggaggctgagatgggaggatggcttgagcctgggaggtagaggttgcctcccgggctcaagcagaaaaaaaaaaattcttttttttttttgagatggagtttcactcttgttgcccaggctggagtgcaatggcgcaatctaggctcactgtaacctccgcctcctgggttcaagtgattctcctgcctcagcctcccgagtagctgggactacaggcacccgccaccacacccggctaattttttgtatttttagtagagacggggtttcaccatgttggctaggctggtattgaactcctgacctcagatgatccagccatctcggctaattttttgtatttttagtagagacggggtttcaccatgttggccaggctggtattgaacgcctgacctcaggtgatccagccatcttggcctaccaaagtgctgggattacaggtgtgagccactgtgcctagcccctttaataattatttctcacaaatatgctttcctgctttctttctgtgtcttgaataatgctatttactctattttctattttcaaaagtctcttgttagcttttccctaccaacttttttttttttttttttgacagagtctcactctgttgcccaggctggagtgcaatggtgcaatcatagctcactgcacccttgaacttctgggctcaagcgatcctcctgcctcagcctcctgagtagctaggactacagacgtgtgccaccaccccagctaatttaattttgtagagatgaggtcttgctatattgcccaggctgatattgaactcctggcctcaagcaatcttcctgcttctcgacctcccaaagctctaaaattataggtgtgagccaccatgattgaccttaactaacttttaaaattctttttaaaccatatatacggcagatcttgcagtgagtgaaggtaacacccaccagttgccattcttaaagatttttcttagtcaacctgcaggactatgtttttaagtcttcactaaccagttcagagataaaacagtctgaggggcttaaggaggaagctagggctgtgggtgtcactagatggggaactcagtctacgttgtttttccttattgtctcgtaaagtcattggtattcacataggccttgttttcaaacctggtacaaaccatgtcttcttggcattgtaattcatcaaatgtagtaccggccctggtacctgccattgcagtggcagccgcgtgcatgctgggctctcctggctcagctgctttcacacattgccgatcagcagcagcagcagtgaaggagaacttaagtggtatgtatttcagctgtccccatacatagtcatccaaattacagggtcttttcttccatttccttcctagggatactggttgtaggagagctgcccagtgtttcttctcctcccacacacccagttttaatggagtacttagaaccctgtaagtaccagattgcaaagagaagaatgcttgggcctccttgcactgcaaccttgaactcctgggcattcgtttcacatgagcaaggcccatgtgaagcatacataatgcatggagagagtgagaaggtggaagggtgagggagctagccagcaagaccccacagatcccttccctatatggaactggacaatggccctttggtcataccaaccaatcagagggagtgaggaaaagatggagctaaaaggagttacatccatgtgcatgatcctgtctagtaataaaagtttgttaataagtgtctggaatttaattagtaactctaccctggaaagcaaactggaaagggcgtgggccaggaaaggaatggttattctctctagaagcctacagtggctaaaacataacaaaccaacaaacaaataagcacacagaagagtgaaacttcaaactgaaattgaaaaaaagttcttggcaagttaatggcaattgattcatgatggattattaacccacagatatggcttgggacctatctgattcattgaggttgacatcatggaggacactatactctctcacaaagtaggtctttttttttttttcttttttctttttttttttttggagatggagtctcgctctgtcgcccaggcaggagtgcggtgacgccatctcagctcactgaaacctctgcctcccgggttcaagtgattctcctacaaagcagctcttcgtgctcttgttagaagcacaattctgggctgcgtgaatatttctttatggtctaaatcatttgtctggggtcaaggggttatattcaggatatatctccaaagtgaagctcccttaactgaatatcccagcgacctgacttgtacaacctctttcaatacattttattcactaagtgaaaaaatcatgcaaatgaatgattaagtgactactataccttggggatcccattagagttcttaataatttccaggaaagagtcacgtattaattcccagcagccatcaaaagatggattgaagacaataatgggttcactgacttcaagtttgatcatgattagctgaggtatgaaaaacttcatctcttggtagggctccttaaaatcattcccatccttcaggagacataaggtagggcaagcgttacaaaattgggccttccaaaatcaagggagtgaattttatacattcatagaactacatgaggaccagaaaaggcaatgaagggcatcatacactgtttatatttaaaatatgggctggggctgggcaccgtggctcacacctgtaatcccagcactttgggaggccgagacaggtggatcacctgaggtcaggagttcaagatcagcctggccaacatggtggaaccccgtctctactaaaaaacacaaaaaactagccaggcatggtgatgggtgcttgtaatcctagctacttgagaggctgaggcagtagaatcacttgaacccaggaggcagaggttgcagtgagatcacgccgttacactacagcctgggcaacaagagtgaaactccatctcaaaaaaataaaaaacaaataaaatatgtattgggtatagcttagcccaccctgactccatgcactctccctttcccaaagcctttattcccttttgtttatgcggcttggtaattcctgcacccaatatctagatccttcccatccttcaaaattcagctaaaacatttcttcctttgggaagcctccctgtttctcagctggatataatctcctcccacttctgaacttgtgtatttctacttcctctgttttttttttaatttattttatttgtgtccttagagatgaggtctcactatgttgcccaggctggtcttaaactcctgagctcaagtgatcctcctgcctcagcctcccaaagtgctgggattacaggtatgagacactaggcccagcctagtatttttttctttctctctggtaggaatttatatgcgtatctcaacttgtctattctaaagttgagggcaggatctatgtctgatcacctctctcctccaaaatacctgagacagcatatagtacctaacaggtgctcaataaaaatttattgattcagtccaaaagtattaatcataatccatataaccccaaatggagttgctaatgagcatagtttattttagacactcaaaatgtcaaccttgctacaacagaaatattgacatagagctatttccaattccctacaaaagctctaacccaggatgccctcataaactacagcgcctaatgaaattgtcagaaggcagctgtaaagtacttcttacatagagatttctagatccatttaaagatgactgatgatatttggtgaatacctactgtatatcaaatacctataaattcccccctattttccagacacaggaagattttacatttccctttgtgtggaattttagagtgagattggcttccacccctgggtttcttatgcttagcaaagtagacaatcacaatgacatttatagattggtcttctttagagagctaacattgcaattcagccccactggtttctatatttttgagcaaaagaccaattgttaatctttattacttcatttggaaaacttaaccttttataaccaggtaatttttaatttttgttactttgttaaggtaaaatgtgcacacggcataaaattcaaaagaatattcatcgatttttaggctatccaaattcagggaatgctatggtgctttgaaaactaggacttagtgttttcagttttctctctttttttttttagacagagtctcgctctgtcacccaggctggagccaggcagtggcgtgatctcggctcactgcaacctctgcctcctgggttcaagtgattctcctgcctcagtctcctgagtagctgggactacaggcacacaccaccacacccggctaatttttgtatttttagtagagatagggtttcaccagtcgaccaggctggtctcaaactcctgacctcaggtgatctgcctgcctcggtctcccaaagttctgggattacaggcgtgagccaccgtgcctggccagtgtttttagttttcattttgacttccctaaaacagtttcatgaaagaatttcttaattaggtcaacaaagccttttgtctttagaggtgccccttgccaagaccaaagaacaaaaacccatatctacaatgaaacctacagcactccctcaatatcaagccaaagattgaaaacaaaccttttccaaccccttcttgtaaaagagaggatgaaaaaaatgattccttctccccaaactgtaagacatatgtctttcattttatgcaatttttctttaaattttcttaacaacttctctacttctgtacatttttaccaacttaatactgagtgattatctcaagaaagtttgccatgtatttaaggaaattatttttaaaattattccaatccacagctggactggacttcttaagattttatttatggttttatacctctctttaaaaattaaaaaattgatactgattaattgtacatatttacaggatacatataatgtatagtggtcagatcatggtaattagcatatctatcatctcaaacatttacttttttttttttttcctttttgagacagagtttcactcttgtcgcccaggctggagtgcaatggcgcgatctggtctcactgcaacttccgccgcctgggttcaagcaattctcctgcctcagcctcccgagtagttgggactacaggcatccgccaccatgccaggaaaatttttgtatttttagtagagacagggtttcaccatgatggccaggctggtcttgaacttctgacgtcaggtgatctgcccgccttggcctcccaaagtgctgagattacagacgtggcctgtaatgcacccggccacatttaccatttgtgtgtgtgtgtgttgggaacattcaatatccttcttccagctaaaagaagacatttttataaactaacaactgcctgatgtgggtggaagtcaagcatttcactttgtgccctggctcacagctgaggacgtacatgacagagtcctggctctaaccaagtaaccaggttattcccctcaaaaggtccaaatgcaggtccctgacttactttgtgtatcatgaaaagggaaacgaggtcctcaagtgacttaatgaccagctccctaagctgcagcgacatgaatgatgccacagaagcaaaatattcctcaatgtttcgacttgagtcatagttgctcttgggagcaaaatgaatccagtgctccttccgtgaggtaaaaagctgggcgcaggtggggatccacctgtaaagacagaagggtgtccatgtgagaagctcttctgggctccgaggaacccacttgccgtgccccctgagctcagtgatgaggcagatgggctcaatgtcccaccaagcagccttgcaaatcagtactttcaatttccagccaccttacctgccatgcctctttcttgggaagaaagtaataagatttgaattaagaggttattcttccattgagaatacccaaatggaaaggggatattggtggcacatcctgctgaaagagtctacactttcttcattataatcagagattggggtaaaggggcataaggaactagaatgttctgtccaacttctctctctctagcagatgcctggtctctgattcaaacttcatagggggaaagagagaatgaggagcaaagaaagaaaacatgaaaggagaaactccagtgtggccctggctgctcagaagttgatggtagaaatcagaaaaccaaaagaagaaatagccaagtgtggtggctcatgcctgtaatcccagcactttgggaggccgaagcgggcagatcacttgaggccaggagttagagaccagcccggccaacatggcaaaactccatctctacaaaaacaaacaaacaaacaaaaattagctgggcatggtgcatggtgacacacacctgtagtcccagctacttgggaggctgaggcaggagaatcacttgaacctgggagatgggaggttgcagtgagctgagattgtgccactgcactccaacttgagtgacagagtgagtgaaactctgtctcaaacaaacaaacaacaacaaacaaacaaaaagaaatagatgcttcattgtttctttcctcccatgtcccccagtttctaattcccagtggaaaccactggccttttcatcctattgcatcttttctctgatcgctaaaaaggtactactctagcaaccagagaagcactactactggttgtagtcatagaggtatgagatttattgagcagctattatgtgccaatgatagcatctacattttctctgctaaagaaaacccatctgcaggtattattatcactgttttacacaagggaatttctctggctgtggaggtagtcttgcaggcatttgcaaaggaaaaaggaattgtgtaaatgtatgaaacccttttgccttgaaatcttgaggccgtttatctggactatctgaatataagtcattcaaatgcattcccctgtaacacagcaaggtctaaagcaggggtccccaacccctgggccatggactggttgtaggaaccaggctgcacagcaggaggtgagcagcaggtgggcgagccagcttcatctgtatttacagccgctccccatggctttttttaaccgcctgagctctgcctcctgtcagatcagcagcggcattagattctcacagaagcgtgaaccctactgtgaactgcacatgcgagggatccaggttgcacactccttaggagaatcaaatgcctgatgatctgtcactgtctcccatcaccttcagatgggaccatctagttgcaggaaaacaagctcagggctccctctgtttctacattatggtgagttgtagaattatttcattatatattacaatgtaatcataaaaataaggtgcacagtaaatgccgtgtgcttgaatcaccccgaaaccatcccactggcccagtctgtggaaaaactgtcttccacaaaaccagtccctgtggccaaaatgggtggggaccgctggtctaaaggattcgaggaggaggaaatgggggtgacagcctcccagggaatggtgataggggaatttcaagaaggcagagggagaccaggcatggggcagaaagcagctggacatgaaaaaaagaggacacgaggccaggcgcggtggctcatgcctgtaatcccagcactttgggaggccgaggcaggcagatcacaaggtcaggagattgagaccagcttggctaacacagtgaaaccctgtctctactaataatacaaaaaaaaaaaaaaaatagccgggcatggtggcatgcacctgtagtcccagctactgggggcgctgaggcaggataatcgcttgaacccgggaggcagaagttgcagtgagctgagatcacaccactgcactccagcctgagtgacagaaagagactctgtctcaaaaaaaaaaaagacacgaaaggatgccagtgggacaaaccccaggctgggtaccagcttcatttcagagggttttcagtctttaagataccatggtgcagccccacttggagggcagatactgacttgttgagaagagtctggtgtgcctccaggcagtgtttctggatcacatcccaaaattcctgaggctgcagaggcaattttcccgctagtatttctgctgttcgaacaaacctgaggtctctgaatctgccaaaagagagggagaaatttcctaagctaaagaacgcttaataacaaatcccgcaggacaggttccaagggtgtgtgttcacgtttctcaatgaaagttaagcagaatcaaatgaattacaggatatgggaaagatgctgaggaggatatgggaggctgaggagggaggagctaagtcctaaagaacgcttgcagggaggagacaaatgaggtgacccaagagtgctcctgagccttagagatatgcctcactctgcataacccatcaagaagtggggctgtggcaccagctggagactcagctggctgagaacttgggtatcaaatggacgaatcaatgttctttacaacagtgaagacccagaggccaggaccaagcagaacatcttcatcatcaaatgggattcacccaagcctctgggtgagctcttgaaggtaactttgaggactgctttgatttaaaacaaagagtttatggatcccagcactttggaggctaaggagagaggatggctttgagctcaggagttcaagaccagcctggcaatatagtgagacatcatctctccaaaaacaaaacaaaacaaaacaaaaaaggccgggcgcggtggctcacacctgtaatcccagcactttgggaggctgaggtgggtggatcacaaggtcaggagttcaagaccagcctggccaagatgctgaaaccccgtctctactaaaaatacaaaaaaattagccgggtgtggtggcgggcgcctgtaatcccaaccacccgggaggctgaggcagagaattgcttgaactcgggaggtggagcttgcagtgacaggagatcacgccactgcactccagcctgggggacagagcgagactcgtctaaaaaaaaaaaaaatagacgcgctgggtgtggtggtgcacacctgtaatcccagctacttaggaggctgaggcaggaagatcgcttgaacccaggaggtcaaggctacagtgagccctgattgcatcactgcactccagcctgggtgacagagcaacaccctgtctctacaaagaaaaaaaaaaaaaaaaaaagcttgtggagccaaaaaagcctctttaagccctctaactcctgtcactgtgagggtgaagaaaggccaaccagtgagaagaaatgagagttttctccactacgaggggtatccttttaacacctaagtcagattctatctgctccaaaccctccaatgacttcccatttcagagtaaaagcgtgcctagtgactggggcccactaggtgctctgcaccctatgccatctctcttgctcctgtcctgcctgtcacctccccccctccccatctcctctcctacccacctccgtgactcacagtgttccaggcacgctcacctcatactgtttccaggccgtgcccacctgctgctgcttgggtcctgtgcacaagctgttcccgctgcctccaatactcatcccctcgacttctatggagctgactcttcaccttccagccttggctcaaatgtcaccttcacagtaaaggctacccatggctgggtgtgtggttgtgcaggatctgccccttccaaagggccagaatgggtgagtgctctgcttgtcaagaaatgcaccctggggctgggtatggtggctcactcctgtaatcccggcactttgggaggccaaggtgggtggatcatttgaggtcaggagttaagagactagcctggccaacatggtgaaaccctatctctacaaaaaaaaaaaaaaaaaaaattagccgggcctggtggcgggtgtctgtaatcccagctactcaggaggctgaggcaggagaattgtttgaacctaggaggcagaggttgcagtgagtcgagaccgcaccactgcactccagcctgggcaacagagcaaggctctgtctcaaaaacaaaaacaaatgcaccctggtgttaggctgcatccatcccattagtggacaggggtagcggggaggtttgttagattcaaacaagtgttttatgggcaagcagccccaccccagccccacacaaaccacactccctatccccattactctggctaatttttcttttcatagtacccatcaccttctaacatattatataatttatttacctaatatatttattgtctgttttccccctagaaaaatgaactcacttctgttctctactacactaaaacaatgcttagcacataaccaggacctggcacctatttgttaaatgaatgaatgaatgaatgactaaataaatgaaaaaaaaaaaaaaaaaacaaatgaactcacagtttggaagccaagagacagaagagcctttggacctaatatatatttattttctatcttatgcttgagtgacacctcctagaactattgatgctagagttgtccagagtatatcggtaggatagagcggctggataaggaagagcggaaactaataaaaagctctcatcaagccctccacttttttttttttttttttcttgagacagggtctcactctgtcacccaggctggagtgcagtggcgatcttggctcactgcagcctcagcttctgaggttcaagcaattctcctgcctcagcctcccaagtagctgggactacaggcacacaccatcacgcctggctaatttttgtatttttagtagagacagggtttcaccatgttggtcaggctggtgtccaactcctgacctcaggtgatccacccacctcagcctcccaaggtgctgggattacaggcatgagccaccacgcccaggctctcattgctgatttttttggttcagttgataaaattcttctaaatgatttcagttcactttggtgctgctgttgctggcataatcttcctcagggaaccatgaaaagcaagtggtaaaaagcctttcttctcagtgaagctataggctcaacaatttgccgtctttgctacgagatcaatttaaactcaggtacatgtgattatctattatcttctgaacttctttatgaagtttctggctattcatccagctctaagactgacttcctcactagtttctatgttaatttatttttttagctcataaacacgcttgtacttaaagcaataccttaatttgttgagcaattactgtgtgccaagcagcagtctaagcactttctttagctaacaactccaggaggtaggtattgttatgatgattcccatttgcatgtagaacacagggtcagactaggcggtggctcatgcctgtaatcgcaacactttgggaggctgaggaaggaggaattcttaaagccaggagttcaagcccagcctaagcaacctagagagaccctgtttctacaaaaaatgtaaaaattagtcagacatggtggcatgcacctatagtcccagctacttgggaggctgaggagagagcccaggagtttgaggctgcagtgaactctaatcatgccactgcaccacaccctgggtgacagagcaaaagcttgtctaaaacaagaaagcaagcaagaaagcaagaaagaaacagggtcacagaggaaggaaggaaggaaggaaggaaggacaaacagggtcaaagagaaagaaagaagaaaagaaaggaagaaagaaagaaggaaagaaaggaaggaaggaaggaaggaagaaagaaaagaaagagagatgagagagaaggaaggaaggaaggaaggaaggaaagaaagaaaaagaaaggaaggaaggaaagaaagaaaggccggacgtggtggctcttgcctgtaatcccagcactttgggaggctgaggcaggtggatcacctgaggtcgggagttcgagaccagcctgaccaacatggagaaaccctgtctctactaaaaatacaaaaaaaaattagccaggcatggtggcacatgcctgtaatcccagctactagggaggctgaggcaggagaaatgtttgaacctgggaggcagaggttgcggtgagccaagatcgcgccattgcactccagcctgggcaacaagagtgaaactccatctcaaaaaaaaaaaaaaaaaaagggggagagaaagaaaggaagagagaaagaaagaaaagaaaacagtcacagagggattaatttctctcaaattatactattaattagtaacagaacaagaaccagaattcagatcccattctataagttattactttatatggttccacttagttagaaaattacttcttttttctcaatgtcctgactgctgactggtacttccaatgctttagaaaattgaattcagttcaaagaaaagaatacagctatttcttttcactgatgggctctgtcctacgttgacttcaccccctcaattcctttttaaaatacaagcaaaactaaggatttgaaaaacaagtaggttctccaagccacagggctcccttaagactgaacacgttcaaagctagagatcctcccaaagcaaaatacatgagctactaataagttcggccaatcaaagttaagtaagcatatctgcctctaatttttctaatacaaaactcagatgggggcagctcatcatttcattagcctggcctttcagtgaactccggtgtcttcatcctctcaccaggatgtgtaccttcttgaagggctcactaaaaaaaccagagtcttccacctccaggctcactgcaattgatgcatagataaaacaaatgtcggatagccatccaatggattagtatgccgccataaaaaggaagcactcactactgatacaagcttcagtgtggatgaagactgacaatattgttcattgaaagacaccagacacaaaagatcatatattgcatgattccatttctataaaatgtccagaatatgcaaatccatagagacagaaaatcacttagtggttgggaggaaatgggggaaggtgagaatgcggagtgactgctaatgggtttctttttggggtaatgataatactcttgaattagacagtggtaaggattaaacaaacttgtgaatatattaaaaacttgcattgtgtactttcaaagggtgaattttatggaatgtggatatctcacttttttttaaaatgaaagaatgaaaaaaggtggcttctgtctcatctggactcctacaatttttttttttttgagacggagtttcgcaaatttaattattgataaatatacctgagagatcactgcttgccagccctgtactggcactgagttacataaaggaataagaccgtccgggcgtggtggcttacacctgtaatcccagaactttggggtgccgatgtgggtggattgcttgagcttaggagtttgagaccagtctggacaacatggtgaaactccgtctctatcaaaaaatacaaaaaattagctgggtgtggtggtgtgggtctgtggtcccaactactcagctaacttgggagactgaggtgggaggattgcttcagcttgggaggaggaggttgcagtgaatcgagattatgccactgcactccagcctgggtgacagggtgagattcgtctcaaaaaaaaaaaaaaaaaaggaataaaacccaagcccgcacacacttcataggctaaagggagacaaataagtaaatgttctattataaccaagggtgagctgggtgcgatggcccatgtctctaatcccagcactttgggaggctgaggctggcagatcacctgagatcgagagttcgagaccagcctgaccaacatggagaaaccccatcttgactaaagatgcaaaattagccaggcatggtggcgcatgcctgtaatcccagctactcgggaggttgagacaggagaatcgcttgaacccgggaggcggaggctgcagtgagccaagatcgcgccattgcactccagcctgggtaacaagagccaaactctgtctcaaaaacaaaaactgagggtgatgttgtaatggaggtaatgccaaattaacaattactggtgcttaagttatattagatactgttctaagtgctttggatgtagtaagttatttattcctcttatcaatcctatgaagtggaaactcttattaacattatcgcaaatttagaggtaaaggaagcaaggcacagaaaagtgatgcgaccacatatatgcctgtaaagcagcagagctaggagttagacctgagcaggctggctccaagtctgtgcaattaagcaggatattccagtgcttagagacaggcacagggtgccctggggacacaaaggagggccacgtaagcctgcaaggaaaggtgtcacttataattcacatgcatatttggcctagatttttttttctttcatttctctatgctgtcagggctacccccactgtgcacagcagaataggcttgcttacacgtggatgtggtcaagaaagggaatgaaaaaaaaagggagggacttcttactctgcaaaccacagttctttcagcctgagcatcatggggttcaccgtgtgcagatgctcctcgttccacttcttggcgctcctgtagacactgtgccagggcacaggggcccggatcactctttgaggaaacaagcgggggatgctctcaataaagagccgttttctctccattgggtccatgaggatgtaatcaactacaaccggaaagggcgaacacctcattattaagctctaagggttgtgctcttagcttcaactcatttagttttgtttttaatatagagacggggtctcactaagttggccaggctggtctcaaactcctgggctcaagtgatcctcccacctcagcctgccaaagtgctgggattacaggcatgagttgctatgcctggccttagagtcaactctttttatttatttatttatttattttttgagatggagtctcgctctgtcgcccaggctcgattgcaatggttcaatctcagctcactgcaacctccacctccgcctcctaggttcaagccattctcctgcctcagcctcctgagtagctgggattacaggtggctgccaccacacctgcctaattttttgtattttcagtagatacagggttttgccatgttggccaggttggtcttgaaatcctgacctcaggtgatccacccgcctcggcctcccaaagtgctgcgattataggtgtgagctagcacacctggccttagcttcaactcttagaatataaatgagcctctgtccatttgcaaggtcatgggtaatcccctgggtataattcaactggtgaagcttcactcttggtgtttgttttctttctgagggtattttacagaaaggaggagtgtgacttcacggtgtggagcacttagaatctggggttgagccctggtaggatgtctagtatcaggcaggacaatgaaataggatttgctgataactcattagtcactgattgatttctcacaccaaaatagatgcacacaaaaaaacccaccatggatgataccatccattatatttacaaatagaagtttaaagaccaaatgttttccatactaagaaaggttggtagaaaagcttcatagaggatgtaacatttgtgctgggtcataaagaacaagtagcaggctgggtgcggtggctcacacctgtaatcccagcactttgagaggctgaggtgggtagatcacttgaggtcatgaattcgagaccagactggccaacatggcgaaaccttgtctctactaaaaatacaaaaattagctgggagtggtggtgcgtgcctgtagtcccagctactcaggaggctgaggcaggagaattgcgtgaacccaggggtccgcccaggtaggtcttgaaatcctgaccaacctctgcagttgcagtgagcagagatcacaccactgcacttcagcctgggcgacagagcaagactgtctcaaaaaagaaaaaaaaaagaagtgtagaatctcagccaggtgtgatggctcatgtctataatcccagcactttgggaggccgaggcaggaggatctcttgagtccaggatgttcaagacaagcctaggcaacatagggagaccttgtcgctaaaaaaaaaaaaaaaaaattgttttaaacttacaaatgtagaatctcaggccccaggttcagatctactgaatcgcaatctgcattttaagatctgcaggttacagggatgcacgtgaatatgtgaagtgctggtgtagacatcagtgatggtagggggatgcaggactttgaattagcggttaaatgatgttttgggtatttccagtggaatcagggtggcaaatgacaaagtgagaagaaagaagatgccttccaggccaggcatggtgcctcatgcctgtaatcctagcactttgggaggctaaggagggaggattgcttgagcccaggagttccagaccagcctgagcaacaaagcaagaccttgtctctacaaaaataaaaataaaaaagaaggtgccctctacatagaagctccccagccccctttatgcccaccagccttaccgatgcttttcatgaggctacagtaatagtcattctccttctcctgcacgaggaccaccatcaggggctccaggaagggactcgtcagcagcgtgttagaaatcagctttgaaatccgaaccatcacttcaccctcctcaggggcaatcatgtctttgcgaattccattggtcagatagtaatagtatctcttccataaacaaaccaccagcgagaaaatggtcatgattggatcatgggttcaactgtcctgcccatcagctgccaagggaccccattcatacagcattcgtctgcacccttcacttgccataaccatgcattctgggcctgtcgcttcacactcatggcaagaagatcactggcaaattttccccaggacttcagaggattcaaccaaagccagagagatgtcagtggggtataaggaaggatttgtcaaataccacccagataggaacagtggagtgagtacagagtccagggatggaggtggcatatctggtgacctttaagaagaggaataacaggccaggtgtggtggcttacacctgtaatctcagcattttgggaggcaaaggtgggagaattgcaaggtcaggggttcgagaccagcctggccaatatggtgaaaccccatctctactacaaaatacaaaaattagccgggcgtggtggcgcacacctgtagtcccatctgctcaggaggctgaggcaggaaaattgctggaacccaggaggtggaggttgcagtgagccaaggtcatgccactgcactccagcctgggtgaccaatcgagactctgtctcaaaaacaaacaaaaaaacattagattttcctgatccagagctagaatttaccccccggaagctttcactcactggtcctgattctgccttctaaggtagctcagacaaacagggttggatttctgtctaaaaaaaaaaaaaaaaaagtaaaggaatgacaagctcctaaaatggcctcgaatcacataccctcctgaacagcaatgatctcctacaaaacactttgatcccatggcttctagctgtcagtggggaaaaataaccccaaagtccaagatctattgttgttcttttttttttttttttgacacagaatttcacttttgtcgctcaggctggagtgcagtggcacaatctcagctcactgcaacctctgcctcccgggttcaagcaattctcctgcctcagcctcccaagtagctgggattacaggtgtgcaccaccacagccagctaatttttgtatttttagtggagacggggtttcaccatgttggccaggctggtctcaaactcctgacctcaggtgatccacccaccttggcctcccaaagtgctggaattataggcatgagccaccacacccagctgatagttcttcttacccaagcaagggcttttgagtttcaaaagcaacataaacacacaaatgaaacaaaaatggccagtggaacctagtgacttcaggaaattttgtatatttagggtttgcctctgagctgctggatggctgagtggctctgggaatgactaatgtcagatagaggagaagcacagagtgtgaggaaagggcttgaagtctgtttttaagtttcagatcagaagaggttgctggccaggcacggtggctcatgcctgtaatcccagcactttgggaggccaaggcgggtggatcacctgaagtcaggagtttgagaccagcctgaccaacatggtgaaaccctatctctactaaaaatacaaaaatcagccaggtggggtggtgcatacctgtaatcccagctactcaggaggctgagacagcagaattgcttgaacccaggaggtggagattgcagtggggcaagatcacgccacagcattcaaacctgggtgacagagcgagattctgtctcaaaaaaaaaaaagaaaagaaaaagaggttgctgctgccagcctctttgttactctcgcctctctccaacgttagtaaaagcagctgctaacaggggagtattgcaaagcttttctgattttaagaactgcctgggtgcagggtgggggtaaaaagtgcttgttaaaatgcagattcccaggcccctcctcaggcagttagggtgtttaccaaggaccccaggtgacccttatcttcaggcaagtttcagaaatgctgcacagctcttaagaacacagagactggctgggtgcggtggctcacgccataatcccagcactttaggaggctgaggtgggtggatcattcaaggtcaggagttcgagaccagcttgacctacatagtgaaaccccatctctactaaaatacaaaaattagctgggcatggtggcagttgcctgtaatcccagctacttgggaggctgaggcaggagaatcacttgaacccaggaggcagaggttgcagtgagccgagatcgtgccactgcactctagcctgggtaacagagcaagactccctctaataaaaaaaaaaaacaacacagagactttggtatcagccagaccggctttcagtcttagttttgtctcctaccctgtagccctaagcacattgcttaaacagtctatactccactttccgcaactggacaatagagataatcatagaacctgggtctcaagtggggtcaagtagctatagagggtttagcagggaattttgccaacagcacatagtcactgtgagtttttattaatcattttattatacaccctaaacccacaagacatttgctctaaagttttattgttcttttaagacgggttggaaactccaacatctatctagagccaggcaggtaatgttaataagtgaaagttgtctagacctaagaaaataataaggaatggtgggaactatgacaaactgaagagtgtatttctcatctaaaggaggtagctactgcttagcaccaaatattttagttttctcaagagaagttggaaaatgtagcttgagactttcctcatgcttttttttttttttttttttttttttttttgagatatggtcttgctctgttgcccaggctggagtgcagtggcatgatcatagctgggatgcctgaggtgtcagagaaggggaccaagggataggttgtcttgtcctagaaagggttgtgaatccctccccctaccctttttttgagacaaggtctcactctgctgcccagactggaatgtagtggcacaatcatagctcactgcagcctcagcttcccagggacaagtgatcctcccacctcagcctcccaagtagctgggaccacagatgcatggtaccatacccagctaatttttgtagagattgggtttctccatgttacccaggctggtcttgagatcctgggctcaagtgatcctccccattcctcctcctaaagtgctgggattacaggcatgagtcaccatgcccagccacctcattctttttttttttttttttttttgagatagagcctcgctctgttgcccatgccgaagtgcagtggctcaatcttggctcactgcaacctccacctcccaggttcaagtgattctcctgcctcagcctcccgagtagctgaaattacaggcgcctgccaccatgcctggctaattttgtttttgtatttttagtagagacggggtttcagcatgttgaccaggctggttttgaactcctgacctcaagtgatccacctgcctcggcctcccaaagtgctgggattacaggtgtgagccaccatgcccagccacctcattcttaaaacacatctacaggccaaattcagcctatgatagagatcccatataaaatatgggatgctttgggatatacttatactaaaaagttattcattacctaaaatttgaatttaactatgtgtcccattttttgtcttgcaaaatctggcacccccagcctatgggccactatttttgcaacttatattctaaaaggactcaaggtatcaatttccatcacttactagggcagagaacatgtacacacactctctctccttctctctcactcgcacaagcacacaaacatgcgccctcttcagtagcctgtcttgggtctagactttggtgtttttcaaacatttcccaggtgattctgctgttctccctgaatttagaatcactgagatgccgagagtaaccctcagcaaaccgagggaaagggggcaacaggaacgtacctccaggtccgattcagatggcttcttttctttactttccatttccatctcctgctgtaacatgacatcgagctgctgttctggactcattggtctgcttcctgggaacgtcaaagatgtctttacctccttcttcatgggtgagaagattgacgtcttgaaggccaacttgatcctgaaaagtagacacagctcagcccttggtgtttggttctccagagaggtgctgtggtgttgcctactttccctagcctgatgagtgtggttctgcaaatagaagcctctctcctctgtgtcatctaatggcatgtgtgtatacttccaagatgaccctaatgactgaacacctcataggtattttagcatggttttgttcagttggtttatttttgtctacaatctcaaaaagcctggccaacatggtgaaaccacgtctctactaaaaatacaaaaatcagccaggcctggtggcatgcacctgaaatcccagctactcaggaggctaaggaaggagagtcgcttgaacccgggaggcagatgttgcagcaagctgagatcatgccactgcactccagcccgggcaacagagcaagactccatctcaaaaaaaaaaattttttttttgattaaagtgattcgtggataagaatatgattatctgggaatgctttgaagccaagaagcagagtgtggctttagtgagaccacatccttctgttcagcccaccgtcctgccttctctggtgcccacagtgatatcttacctagtggaatcctctttgtttctggaggaaaacttcgtttttttcctcatgggctctgatgagcttctatttcctggaagaatggagaagaaagacatcagtgatgggcaatggccttgggccattctccgtccacaggggcatgactctcggaacagtccaggagcacactaaggggagcggacatggtacggtgtgacgtggcaggagatgtgggctcaggtctcatgtgcatcactgattacctgtgtgaccctgaagaactggcttcatcactccggacctcagcttcctcaactgtaaagtggggatgtgcgtatcttccattcgttcatacatttggcaagaattaataactgcttgtttcatgtactctccaatattgtatgctctattttctaaacacctgttatattactgtttaatatttctctttaagtagacctgggcatttaaacttagtacatttggccaggcacggtggctcatgcctgtaatcccagtactttgggaggctaaggcaggcagatcacctgaggtcaggagttcacgaccagcctggccaacatggcgaaaccccatctctactgaaaaatacaaaaattagccgggcattgcggcgagcgcctgtagacccagctacttgggaggctgaggcagggagaattgcttgaacccaggaggtggaggttgcagtgagccgagatcgtgccactgcactccatactgggcgacagagtgagactccgtctcaaaaataaataaataaaataaaaaataaaataggccggacacggtggctcatgcctgtaatcccagcactttgggaggccgagacaggcagatcacgaggtcaggagttggagaccagcctgaccaacatggtgaaatcccccatctctactaaaaatacaaaaattagccaggcatggtggcacacgcctgtaatcccagctactcaggaggctgaggcagaagaatcgcttgaaccctggggacggaggttgcagtgagccaagatagcaccattgcactccagcctgggcaatgagagcgaaactccgtctcaaaaaatatacatacatacatacatgcatacatacatacataaataaaataaacttagtacatttatttttaaaagaaattttatgattatcacaaataaaaaataagtacatatttattgcaagtagaaaaaccaatatcatttgcaataaatagaaggtagctacaattaattcaataagtgatataaaaactatattattcaactttaattagatattacttcctaaagtgtctatctttgaacttctcaaaatagtccacatataacaacaatacaaaaatcctttttttttttttttttgagacagggtctcactctgctgcctgtgctggagtgcagtggcatgatttcagctcactgcaacctcaaccacccaggctcaggtgatcctcccacctcagtctcctgagtagctaggagtacaggcgcatgccaccacacctggctaattttcctatcttttgtagagacggggttttgtcatgttacccaggctggtctccaactcctgggggcaagcaaccctctcaataaacacaacaatcaaggtacagattcacaaaatggaaataatacagcaataacaatattgctccaaaataaatttttaagatcctccaagtacaaatgtattttaatgaataataagcagaaatcatctcaagcaaggacatgaataacagacaccagtgccgctctgaagaaagcatcttagtactttatattcaaagactctggcttgcctgagaattttggggacaatgaaacctgggaagcaatagcactagttcttcacagatattaataattttggactaagaaaattattaaagactgctacagactgaaagctaatgtcttgtcaaaattagtatgttgaaccttaatccccagcatgatggtatttggaggtgggactcttgggaggtgactaggtcatgagggctccatcttatgaatgagattgtgcctttataaaaaaaacagcaaaaagatttctcaccccttctcccatgtgagcatgcagcaagaagatagagaagacagatgtctatgaatcaggaagaggaccttcatcatagactgaatctgttggtaccttgatctcggactttacagactccagaaccacaagatatgaatttctgtagtttataagccactcagtttatgattctttgttatagcagcccaaaaggaactaagatgatgaccatgaaattaccaattagagcagcaaacttaaggttctgtgtatcatgatcttgaacatttgggcattaattatttgctacatgtccttaaagcaggaacatgcaaaagcagcatcctagagactgtgggtgtgtatgtaatacacaaataacactggtaagaaccacttgggaaaaagaaatcctccaagtgatattgaaagggctatgacaataagaatggaatcaggagttggaaaagggaggtagaaaaccataagtaatcagaaaatttgaaatggaaagatagtcatttaaacaaaaaacactcattagacatgaaaaactcaagactgaacagagttgaagagaaaattagtaaattggaagatgtaattaagaaactcacccagacgtagcacagagaaaacaatgaaaaatataaaaatgagtttgagacagagagcagatcaagagtgccaacatacatccaacaaaaattactaaaggatatccttatgccaatatacctatgcttggtgggaattaaattaatacatacaaggtgctgtggtaagcagcttccaagacagcccccaatgatccccatctcctggtaacacccctttgtggtgtaatcctctccccttgagtatgggctagaactagtgactcctaacaaatagaatgtggcaaaagtgacaagatgtcacttccaagattaagttccaaaaaagcctatgggttctctcttgctggctctctctctttctctccccctccctcgctctaagggaagccagaagccatgttgtgagttgttctaagggagagacccgtgtggcaagaaactggtgtctatggccaacagccagcaaggacctgatgacatgagtgagcctggaagaggatccttccctagttgcctttagatgatggtggccttggtgtatgccttgattgtacgctagtgaggggccctgagccagcactacaaattcagccatgcccacgttcctgccccactgaaattgtaagataacaaatactggttcttttaagccacagaattttggaataacttatcatgcaaacaataacacaagtacatagaacagtgcctggtatatgtaaatggtctataaatgttagccgtttgcaatcatttcctccatagataaggaggagagtgaggctttgcaaagtctccaaagttagcttcagcaaaaggggagccaggatcagaatccaggagtaaaaatttcactccaggccaggcacagtggctcatgcctgtaatcccagcactttcggaggttgaggcaggtggatcacctgaggtcaggagtttgagaccagcctggccaacatagtgaaaccccatctctactaaaaatacaaaaaaaaatagccaggtgtggcctgtagtcccagctactcaggaggctgaggcaggagaatcacttgaatccgggaggcggaggttgcaatgagccacgatcgtgccatggcactccagcctgggcgacagagtgagactccatctaaaataaataaataaataaaaatttcctccaaagccccattctgcaagggtgtgacactgccacaagtacctgatgatggcagcccctgaccggtcctgtccctagggacactgatggtggccggttggtagaccttcagcagatctttcagcttcaggtcctgggccatcaaggagtagttgttggcgatggaatcactgggtccacggtggtgatgctgttctttgaagggtgcagccaaggtccatgacgtgcgttgcatcaagggcgggtaaaagctgtgtgacatgacagtctacgaggtaagaagtgcagagtgagacacaatgaggaacatctctcgatgagcctgagctctgctcacactgaggctcacaagagttccaagtgccttatgctatgtttctgccttctgcacattcagtggaaagattgtctgaacagacaccaactgtacttctctgaccattgtaagcatgaattctgatgtcagggataatagcttgcattcaccagtaattttgaggcaggtaattgacatctctggtctttattccttatggacatgactacaaggtacaagcaattaccctcattttacaatgaaacacgcagaagttcagagagtttaaataacacagcagatcagtggacggccagattctaattcacctttggacaatggcatagctctctctcccacacttctgcagcctcttctgggggcaaaagcgaccaaagctactaatcctacttgtcaggtctgtttgactctccaccctcattgagtacctgccaaatacggagagaagtgggggatgcacttcacctcctcaccctcaacagaagagctggcagccaggtgtgcatacctgatagagtccagacggttcctcattagcagaagcaggcagaggaggcagctctggctgcccctgggagtggctcatgtgatgtatggagtcacttttggcgatctgtgggacatgggaacaaagtcacccttcaaaaattagggaagatttgcaagcctctgagttggttaggactaaagaggtccccaggaaaagttttaggtccagagttctggacctaaaacaaaacactcctctcattcccatccattatgtatgtttcatttatttaaaaattaacagataagggctgggtgcggtagctcaccccggtaatcccaccagtttgagaggccagggagggtggatcacctgaggtcaggagttcgagaccagcctgaccaatatggtgaaaccctgtctctactaaaaatacaaaaattagccaggcatggtggcgtgtgcctgtagtctcagctacttgggaggctgagacaggagagttgcttgaacctgggacgcggaggttgcggtgagctgagattgcactctgagatgtattgaagtgtatatacattatagagtgactaaatctaattatcatatgcgttaccttgcatggttattatctttgcagtgagaacacatctactctcatagcgttgttcaagaatacaatatattgttaattagtcatcatgctgtacaacagatctcttgaacttattccatctaactgaaattttatatcctatgaccatctccccaacccttccactcctgtttcttttttctttctttctttttttttttgagatggagtcttgctctgtcacccaggctggagtgcagtggctctatctcagctcaatgcaacctctgcctccgggggtcaagtgattctcctccctcagcctcccaagtagctgggattacaggtgactgccaccatgcccagctaattttatatttttagtagagacggggtttcatcatgttggccaggctggtcttgaactcctggcctcaagtgatctgccctcctcggcctcccaaagttctgggattacaggcatgagccaccacgcccggcccctgcttcattttttaatcattcagtgtctcctcctcggattcccttctatgagcaaatttgaatatttttcccccgtggaagagcccaaattctgaggacatccccagtaccctaccctcaggtatgattaaaggaggtgactttaaaaacattgactcttgcatttttttttttttgagatagtctctcactctgtcacccaggctagagtgcaatggtacgatcttagctcactgcaactgctgcttcccaggttcaagcaatcctcctgcctcagcctcccaagaagctggatgggtgcccaccaccatgcctggctaattttcatatttttagtagagacggggtttcaccacattggtcaggctggtcttgaactcctgacctcaggtgatccacctgcttcgaccttccaaagtgctcggattacaggcataagccactccaccaggtggactcttgcattttcacatgtgcaaaattccaaagagaaattcactcaggcagtggcactgaattttctgtgtatttaacacacacataagcaactctttatgattcctgcgaaaagaaaaagtgttatttcaacaatgtgggtgttgagtactccattccaaccagtgagtgcatactgtggagtgagcctcaggtaagggtcaacttgtggctcccacaatcactctcagattccaagtgaccctccacctctcctgagcagagaagaaagtgactacattattgaatgaaatcacatgtgtttttgtcttaagacttagcccctatatgcaaaacaaccacttcacctgggactagtgatggagaaactgcaacttgttccaacactagaagaaaagctgttggcctggacttattgagaggtgctgccgttcagcactttaaaggtggtttgagggattttcaagggcaattttgactctctgtgattttcaccttaggcattgactttggacttaactcctatataagatgagccaacatcgtatcagtgtgatttatttgggtgtgcaaattatgacatgcaagatcactgatgagggtgggatggggcagggggcatatgactattagctgtccctctgcccccaaccccttaaagatgactcaaattaaccatcattatctctcccggagcacctacctcattaaataacaacagaaaaacaacaaccgcagcaatactatctaccattattccaaacgattatgtgccaggtactgtacaacctcatgagatttttttcatacccgcattctagctgaagaaaatgagggtgagaagataggtaacacatcctagccatgtaattggccggcttgacttctaagtcagtgacttatttattattattattattatttattttttttttttgagtccaagttttcgctctgtcgcccaggctggagtgcagtgacacaatcttggctcactacaactgcaacctccaccccctaggttcgagcgattctcctgcctcagcttccttactgcatcatgcaaactgacagggacgctgttctcgggataatgaagaaagcaaaccgtgagcattttgcagaacacaatggaaagagggagaacctctgtagaaacaaattaaactaggctatgtcataggcttggactaaaacaaatacacaaacagtcataagtacgctgatagcagaaagcatcccagtctgtcgatcaggaacacatggggcacacacaacatgagcagatctaggcatcaattgcagaatggggctaaaagagttttcctggcaataaatggctaagaatcctctgtggcaccttcaagagatcgagattctcataagaactagctggttgtgcaaaattgtttgttaaaaatatgaatgcttggccagccgtggtagctaatgtctataatcccagcactttgggaggccgaggcgggtggatcacttgaggccaggagttcgagaccagcctggccaacatggagaaatcccgtctctactaaaaatacaaaaattagccaggcggtggcgcacacctgtagttccagctactcaggagactgaggcaggagaatcgcttgaacccagaaagcagacgcttcagtgagtgaagatcacgccactgcactccagcctggataacagagacaaactgtctcaaaaaaaaaaaaagaaagaaagaaaaagaaagaaagaaattaatgcttaaatcttctctttggtaaatttcaaggagctttcacttcagagcatattggcttagttattatctacaaatccactttagttttacaaagtttctatttaaaatgctcctctgggcacttcgctgtatggcaacctggtgattcaacacagatacaacagaaattctggaacttagattgggtagaactgtcactttgggcagcttattgctgattacacatgttgtatgtatgttcttcatggaggccattcccaaatgctcgtctgaggacgtgctacaccagaatcactctggtcttagataaaaatatagattccagggccccactccaaatcttctggatcggaatctaggagtgggggaccaagactctatgtttttaagatgctccccagaatattctaatgttcagccacagtcaaaaactgatggttggaatatatggtctaatgggcttggaagggaaggaaagggaagaacgggtgtctattcccggatttttcacagcaaaacttgaagatttccaaaagtctaattcagcaaaaatgatatttcaaagcagacaacaaaaaaatgtgatgaatacacttgttcagtcaagggcatctaacatgccaattggccctcttcccacatattcccaacacattaaaaatacaggtaaatcggccagacacggtggctcacacctgtaatcccagcactttgggaggctgaggcaggcggatctcctgagatcgggagttcaagaccagcctgaccaacatggataaaccctgtctccactaaaaatacaaaattagccaggtgtggtggcacatgcctgtaatcccagctactcaggaggctgaggcaggagaatcacttgaacccaggaggcggaggttgcagtgagccgagatcacaccattgcactccagcctgggcaacaaagagcaaaactctgtctcaaaataaaaaataaaaaaaaaaaatacaggtaaaacaagaaacgtcttaaaattcacacctaccttctgagatgagcaatccatgtcacccatggtgtccactctaattgtagctatttttttaaaatgaataaagagctttcagcttctccagggatgtgcctctcctatccagttggtctgaaattcacacttccttatagcataatggggatgacaccaacaatggaactttccagatgttctgaaagctctgttcatgaggttgcctctctgaggtcatagactttggcccgctgaggagttccctggtaaaaaaggagagaaagggaagctagagataaggggacagcactgggtttctgctgcgcttttggctctggttcctagtcccccagcggtggccacgcttcctttcccttgagtgcttctctcttggaaattttccagaaacacactgagttcactgcagaggaaagactgaagcagagttacacattaatacagagaagagggagactcacccctccaaacaacatcctggcagcccgaactgttctccctcctcctccctggactcttaacactggcagtgcttgtatgcaggcgctgggcacagtaaccatgtctcagcgtctgttgctaagggaaggaggggcctctgcggtgcctacatacaagactgggcatgacctagctctgtgagctggtgtctccctttgctggaggcccaggtgggcagcaggaagtgttggtgacagaagggaacatgggaaggtgtttagcaatgttccaggaataacagaggcaacagcaataaaagacctttggagacgtcgaaaagcacagagtatggtggttaagttcttgggatctacaattggacaggtcatacttcagatcctactcttctcattaattagctgtgtggcttggcaagttgtttaatctctccaagtgtcctttccgtctgtaaaatggcaataatgtgagtccctacttcatagggttgctttgaagggttaacgggataacgtgtacagagcgatttgcatatagtagaaggataactgatattttcccagtttttccccgtttttttttttttttttgagacagagtcttgctctgttgcccaggctgcagtgcagtggcgtgatctcagctcactgcaagctctgcctcccgggttcacaccattctcctgcctcagcctcccaccagtgcgcccagctaattttttgtatttttagtagagacggggtttcaccgtgttagccaggatggtctcaatctcctgacctcgtgatccgcccacctcggcctcccaaagtgtgggattacaggtgtgagccactgcgcccagcccagtttttccccattttaacactaagtcctgcatcctgggagcaatctcagtcctgggcaaactgggatagtttgatcacccaacacagtcaatgctctataaatgttgtggctaacatcaatattacgataaacacagaaatacatgtgcacatactcaaaagtaacaatattagctgccgcccgaatattaaaagcacatgttccatggtcactgtgaagttctctcaaaaccaagttagacttaatgagttttttgggggtgccatgcttgcatatctttttttttcattcaatttccccccaaacaccacgatattcccattttaaggataaggaatcaaaactgagagatatgggccaggtatggtggttcatgcctgtaatcccagcactctgaaaggctgaggtggatggatcacttgaggtcaggagtttgagaccagcttggccaacatagtgaaaccccatctctactaaaaatacaaaattagccgggcatggtggtagtcgcctgtaatcccagctacttggggggctgaggcaggagaatcgcttgaacctgggagggaggttgcagtgagcacagatcatgccactgcaccccagcctgggcaacaagagcgaaactccatctcaaaaaaaaagaaaaacaaacaaaaaaactgagagatacataactttcctaagtcgacttgactcataagtagcactgatacaattggaacctgtcctgatgaccccgagtccactgctctttccataacctacctgtccagaacacaaacattcccgagttcctatgaaaagcattgcatagtgagaggtgacagcgtgctggcagtcctcacagccctcgctcgctctcggcgcctcctctgcctgggctcccactttggcggcacttgaggagcccttcagcccaccgctgcactgtgagagctcctttctgggctgggcaaggccgaagccggctccctcagcttgcaggcaggtgtggagggagaggcgcgagcgggaacccgggctgcgcacggcgcttgcgggccagctggagttccgggtgggcgtgggcttggcgggccccgcactgggagcagccagctggccctgccggccccgggcaatgaggggcttagcaccccggccagcggctgcggagggtgtactgggtcccccagcagtgctagcccaccggcgctgcgctccatttctcaccgggccttagctgccttcccgcggggcagggctcgggacttgcagcccgccatgcctgagcctcccaccccctccgtgggctcctgtgctgcccgagcctccccgacgagcgccaccccctgctccacggcgcccagtcccaccgaccacccaagggctgaggagtgcgggcccacggcgcgggactggcaggcagctccacctgcagccccggtgcaggagccactgggtgaagccagctgggctcctgagtctgatggggacgtggagaacctttatggctagctcagggattgtaaatacaccaatcagcaccctgagtctaactcagggtttgtgaatgcaccaatcgacactctgtatctagctgctctggtgggaccttggagaacctttatgtctagcttggggattgtaaatacaccaatcagcactctgtatctagctcaaggtttgtaaacacaccaatcagcaccctgtgtctagctcagggtctgtgaatgcaccaatccacactctgtatctagctattctggtggggccttggagaacctttgtgtggacactctgtgtctagctaatctggtggggacttggagaacctttgtgtctagctcagggattgtaaacgcaccaatcagcaccctgtcaaaacagaccactaggctctaccaatcagcaggatgtgggtggggccagataagagcataaaagcaggctgcccgggccagcagtggcaagccgcttgatccccttctacaacgtggaaggtttgttctttcactgtttgggttcatgccgccttaatagctgtaacactcacggtgaaggtctgcagcttcactcctgcgccagcgagaccagaaacccaccagaaggaagaaactccgaacacatccgagcatcagaaggaacaaactccagacgcgctaccttaagagctgtaacactcaccgcgagggcccacggcttcattcttgaagtcagtgagaccaagaacctacgaattccagacacaatagaaccaagtacttccattttccccctttttctactccttttcctcaaagttgggctttccatcctttcaaaataaccctgagcttttccatctcttatattatgctctttatcacaaagtatacatacggtttcaaatagcatttggaataattgagacagtgggagagctggagactctggtttagacggaaatgggaagattatcaggtctcctatactgggtgtgaaacctcatgtcccaccaaaaacagcaactgtaatccaatgaagtgaaaaattagaatggggccaggcgcggtggcccatgcctataatcccagcagctggggaggccaaggcgagtggatcgcctgaggtcaggggttcaagaccaacctggccaacatggtgaaaccccgtctctactaaaaatacaaaaaattagccgggcgtggtggcaggcaccagtaatcccagcttcttgggttgctgaggcaggagaattgcatgaacacaggaggtggaggttgcagtaagctgagatcacaccattgcactccagcctgtgtgacacagcgagactctgtctcaaaaaaaaaaaaattagaatggtcctgatgtggagctaatggaccctatggcctgtgtgtgagtaggaggtatgctaccatctgaaatttagtgtgttttaagtctactagtgtttaaaactatcaaaacaatactaatggctttcgcttattgagcatatactatgccctgggactgctgctaggcacttagtagacatcatgtctttgaatcttctcaacaacctagaatataaatatcagtattttcacaagttttatgattgaggaaactgatacattaaactaacctgcccatagtcacacagctaggtcatcaggaaagcttgaacttggttatgaaatctgttccatggcttcaaccgaaaacctacatgtaatctgaggaaaggtggaaaataaagtatctgccaaagagagtgaaagtgacttcccccaggccacctcacctgtaccagaattgtttgttgtctgacaactttgtgttggataattcttaagaaaggatataggcttcaagtttctcaatcttctttttctttctttcttttttttttttttttgagatggaatcttgctctgttgcccaggctggagtgcagtggtatgatctcggctcactgtaacctccacctcctgggttcaagtgattctcttgcctcagcctccccagtaactgggattacaggcgtgtgctaacacacctggcttatttttgtatttttagtagagatggggttttgccatgttggccagcctggtctcgaacccctgacctcaagtgatctgcccacctccgcctcccaaagtgctgggattcaggcatgagccaccatgcccggccttgtttctcaattgggctgccagacaaaacagaaggtgcccagttaaattagagtttcagtcaaacaatttttcaggtaaaagaatgttttagggccgggagcagtggctcatgcctgtaatcccaacactttggaaggccgaggcaggcggatcacaaagtcaggagtttgagaccagcctgaccaacatggtgaaaccctgtctctactaaaaatacaaaaattagctgggcgtggcggcacatgcctgtaatcccagctactccggaggctttggcaggagaatcatttgaacccaggaggtggaggttgcagtaagccgagatagcgccactgcactccagcctgggagacagagcaagactccgtctcaaaaaaaaaaaaaaaaaaaaaaagttttagtataagcatgtcccattcaatacatgggctgtacttgtacttgtactaaaaagttacccattatttacctgaaattcagatttaattgagtgtcgtgtgtttttatttgccaaatctgccaacatggggagcagaggtcagcaaggttccaagttgcccctgcctcttgttatcaagagtttagggtcttaatctgttgctaaaaaaatttcacacatttcttattcagaggctggtattcctggcagctcattcctgaggcctaaaatagttgtttaagcagagcaacagtttcaatccttggaggctactatagcaaagtaccaaagtctgggtggcttataaacaagagacatttatttctcactgctctgaaggctggaagttcacaatcagggtgccagggtggtctggttccagtgaaggcccccttccatgttgcaggctgccaacttctcattgtatcctcacatggtggaaagagggtaagagagctctctgggagttattcttattttattttattttattttattttattttattttatttattttattttattttattttattattttattttattttattttaatgagccagggtctcactttgttgcccaggctagagtgcagtggtgcaatctcagctcactgcagcctccactgcctgggctcaagagatcctcctgcctcagcctcccatgtagctgggactacaggcatgtgccactatgcccggctaacttttgtatttttagtagagaagaggtttcgccatgttgcccaggctggtctcgaactcctagactcaagcaatccacccaccttggcctcccaaagtggtgggattataggtgtgagccactgggatctcttttataagggcactaatcccatttaggagggcttcaccttcatgacctaatcacctcccaaaaaccccatgcctaatcccatcacattgggggttaggattttagaggaacagacattcagtccattgcagcaagtaattgggaaagcataggagaggctgcgcgtggatttttttaacccaaccactgcatgttccttgagggccaagtcctgatgctatggagagatgctaggatcccagccctggaggaacacatgatgtgatggaggaagcatctatcacacaaagacaagcaaaactctgctggcccagccaaaaatgccagaggtggaaggaatttgaagattcacagagacgcccctagatggcactcttaaacaaaaatcccagtggaaaccctaactcagctttccaaagcaacttccatttagggaatgatgattggaaggctgtaatctaaggaaacacacacacacacacacacacacacacaatcttttcctgggtggggaacccagcattttgcagctgaacaaagtgcatgacgccagacaagattggctaaaacttaagaatttagggattcttgtctgtcctatccccaccattagctcttctttctgctattgtggaattacagcaggattctgtggtttatcatatcattgtcgtgatcatcatcataaatcatcatcccaagcaaatatttttgagcccctactctgtgcctcaataggtgctaagttctcgacagccacagccacactattgcaccagtcctcactacaaccctgtgattgcttctttttttttttttttttttttgagacagggtctcactctgttgcccaggctggagtgcagtgtcttcactgcaacttctacttcccaggttcaagcgatacttctgcctcagcctcccgagtagctgggattacaggtgcgcaccaccatgcctggctagtttttatatttttagtagagatggggtttcaccatgttggccaggctggtctggaactcctggcctcaagtgatctgcccacctcagcctcccaaagtgctgggattataggtgtgagccaccgcaccctgccagctttttgttatctaaagacttattttccaggttgctatggccacaggcaaagaggagaggtcggtcaacacaggtccctgtctggaaagtggctgagaactgtgcaacagcagaccaatggttgggcttatccctctctctaatttatggttgaagccatggttcagagaggttacttagtcacacagtaagttgccatcatgctctatagcagtggttctcacctcgggacgatggggccttccaggggacatttggcaatattttgagacacaactggaggtgggggggggcggttcttgtaactggcatctaatgggtagaggctaggatattgctaaacattctacaatccacagctcagaaacagaattattccgccccaaatgtcaatagcatactattcagaaaccttactctatagggcagatttggggccaggggaaacaggggctcctgctccgacttggatccatgcaaaccgaggaatttggattgatttatcttgtctctctcagcctggactttttcatgtgtaaaatggacatccaatccatctgaaaggatctcactggcttatgacattcgcatttgagcagtcatggttaaaaacttccagccagggtgatacttcatcacgtgtgtgtcttgagcgccagagacgttccagagcagctggttttaggcatacaggaggggaaaccctgacacccttggaaaactcattctcggctgccagtctgcctgtcttgaaggtggtctgagctttctcactccaagccagtcgtgtgggaagggacactctctgagcctcagtttcctcagctgtcaacctctcagggcttgttctagtggctccgaaagccagtgggagcgagcgcgctttgcaaagccttgggcgccgggccttggcgcgcctttgccggatccttccggccacgggcggggcgagcccagaggagaagagccgaggggcggtgcccgggccagggggcggaggcaggcggctctggctccctctcgggacgctctttccttcttcctcttgttcctcctcctgcctctcttcgcttcgcctgcaaacgcggtgggggctgctcggcggtcaggagcaggtgagagctcggagcttgggggtgggggtccgggtgccccgggtggctagacccctctcgccgggcggggacagaggaggagcgcgggggcgacggcgtgagcgcgctatcggggtcccacgcccgtagctttctgccccggggttagtgtaaggggcgtctcctgcttatgagtcgccgggacggggctgggagcgcacgaggagacacgattcctccccacccctaaatgcacactcaccccgccaccccccaacacacacacacatacacacacacactaccactagattaggtaaaatggtagctagcaccaccacaccccgagactgtgcccctttctggggaacctggggaagacgtcgaggcaaacctccctaggattattgaaaacgggcgccttcctcaccacccagcccctcttctccaccgaggtccccttccccatcgctgcagagagatctgcaagtatcaaagggggcttctttacccccaaattaataactaagtactcgactcccctctgagttcccattattcagtctctgtgccttctgggacgcggaccccctctccacctgcatttcactcccttcctcctctccttgggtctccctggcttttgaacgctgaaaggctgggcccggatggggaggggcggccagtgtgagctcgaggcgccctgtagctcccat

SEQ ID NO: 1702 - DNA, 1085 bp, Homo sapiens
acctcagtttgaatgcatgggagagcccagagtggtgacggagacagggggaaaggcttccccctcagggaaagggaccgaggagtacagtgcagtgaagtgagggctcccatagcctggggtaccaaaatggggccctggggccagaggaaaggacactggtccccctgagaaaggagacccaacagcctcaaaatcctctcgttgtgcatagccactgcttgatcgcttgcccttctggcgccggttacagaaccacactcggaccacatccttctccagcccaagctgctgggcgatgtggctgatctgctgcagtgtgggtttcgggcaccgcaggaacaaattctccaggttgcctctcacttggttctcgatactggttcgctttctctttcgggcctgcacgagggtttctgctttgcatatctcctgaagattttcattgttgtcagcttcctccacccacttctgcagcaagggccgcagctcacacatgttcttgaagctaagctgcagagcctcaaagcggcagatggtcgtttggctgaacaccttcccaaatagaacccccagggtgagccacatcggcctgtgtatatcccagggtgatcctcttctgcttcaggagcttggcaaattgctcgagttctttctgcagagctttgatgtcctgggactcctccgggttttgctccagcttctccttctccagcttcacggcaccagaggggacggtgcagggctccggggaggccccatcggagttgctctccaccccgactcctgcttcgccctcaggctgagaggtctccaagccgtcttggggcactagccccactccagtctgaggcccacagtacgccatccccccgcagaactcatacggcgggggacatgggggaatcccccactcctcagagcctggcccaaaccccggcccgattcctggccctccaggagggccttggaagcttagccaggtccgaggatcaacccagcccggctccggcccccctggcccatcacctccaccgcctggagggggtgagaaggcgaaatccgaagccaggtgtcccgccatg

SEQ ID NO: 1703 - DNA, 14977 bp, Homo sapiens
gctgtgattctcactatactggtcctgaggaaagggcttctgtgaactgcggtttttagtttttattgtggttcttagttctcatgagacccctcttgaggatatgtgcctatctggtgcctctgctctccactagttgagtgaaaggaaggaggtaatttaccaccatgtttggttcctgtttataagatgttttaagaaagatctgaaacagattttctgaagaaagcagaagctctcttcccattatgacttcggaaatcacttatgctgaagtgaggttcaaaaatgaattcaagtcctcaggcatcaacacagcctcttctgcaggtaaagatcattttctaggggtcagagtgaatgacgaggtgaaggatgaggagagggtttatgaataaggcataggtgttttcagttgctggttgtctgattgagtatgtctgggaaacacaagagtcccagaagattgagtggcctgcagatacgcattacggggtgtacatttgtattgtggagaagaaaagattttgtgccactctcttcagcctccactctgcttactgaaacagaggtgagagaaatccactccagttctgagctaaggcgagtgctctgatgcccctgtgttttctgaggctgagtggggctggggttaagagattgagtacagcttctgaaaccatcaatccagatgcagggggtcctgatgaatttgtgagatttgttttttgatcagttagagggaaagagtttgggtggacagtggtgagggtatatttgttggtaatggatggaaatgtaacaaaaggcctttgcaaatgaaagactagaaagtctacaaagaaagtctcttaaatctccaggaaactttttctgaaatcagagaacctattgcgtgttgcatctctgagacagactctgttacgtttgggagtagatgcaaggtgatttgggtgtcatgtgtgatatctcaagtatagagcaaaagagagaaaagaatgtatatagagtacaagaaactatgggggaaggggtcaggactatagttacgctttctaaaatacctctgtgaaggtgtggagagcacttagggaaattttttctccttaaaaactttatataatttctttattacacaagtattaatgttcattgtagaaaaaattaaccagaggtacacagatatttgaattataattactcttatcatctagagaaaatcataatttgcaatttagtgaatatccttccacatacaaatacatataatgtgcatatgtattttactaaaaatgtaatcatattatataatactgaatttttttcccccatcatttgacaaaatatcataactcgaagaaagtgattcctaaccatgagatggtaactaaaaagactgactttattctaaacatgtgatgaggaatgattataaagatttatttgctatagcattatttaaagttggaaaccattatttaaatatatgatgaaatactatgcaaccataataaggagtgttaaagaagaaaatataatggtatgaaaaatgttcatgatatagtgtaaaggaaaataataggtcagaaatcagtatttatggtatgtcaatcgtgggaaaatttgcatatgtgtatatatacattcaaaaaattgctagaaagatatataccaaaatattatggtatattataagttatatggcataacagttatcctcaattgtaggaattcgtacttttatgtattttttaaagtttctacagtgaatattattatatcctttctattcctattctcatgtgatttcaaatgtcataccgttagtaactgtgtgtcatccaagaaaagagagagaaagaggaggaggaagaagaggaagtaaagaccaaacttattactgataaaactaatttggcttcttcttcagcttccaaggagaggactgcccctcacaaaagtaataccggattccccaagctgctttgtgcctcactgttgatatttttcctgctattggcaatctcattctttattgcttttgtcagtaagtatgccaactgaaccaataagcaatatctgctgtccatgaacagagggtatcctttaaaaactgacttttgaaaatgagcttatccagaaatctgaaatgaaattttctctggggagacataattcatgggaatccactgtgaattttgctctttatttggatttagttactgtcctgtaaaaataatggaatcccttctcatttagagaaactgaagcataaatgtgggtgtatgtatttgtgttgtagagtgaaatctatggggcatcatctctatactagacactatgtaagtgaggacaaatctatgtttccttggtagcatttatcaggccagtctgatttgaatgcacagacatttatgttttgggatgagcaggtagacaacaaggagatgggaagaaatatttcaggaagagttctccactggcttttactctgattattcctgccctgctcaagactgtgtgggatctaaaagtcaattttgcaaattaggtggattgctgcgtatctttggctttcagcatttgttgagttttattccccctggttctgtcacccaggctggagtgcattggtgcaatcttggctcactgcaacctccacctcccaggttcaagcgattctcccaccccagcctcccaagtagctgggattacaggtgtgcatcactatgctcagctaattttttttttttttttttttgtatttttagtagagacagggttttctcatgtttcctggccttgtcctgaactcctgggctcaagcagtctgcctacctcagcctcctaacgtgctgggattacaggcatgagtcactacgcctggctcaaaatttttaaaaggcataaaaagcagtatacatttaggtagattctttattaatttctttggtcatttcataagtattgtccatctactgtatgtcaggcactgtgccagacagagagtcaagacagagccacagcccctggtctcaagaaatttagagaatgataaaatgaaccagtggttataacattgtatggtaagtgttgtacagttaagaagtataataagtgcaagaggctgaggtaggctttccggaggaggtgacatctagagctgtgtgtaccaagaatgacctagagatatgagagagcatggaatttggggaaacgtaagtatgcatgactggaacatatggtgctaagtaaagaactaagaaatgaagttgtaggtggcagaaagaaacaggactcagatcatgaagactgctgtatatcatgataaagagtttggattttttccctcctaaaggttattttatcaattatcttttgctggttaataagccaatctaaaacttagtggattaaaacagcaactatttatttagctcataaatctgtgtcttggcaattgagactggtgtcagttgggagatttccccagtcctggctgaactcactcatgtatatgtggttgggtactggccacaggcaacttagcttctgaggaacaggatgttagatggaatggcaggagagatttggccacgtttctcttatcattcatcagggtagcctgggtttgttcacatggcaactggcaggcttttaagactgagagcggaagtaagcaaggccttttgaaatctcaccttggaactagcgcagagttgctcctgcacattctattggccaaaagaagtcttacaggcagcccagatccaggcggtggagaaatagaccacatttcttgattgaagaagctgcaaaatcacattgcaaagcagtgtagatacagggtatgttgaaagttgtggccatttttgcaatgtcacagtcatagagaaaattgaagaattttaagcagggaattgatataattggattggacttatagaaacatgatttttacagaggtgtggaaaatggataaatgaggacaaatttggagggaaagagaggttagaaggataattcattaattcaattgagaaatattgtcagactgatctatggctagtgttagcgaaaaaagagaagatgaagtaattttgaatgataaaggaggtagaggcttgatgaatattcagttctgggaaataagggacccagagaagtaaagtatggctccaatattctgactttgtaaactcagaaatcattaagtttttcaaagaggtagacaatataggatcagtagcaggtttgggttggaagatggtgatttaagttttgggcatgttgagttttatatggctgtgagaacctcaaatggatgtgtctactgggagacacatttgtctggatttagggagagaggtctgagctttggaagtccttcacatagaggtagcaggtgatgccgtgggaatatatgatatcactcacggagataacttagtatgagaaagacggataaggatggaactctgggaaatgttacattttaaaagaggtggatggaggaaacggagctcatcaaagagtgtaagaagcagcagcaagaaaggtaagacaaaaacaacaaagagtagtgtcccaagagctaaggggaaaggcaactggggtcaagcctttaaggaagtcaaataggaagaggactaagtaaccctaggatattactgaggatccactttagggatggttttagtgaaatagtggaagtaaaacccagactatgatgggtcaaggagcaaatgaaaggtagggaggaaagacaaaaagttcaatttcttttttttttttttttgagatggagtcttgctccgtcacccaggctggagtgcagtggcgcaatctcagctcaccgcaacctccgcctcccaggttcaagcaattctccttcctcagcttcccgagtagctgggattacaggcacctgccgctgcgcccagctgatttttgtactttgagtagagacgaggtttcaccatcttggccaggctagtctcgaactcctgacctgcctcgacctcccaaagtgctgggattacaggcgtgagccaatgtgcccggccaaaagttcagtttctagagggagaggtgggttagttttaaactgggagaaacatgagagcgttggtgtgctgaggagtaagagccagttgggatggagagagtaatggagagaagaggaagaaaataatgccctcttgatccatgtggggttctttttaaaattctccattcttcaaggtaacccagaactcctcagaattaatttgcccctctcccatctgctccaaagtcccagggtgcgcacatccttaaatacaagtgtttattgccctgcatccccccacccccaagagttagcctttgcatgcatcttatattaagtattgaaggagaatgtggagtccctttagatccattatgatggaactgttgtgtcctcttccaactactgatctttcagctattcctagagatatctatagtttcagtatgggaaatcttttccctctactccagtaatagggcatttgtaagttttatttcaataaagaatgcaagaaagtaacgataaagagcaaagtcataatgctaccaggaaaataaatggtctttattctcttttccagttttctttcaaaaatattctcagcttcttgaaaaaaagactacaaaagagctggttcatacaacattggagtgtgtgaaaaaaaatatgcccgtggaaggtaaaaattaatgtgcctagaattcagttgctgaatgtactatgtaaggatcccaaatcaatatttccagtaagattcccaggtagatcatactgaaaagttgagtctcacaataatttaagctacaaatgtacaaatatctaggacatgctgggcatggtggctcacacctgtaatcccagcactttgggaggctgaggcgtgtggatcacaaggtcaacagatcgagaccatcctagccaaaatggtgaaaccccgtctccactaaaagcacaaaaattagctaggcatggtggtacacacctgtaatcccagctactcgggaggctgaggcaggagagtcgcttgaacccgggaggcagaggttgcagtgagccgaggttgtgccactgcactccacctggcgacggagcaagattccgcctcaaaaaaacccaaaagacaaaaaaacaaatatataggacataaaattcttttgttgttgtttttttgagacagggtctcactttgttgcccaggctagagtgcagtagtgcgaacatggctcactacagcctcgacctcccgggctcaagtgatcctcccatttctgcctcctgagtagctgagactacaagcacacgccactacactcagctaatttttgtattttttgtagagatggagtttcaccatgttgcccaggctgatcttgaactcctaagcttaagtgatgtggctgtctcagcttcttgaagggctgggattataggcgtgagccacggtgcctggtcctaaaattcgtatatgtactcatatatctttaatttgtctatggaaaaaaatagaagcttaattgtgaaaaaggttacattgcttttagacttcttcgacctttgcttctttcggaactttctatacacatttgctctttttttcacatatcagttaaaaccatgtgatgaaaatgtgatgatgatttttttatggatgtgaattatttaaattatttaaattaatagattattgttattattattattatttttgagataggatctcactctgttttccaggctggaattcagtagtgtgaccacagctcacagtagccttgatctcctgggttccaagtaatcctccacctcagcctcccagtagctgggatcaaaggtgcccactaccacacttggccaattttatttttattttttgaatttttgtagagagaaggtcttgccatgttgccaggctgttcttgaattcctggcttcaagcaatcctcccacctcagcctccccgtgctgggattacaggagtgagctaccatgcccggccaataggttatttttaagaacagttttatatttacagaaaaattgagcagataatgcaaagagatctcatttttcccttgctctgcacacatgctctcccctattgttaacatcttacatgaatatagtatacttcttacaactaatcaactaatattggtatattattaattaaaattcacaattttcaggtttccttagtgttcacctcattttcttttctgtaataggatccccatccagaacaccacgttacattgaattctcatgtctctttaggcacgtcttggctgtggtagtttctcagattttcctcatatttgatgaccctgacagttttgagcaatactggtcaggtatattatagaatgtccatctatcagaatttgtctgatgtttttctaataattagactgggattattggtttttgggaggaagatcacagatgtaaaatgctattttcattacatcatatcaagggcatatattatcaaaatgattcttgactattgatgttgaccttgatcacttggttaaggtagtgtttgtcaagtttctccactgtgaagttactctttccctccccacccctttccatactacactctttggaaggttcagtccacacttaaggactggggagttatgctctccattcatgagggtggattatggtatcagtcatggtcagcaggctggagactcaggaaggagtaagagttgcagtttgagtccaaagaccatctgctgcagaaccttgaagagccagtgctgcagatgaagtgcaaaggcagtccactgagtttcctcttgctcagaggaggtccctctttttgttccattcagatcttcaattgattagatgaaatctacttacattattgagggcaatctgctttactcaaagtccagcaatttaaatgtaaatctcatccaaaagcattttcacagaaacatccagaatgtttggccaaatatctgggcactgtggcctagataagttgacacataaaattaaccatcacaagtatctatataatttatttgaaattttgtccaggtgatatttgtctcttttattccatttatttatttatataatcatttagttatatctgcatgtactcatggagatatatatatctatatatatatatatctcttcaacttttaagttctggggtacatgtgcaggatgtgcaggtttgtttcatgggtaaatgtgtgctatggtggtttgctacatagaccaacccatcacccaggtattaagcccagcatccattagctgttcttcctgatgctctccctccccggcttgctccctccaccacaggccccagtgtgtgttgttccccactgtgtgtccaactcatggatatttattttaaattttggtttataatccaatactgctctattttgtagttccagctttggacattgggaactttttcatttgactcctgtgaccctttaacatatcaccacgtgttttttcttttgttttggtttagcacttcctcactttctgggactgcaaaatgcttgagactcacattgtacatttcatgtccctatcctggaatcagatatttctttgaggagccctagttcctttgattggagaatagtgtcctatgaaatttgataatttgtattgtcattttcattcagttcaatgtatttttaaaaatttccctttagacatctcctttgactcgtggattatttaaaagtgtgttgtttagtttcaagcgtatggagattttcctgtgttatttcttttattaatttctggtttcttttcactgtggttggagaaaacgatatgatttcagcaattttaaattagtcgatgttatttaatgtcccgagatatggtttgtttcagcatatgttccagaggcactggaaaagaatgggtattctgttgttgggtggagcgttctataaatgtggattggatccttgtaattgatgatgtttataagttctatgttcttgctgattttctgtgtagttctgtcaatggttgagagagaggtgttgatgtatccacctataattgtatatttgtcaattcctctttcaattgtatcagttttgctttatacattttgcagctttgtttggtgtatacacatttggggtcactttacaaggctctgtttatttttttttctgtctagtttttttgtttctttgtgggtttttttgtttgtttttgttttttttttgtttttgtttttcagacgaagtctcgctctgttgcccaggctggagtgcagtggtgcgatctcagctcactgcaacctctgcctcctgggttcaagcgattctcttgcctcagcctcctgagtagctgggattacaggtgtgcgccaccatgccctgctaatttttgtatttttagtagatatggggtttcaccatgttggtcaggctggtctcaaacttctcatctcaggtgatccatccacctcggcctcccaaagtgcagggattacaggtgtgagccaccacgcccagcctttttttggtatttttagtagagacagggtttcgccatgttggccaggctggtctagaactcccgaccacaggtgatccgcccgcctcagcctcctaaagtgctgggtttacaggcgtgagccactgtgcccagccttttctgtctagtttgtttctgttgctcagttgacattttctgttgttttgtcttccaattcactaatctctctatccccttcattctgctgagtccatccactgagctttttattttggttattatattattcaattataaaatttccattttttttttttttgtctatctactgtgttgaggcttctttatttaagaaaaaagtgatacatgatgtgggattaaaatcaagaacatcattgaacttcaccttccctccaaccagttgccccaaactcccctgcccccaccctttgtgttcccaattccttccttagtgaatgaagaacttaatcccaaaagccctggcacaaactccaggtgctctttccctagctcctcccctccccctgtcccccattcctagaagggcaggcacctcagtttgaatgcatgggagagcccagagtggtgacggagacagggggaaaggcttccccctcagggaaagggaccgaggagtacagtgcagtgaagtgagggctcccatagcctggggtaccaaaatggggccctggggccagaggaaaggacactggtccccctgagaaaggagacccaacagcctcaaaatcctctcgttgtgcatagccactgcttgatcgcttgcccttctggcgccggttacagaaccacactcggaccacatccttctccagcccaagctgctgggcgatgtggctgatctgctgcagtgtgggtttcgggcaccgcaggaacaaattctccaggttgcctctcacttggttctcgatactggttcgctttctctttcgggcctgcacgagggtttctgctttgcatatctcctgaagattttcattgttgtcagcttcctccacccacttctgcagcaagggccgcagctcacacatgttcttgaagctaagctgcagagcctcaaagcggcagatggtcgtttggctgaacaccttcccaaatagaacccccagggtgagccacatcggcctgtgtatatcccagggtgatcctcttctgcttcaggagcttggcaaattgctcgagttctttctgcagagctttgatgtcctgggactcctccgggttttgctccagcttctccttctccagcttcacggcaccagaggggacggtgcagggctccggggaggccccatcggagttgctctccaccccgactcctgcttcgccctcaggctgagaggtctccaagccgtcttggggcactagccccactccagtctgaggcccacagtacgccatccccccgcagaactcatacggcgggggacatgggggaatcccccactcctcagagcctggcccaaaccccggcccgattcctggccctccaggagggccttggaagcttagccaggtccgaggatcaacccagcccggctccggcccccctggcccatcacctccaccgcctggagggggtgagaaggcgaaatccgaagccaggtgtcccgccatggggaaggaaggcgccccaagcatggtgaaatcttggtttttctttatatcttctagttctttgctgaaactttctagtttttcatttgtttcaagcatgtctgtatcttcttgttgaagcgtttttgttttttgtttttttttaatcatggctgcttttaaatctttgtcagataattctaacaattttattatcttttttttttttttttttttttgagacaggttctcgctgtgttgcccaggctggtcttgaacttctgggatcaagcgattcttctgcctcagcctcccaaagtgctgggattacagatgtgagccaccgtgcccggccccatttttgttgtcttgattgtaggcatctattgattattatattttattaaatttgaaaacttactggttcttagcataatgacttattttctattgaactctggatatttttgcattatattctcagagtctggatcttatttaaacatgttttcgtaatagctgggcttttcagatggcacttcagcaggagaaaaggggccctgcctcattactgcctgattgaggtagacttggcttccttgacacctgaggggcaggggctcctggttgcatctgagtgtggaggggagttccagcttccatgtgctctctcttggctcttaattttaataatacacacacttttaagagtgattatttatattgcacgtatgtgcccctcttcccaatacagagacagcctggagctgttgcccaaagaattggaagtcatttagttccaactgctactttatttctactgaatcagcatcttggcaagacagtgagaaggactgtgctagaatggaggctcacctgctggtgataaacactcaagaagagcaggtactttctaatagataatggggctgtgagccctgcctgatctttgtatatctctcttggctaagaaggaggtttttgttactttgggatatttgcgctgtggcagaaggctttcaataaaataggtagaaagggctcctaagcctttatattccatacctccttcctgcttcagtaaaactaacctccccggaagaaattgtgacattaaaaatatatgagggttgaatggaaggatgaaaatgtttcagtctgaaatatcaatttgttatttcaatatgtaaatgttttatacatgattaactacttaacaaagaagaggtattaagttgaatagagaaaagaaataaagttaactcatgatgaatcacaatcaacactcaggaatgaaaataaagaatccctgaagttatgaaaggaaaatgactgaatctgccaaaattttctcatgtacaactttgaagaatgtaatcccttagtgaagaaaagaggggaagtaaacctgagatgagaattcattctgatcatagaaattgcttccatactggctgggcatgctagctcatgcctgtaatcccagcactttgggaggccaaggcgggcggatcacttgaggccgggagttcaagaccagcttggccaaaatggtgaaacccagcctctactaaaaatacaaaaattagccaggcatggtggcacacacctgtagtcccagctactggggaggctgaggcatgagaatcgcttaagcctgggaggcagaggtgcagtgagccaagattgcaccactgcactccagcctgggacagaaagtgagactccatctcaaaaaaaaaaaaaaaaaaaaattccttccgtatgtactgaacatcatgcttacaagcgatgtctttgattctgccctgctcagccagagatccccattcctacgtagagctctaatgcagctgttgctggatcctctccttttcttcttgtttctctaaggtattaagaattcagtttaagctgaatactgtaaaggctgtgactccttcttttcccccctcaggatttcatcttccagaatctgcaagaagaatctgcttattttgtggggctctcagatccagaaggtcagcgacattggcaatgggttgatcagacaccatacaatgaaagttccacgtgagtatagaatgagataaaagaatcttgggtcctggatcatgcagagagcttagggtattctagctatcagctataaaagtaaaatagctcactcttcttttagctcttgggtactaggttaaataatttcattatctcatttaatctgcgcaagaaccctatgaggcacacattgttatttttcccactgtagatatgaggaaattgagcttggagagtgtagataattcagctaaggtcacccagtggtgtcaacaattgttctcaaatcaggtggatcttactgtgcttttaacccgtatatttacctgtctctacatagtgaaaacccatgttgattaagatcataaccaattattaagatttaataatgctttttttttcttttttgagacagggtcttactctgtcaaccaggctggagtgcagtggtgcaatcatggctcactgcagccttgaattcctgggctcaactgatcctcccacccaagtcttctgagttgctaggatgacaagtatgtgccaccacacccagtcaggctgaagatgtaatgcttcttatgaagcaaaaatgctaaattctgataatcttatatctcatatttatgtaattctttaattgcataaattacatactttacatatattacataaattacataaaatacatactttactggattaccaccttcgatcttcatatccactgtatgaaataaatagtgatattactctagtccttattttttagatagaaaaactgagaatcagggaagttaaattacttgtccaataacaaggataagtagaagattcaaaagattttactagttctctagactttaaaaacagtgcattaaaaaaaggaaaaaactctattgataagtgggaccagggtaaaatcttttcatcatacaaggacaccctataggttgatggacccataggaacaggacataaggatggacaaatagaagagaacctctagaaaatctatggtgaggatattcaaagcagtaaggtagagaacattgagtgacataggcacagttttcaaaggaaatgccggaaatgcagatggaggagaagctgcatgatgagtagcagaaaggtggatttgggcatatctgaccctatgttccatgaaattcatccctcgctcctcacccctgtctctaacccttttcaaagctctgtttgaagaaatgccctcatcctttttgtcgctttcagattctggcatccacgtgagcccagtgatcccaatgagcgctgcgttgtgctaaattttcgtaaatcacccaaaagatggggctggaatgatgttaattgtcttggtcctcaaaggtcagtttgtgagatgatgaagatccacttatgaactgaacattctccatgaacaggtggttggattggtatctgtcattgtagggatagataataagctcttcttattcatgtgtaagggaggtccatagaatttaggtggtctgtcaactattctacttatgagagaattggtctgtacattgactgattcactttttcataaagtgagcatttattgagcattttttcatgtgccagagcctgtactggaggcccccattgtgcacacatggagagaacatgagtctctcttaatttttatctggttgctaaagaattatttaccaataaaattatatgatgtggtgtctc

SEQ ID NO: 1704 - DNA, 14977 bp, Homo sapiens; identical to SEQ ID NO: 1703

SEQ ID NO: 1705 - DNA, 14977 bp, Homo sapiens; identical to SEQ ID NO: 1703

SEQ ID NO: 1706 - DNA, 14977 bp, Homo sapiens; identical to SEQ ID NO: 1703

SEQ ID NO: 1707 - DNA, 44102 bp, Homo sapiens
atatgatagaatattgtatttattaatgtggagctctttgtaccaaatataagtttaaaaatcaggttatcaaagagtatgtatgatacaacgcttttttaataaaataaaatacatttacatacatagtcactatgccacaagatgttaagaatagttttctctagatagtggccttacaggcaatttttatttggggtgtgtgtgttttactcaataaatatttattacttttgtattcagaaaaaacattaagagaatcataggaaagtttaactaaaaaagaaaatctttaaaatatcattaaattatttaacatatccttcaagtgagattgtttccttttgctaagctatattttgtaatctccacaacaaacatgaaatagtaaagttgacataaaaaaacttgcacagtaataggaagcagtgtttacattttgccaccccttacattttgaagagggaactcatattcttaaccaagactgtttcttatcattattcaaaggtacctacttttcctaaatattgcaattaaattatttgtacttaagaaagcagtgtattgtaaaggaaccagccagacctgggttaaattcctaattttgccatttaactttgacataaccacctaaacccaatcaaaaaacgaaaagtataggtactcaactgagccagtgaacagaatatttagtccaggtacacaccaggtagttccaatttaatactcagcaaagtacatatcccctctatttacattttgctcatttccttttgatattccaaaagttcttacttgggttactcttgacaattagaacctttcttgcccatttggggaacaattattcttctaaggctataatttggcattaagccaggggattcatggtttttacaccacgagtattgagaatgttgctatttctggcaacgtctttatgaaaagatctttcccacttttgaaaatagttacgcttctctcaagaaactgggttacctcagacacaataaattgtgtaattaatgtgatggttccttctttgtgttaattgctaggatgttcacacacatctgtgatctctctagaaagtatagcatagcatgtactttaagtagttaactccctcttggcttcacttttttttttctgttatatgattcatcctattatgtctacttctgaaagcagagataatactggccctcatttaaaggggttttaaggattaaatatcagtgtgtctactattctgcctggaccacatagagggctcaaaaatagtaatttcacatgacaggttctagactttcaaataatacagtttgatgtactcttgcttatgtaaccacctgataaaattcaacatgttccaaattccctttgaaataatggaaaatgacaaaaataaacagccaaatatcaaaactagaatgaaaaatgaagttacctcaaatagtgaagggcaaaagaaactggatctaagcctggagttaaattgagacctcgtctgtctgaactgatacatgactaacacagcttaccaactggctttttcttcatctaaaaataggccattaaacaaatatactttaggatttataaatgacaaatcaagaaattatcttatattgttttaatatatgaatttataaattattttataaatttaatataatttaaaaaattttaaagtagttatcctaaaacaagaccttgaaatgtatcagtgctgttcgaaggatctagcaatgaaggtggagaagttaaataaaagataattgacaacaacagtttggtgtacattaagtaataaaagcaagttatatgagtaacagcccttgtcttcttagtggctaaggtaaggggaagatgtcattgtcattgtgttgttgctgattatagcttattttaaatttgtgttcacactcttgaaaatctacccaaattacacaggaaaatctcacagttcagcagtgcaaaaattttatttctgtttcccctccccaccactttacaagatgtaaaattttacttaatccaccgtattctctttttttaattatctgttatcagtcatgtcaaatgtgaggaaaaaaacactaatcaattaaaaatatccgtccctcttccccactgctacagcaaatttaggataaatctacagcattcacttactttagctggttctgatactgaggaatacttttttatttgagaatcaacacctaaagacttggctaattgtacagcatttgaatcatcactgataagtgttccaagagccacaagaagtctaaaagtggcttctaggtcttgtactacttccaagattgtgctaattagtgacaaacattgggctttcccttcaatgttatggtctttatgaaaacaaacagaatagttcagggccaatgtagccagagcaatgtgaatgttcttattgctccctgatttcagttctattgcatgggacatcagtgattccctctgggacatcatgagtttttgtcctgcctggccaacaaaacaattgcaaaaagtcctgagagcaagcagctggtttgctggctttcctttagggttcagaagattgataagatgactgctgaactgagccccttccttttcattgcagaagttctcattcacactggggtgtttaattgacaaccgaagaatgtcaagtgcaggaaagacaatatctattaaaaaaaaaaagtcattaatgcttatgaaaataaagaaaatttcttttgactatcgactttgaaggattttattttcccactgcaaaactaaccattttagaaaatgtgaaaaatcatgtgtctgctttaaaaaaaatgcatatatttctgaaacttttgttaatttttcatatttatataaactagatttattgctgtaagatcatattcgctttaaaaataaggtaactctctcaaacagcctacacactgtgagtattcaaaaatgaatggaaagaatggggtgcagactttgcttttaaaaaattctgtaagaccgaacaattaaacagggaaagttctttttttttttttttttttttttgagacagtttcactcctgttgcccaggctggattgcaatggcatgatctcggctcactgcaacctccacctcccgggttcaagcaattctcctgtctcagcctcccaagtagctggaattacaggtgcacgtcaccacgcccagctaatttttgtattgttagtagagacgaggtttcatcatattggtcaggctggtctcaaactcctgacttcaggtgatctacccaagttggtctcccaaagtgctgggattacaggcatgagccaccgtgcccagccggaaagttcttaagagaagaattccagttaacaagtgataggatgcttataggttggtgggagctttataatcaagggcctgggtagatgccatctgaatgaatgcacaaaataatcttagcatcactaaaggtgaggaaatccaacattatgtgctccgtaatgtaaaagtagtatgcatcatcatttataaaggatttcacctaaaaaaaaaacacctactgaaccagaatctaattttgccactagcaataaatacagagatggaggaacacatcagcaaaatccataatatgggacattttattgaaaaaaaaaaaaaaaagactttttctccaataaatcagtggcataaaaaaaaataacaggcaaggactctttgagaattaaaaaagacttaactgacataattggaaaaaaaaaaacttacagtaaatatttgtagcctagggttaacaggtcactaagagtatcttggatgcctggccaggaatccacaaatgctctgaaacagtaaacaaacaggtgcatgcccgggcgcggtggctcacgcctgtaatcccaggctgaggcgggaggatcacgaggtcaggagattgagaccatcctggctaacgtggtgaaaccccgtctctactaaaaatacaaaaaattagccgggcatggtggcgggtgcctatagtcccagctactaaggaggctgaggcaggagaacggcgtgaacccgggaggcggagcttgcagtgagcttgcagtgagccgagatcacgccactgcactccagcctgggcgacagagcaagactccatttcaaaaacaaaaacaaaacaaaacaaaaaaacaaagaaaacaaacaacaacaacaaaaaaacaaactggtgcatatatggggatcatatattaccttcagattctcaaaaggcatgtaacggaaacaagatcatcaattccagtagtgtagtgaacccttttcgtgaagattttccatagtgatttagaactaccgaagttaactttcatttaatccacaaataccagtaatattgatagaaatgaagataaaacttcttgctttctggttacatttttgaagagtgtttatttaccttcaggacagttaatagctttccacaaaatctgaagttgctggactgtgggtttttctgaagaactattacatattagagacagtatcttctcaagaagtatcaagtcatcctcagttaacttcttctcttcaggtgcagttccattaagttccttcagtttacctagaacccaaaaccaaactttcaaaattctctaactgtaattggccagataatatataaatgccaagactttcaataaaagtactctagtgtacaccatggggagttaagactttactcagcaattatcaaacaccataaagtaaggataaggcttatgagctttgtcttttttttttttttttttgagatggagtcctgctcagtcgcccaggctggagtgcagtggcgccatcttggctcactgcaagctcgccccccaggttcaagcaattctcctgcctcagcctcctgagtagctgggactataggcgcctgccaccatgcctggctaattttttgtgtttttagtagagacggggtttcaccacattagccaggatggtctcaatctcctgacctcgtggtccaccctccttagcctcccgaagtgctgtgattacaggtgtgagccaccacgcctggccttattattattattttgagatggagtctcactctgttgcccaggctggagtgcagtggcatgatctcggctcactgcaacctccgccatcaggattttcaagcgattctcctgcctcagcctcccgagtagctggaactaccagcatgcaccaccacaccagctaatttttgtatttttagtagagatggggtttcaccatgttggccaggctgaccaacatggtgaaaaactcctgacctcaagtgacccacctgccttgaactcccaaagtgctggcattacaggcatgagccaccacgtccggcctccattttggatgactttcaaagcagtatcatgtgtaatatatattcaagtgtaagtcaataacctagtttctccatgagaaaatttataacaactttttagccaatttatgtcaaattctacagctgtcaatgaaatagtcaaagagttaaatgcctactgataacatttaatttatgacttagttccatatgcatatttgatgtcacattattttaaaaatttatttaatggacatactgccctttcttcccatgttctcatttcatgaaacaatttccttcaaatccttcgcatgtatctttagtatcagtatcctttgtatcatgactttgagttactgtgtttctttaaaaatctttatctcaagaataaaaaagtccaaattccgataataaggaaaattatccaaatttacaccattgaaatcaattataaatggaaactagggcctgtttcactaatctcaggtattaacagctttaactctaataaataaaaatcaagttcattaaggaatgcaaaagtctaaatacctgttagattttcacaagtttttttaaaaaaaatctaaaagtgtgcatatactacattattcaaaataaagcaattaagaaaatattaatgagtgatttttataaatttttacaatactgactctgccttatactctggtaagtatgttacgttatgttaacccaattaattctcatcataatctttgtggcaaacaaagctaataagtactcttagtccaagacaacaacaacaacaaaacactgtattttgttttgaggaacacaaacagaaaaagcaatcaaagtcactaaagcagattaatttctttttttttttttttctccttgagatggagtcttgctctgttgcccaggctggagtgcagtggcgcgatctcgggctcactgcaactcctccacctcccaggttcaagtgattctcgtgcctcagcctccagagtagctgggattacaggcgcccaccaccacgcccggctaatttttgtatttttagtagaaacggggtttcaccatgttagccaggctagtctcgaactcctgaccttaggcagtccgcccgccttggcctcccaaagtgctgggattacaggcatgagtcactgtaccaggccagcagattcatttctaatgggcaatttaaaatgaacttgtattatttctgagggccactaatcttttaaagataagatcttaatttttcaaatgctttactcattcatattcattaattttttttgaaaacattaagagcctgggtgggtagaatttacattttccacctttaattttttttattacagtcatcataaattacttactttatgtttgtgtaagacttcttagaaagtattatggatcctttaccagactgtatatttgtggtggacacagttgtttaatactgcaatagaaatatctattcatattaagtacccaattcctgacacatgttggcaagagaaacaaccttgatgacatctcaaacagtctgtgaatatgtgaataaattaattaaagaaacttacctaatatttgtgtagggtttgcttggtcaaatgtgacagcctcttttttagggaaataaatattcattgttttagatgcagctgatcggtaggcactattccctatttaaagaatagaagatgatgataatcacaaggagtgatcaaaaatgagatttttctaactatatgacttagttttcacaattattgagatatgcaactattcagtgcgtgcaataaacaaggaacctcaaggggaaaaatatccaaaatattttgtataatttatatttattgatataatattttttggttttgggaatggaagcttaaatgtagaacaagatcatctcacactttttacttcttttttttctttctgagacagggtgcagtggtgcaatcacagctcactacagcctcgacctcctgggctcaagcaatcctcccacctcagcctccgaaagtgctgggattacaggtgtgagccaccgagcctggtctaagattaaatctaaattataaattttaaaaaagtcaaagaataccatatgattatatgaaactttccattttcatcttctctaaggcatgctgatctctccttttatgtcttttactgcttattccaaaggatgtagtaggtattatcattttctctaatctttttctgcatcatctttataaatccccaagttgtaaatccctgaaggacaggagtcctagtctttcttttttttttaagtattttattaagttccagggtacatgtgcaggatgtgcaagtttgttacataggtaaatggatgccatggtggtttgctgaggagtcctagcccttttgtttttttgagacagagtcacgctctgttgcccaggctggagtacagtggcgtaatctcggctcactgcaatctccacctcctgagttcaagcaattctcctgcctcagcctccagaatagttgggattacaggcatgagctaccacgcccggctaatttttgtatttttagtagagacagggtttcaccacattggccaggctggtctcgaactcctgacctcgtcatccacctgccttggcctcccaaagtgctgggattacaggcataagccaccatgcccagcctaatttttgcattgttttagtacagaaggggtttcaccatgttggttgggctggtctcgaactcctgactcaggtgatccgctcacctcagcctctcaaagtgctgagattacaggcgtgagccaccaggcccgtctgagtcctagtcttttatacttttttttacatcttaagtctctattatattaacagaaactcagtatctgatcatgaacaaactggcaaatgatgaaaattcagcaatattcaataaataaagtgaccttcaactaaagtataatttaaatctaatttacatctcacatttcaaatcttaatcaatttaaaccctattttgttcaaatgtacagttaagatattgtgcaaaaatatgaataaaagatttatcttaatattctgattacattaggaatagaaagggatgaaggtagataaagacgaaacacttagtgagattggtgtacaaaattaattgtttataaacaataaatttttcttgacataaaaatgagccatacacacattgcctgcattcttggtcattacagtctaggagctgtgttaagaatgcaaatattaatcaaatatcatccaaataagtataatgaaaagttccctgatggaaaagtacaggatgcaatgaaagataagagtaggcgatctagcaaggacacatgtgggtgttcagaaaagtttcactgagcttatctaataaatactgtattacaaaattaaataaaaaagaaaagggagaaaaacagccaataatttgtggtctaaatgacaaggcaaagggcaatgcataagtatgccaaaagaaaacagtgagttcaaagctctggaggtagaaaatactattacatgctcaagaaactgacaccagccagtatggctggacagaagaaaggcaatgaggaatgtggggcaaggcaaaagaaaaatattcactgggaagccactgaagagttttttaatcaagggaggtgcataaacagagtaaacaataaaaagatcactgtctgcaatatggatcatcgagagaccaatttggaagttatttcattattccaggcgagaggtgacattagcttgtactaaggtatataaagcttcaatatacacaccatgctgttaaaaactaacttctggaaaatgggagggagcactgttaacctttgttaacaagtacagctaacaattactaagcattaatttggtaaaaagttatttacataaattttataattttaagttcttaattctaggaagtagatatgacctcaactttgcaaatgagaaaaacaaaagcacagacacatcaaataaattgttcaaggtcaagcagataaaaagtagtagagctgagatttgaatttagattctcactccagaatccataatcttaattacaggtactatgttatacttcagtattgctaaccaatgttacttttgcaattaaaaaatagcttacaaaatcacatgccaagtgatggacatggtagtgtgcgcatgtaaacccaactactcaggaggctgaggtgggaggatcatgtgagcccaggagtttgagcccagcccaggcaacaaaacaagatcccatctcaaaagtaataaaaaataaaaacacatgctaggttagttattgagtggtaggtttatgggtgtttattttaatgctgaataacatatatgttactcaatttctctcatataaattacaaagaacataaaaattaactagaaaaaaatatatgccaagatatctgtcaaacctgaaagagatgaaccacaaatttagctctgtgttttactggcagccaatacagaggaaaacatgccagcacatattcaatgaacaagtgaggtatgtcagactgtagactaggtaactaaggattaaaaaaaaattagttgctcagaagaactatagctattccaggcataaatcacagaagcaaattctttcctgagtcttcttaaagagaacaatgtataatccagtgaataacattctcaacacattaagaatgaagagatgagaataaacacagactttgtaagagtagtgaggaaagcagatttacgacagtaaaacagtagtttccgatcctagatgcatattagaatcacattggaagattataaaactaccctttgccaagcccccatctcagagcagaattagaccaagtaagcatctctggggataaggctgaagtacgtttgcaaagctccccagatgattctaaaatgtagtaatcagacaattctgagaaaactcaaaaagccagacaagtttggtctcgatttactatataaaaagttctcaagcaagaaaatgacacaaattttcttactctttttattaaagttccaacgaatttttaaaatctaaaaaaaagaaaaagaaataaaaagtatgtacctgtaaatggatcaactccggccatggtagttcccatacttgcagaacctggtacataacgaccagcacctacaatacaataatactcctagtaagcaaaggtgactgtaaattataaagttcaaactgctccttcgcttatttccagtattaagcacacttcacaatggcgtcattatatacataataaatatgccacaaatttaatacagaaaagtgcttagaacagtgcctgagcatatcataagtgttagctacaaagtaaacattacatgccttatatattataattgtagaagtttagtaaactacaaaaatgtaagtggattggagagaaataaaagtttccagaataaaatgtgaacactattctattgaagtaaaggggtgggactaactagcacataagacaattggaaaagactcaggtaagagttagagatactatgacaacagcccagtcacattttattatagataatacttgtggctgtcctattgaaaatagaaagaaggaaacttaaagagtaagtatagagagagaatcagcaggatttggagatattcagaataatggatcagcctttatgggaagaagaaaaatgagctactgttctagcctctctcaatttatactctaggagttgttacaaccggcgcaaaacatacagaaatgccaaagaaaattaaaaaagcaaaaccaaaaaaaaaaaagtaagattaattaaaataatgagaaacacagaataaatggatttgttgaaatttaaccatatgccagttaatcatcttctatgcatatattcattaaagtattatatagataccattataattcacaatattttagaagcagaaggttgaataacttgcccaaggcattaagctgttaaaaggtaaagtacactctcacacttttctaaatatggttttctgaccacctgaatgaatcacagattcaatacacagattcccagagtccacccataacccagggttactccaaactggctccactttagaaacacttggggaactttaaaaaataagatcgctgggcatggtggctcacgcctgtaaacccagcactttgggaggctgaggcgggtggatcacctgaggtcaggagttcgagaccagcctgaccaacatggataaaccctgtctctactaaaaatacaaaattagctgggcatggtggcacatgcctgtaatcctggctactcgggaggctgaggcaggagaattgcttgagcatgggaggcagagtttgtggtgagctgagatcgcaccattgcactccagcctgggcaagaagaacaaaactctgactcgaaaaaaaaaaaaatctaagatcaaactaccaccaagatcatttatttaattagaatccttgggtgagagatcagagcatgaataattttagttttaacctcctcattaatctagtgaatcagaatctcttggccatagaaccctgggataagtaatttaaacaagcttcccagatcattctaataaacattagcagtttaaggactgcataaattaataaggaaaagaaagaagaattaagactgactttaagttgtagccagatagggaaatcttttggccccagtgccactgacaaagttgggaaaacatcatcatcaacaacaactaatacataccgtggcttaaatatactccaggcattttgcttaacacttacacatattatgctattttattttcatacctcaatatggtagatgctgttatatatttatacaaaagtgtattcaattatcctgataccctaattctcttggacattgtgtatgctatcttgcatatctacataattactgcatcttctgagttactgacattatggaacagtgagatatgctctggttataatggccccaggagttttcttgattttgctggtattagttgaagcttgatatgttctttctgttccagaaaaaaagccgccaaagtgatttggattctcacttggtattaagtttcagggcatcactgtttctgaactgctgatagagagaaagccatcttatctactcttcagatccttactaccatttgaaatcacattatgttatcaaagacttccttaacagccactgtgccataacagcatttagtgtgatagttaattattttcatttacttgttatcaatgcacatggtacaaccatttccatctgggccatcaataaattcacaggaaaaaggaagctcacggacagcaatccacaacttcatgatgctgacctaacgttgtatgtttgtccaatctctatgacttagagaggactgtaggttgtcatttttatagctcacagtaccagtctgcaaggccagtggatacctaaacgctatgatctcttcccaaactgagtatactgtcgaggaactctgtctgaagatccaacaacagcattatacaagatatcaaaagccattctgaaaatagagacttcttcagctgccttaaagtccaactctggcactttttccagtagtgttgatgctgaggcatgcataccttggtaaataaattcattttgaagagatacaccaacacttcaagggcttcaagaaggacattaataacttagattaggaagactactcctgggtagttgggtggaatgtctccttccatgttaagtcaaaatatgcctggggagacttcttgattgtactgctccatccaatatcagggctcacatggctccttctctgctcgtgattggtagcatctcgccagtgatagcactcatgctgtgtcttggttggtgggttcccctattatctaatttcacagataaaaaaaataggctcagacaggttaggtaacttgccaacttctcatagcaagtaagtggtagagcccaattttgaaccaaggtttgtctgactctaaaacctatattcttaactatactgctctcctggtgggaaggacccctggagaaaacaatgaattctaataatatgctatttaaaagtcacgagggaatctacacaaccactccaggaaaaagcaaaaatcagaagttaaagaaaaggaaatccatcaaaattggaaatgcagataagggaattaccaattactggatgacatctccaagatgtaaagccatgtgatgcaagatgctatacatttagtgaagaaagatacatgaatcaaaactacatcccacctgtaaaaggatctgctgtgggtagtgtgttagaagatcccgaagagcccggaacataccgaccaccacctgtgcatgcaaaataaagaaaaggcagaagtgcaccaaagttctgaatttttcaaacagcacaatgcttgttttagaagaacctacatttggagaaaaacagaagagcaaaactttcacatgatagaatgacagaaactatagtcagaagtcttataactgggaaaaaactgaaattttaatgattctccaagttttgttttcttaactttaatgctttattataccttagccccagcacttaaatattaaaacttaattcaaatatcaaaagagaattgcaggtaatatctgacctaaatatataaacatacaatcaattcctgtccctgttcctatacaaattcacaagagttcctgctgttgttattgttatcaaaaccacaggcactaaatgttaatcatttagagctctaggttcattaattcatgtgtcaaacaatggactcagggctggggatccagaagggaacaaaattgcttatatccactgaagcttacaacctactggagaagagaattagaaaagggatgaaaactacaaaggaaagagacttccatttatacatttacgaatgtgtggcgtatgtgcctatgttttgttagtacctctagggaaataatcaggttgtccacaaaaaaaacaaaaaacaaaaaacaaaaaacagtaaggatgctgaaaaagttaagagtctcagaagggcaaaacaagccaagtgcttcctagatttccagacaaagtcagctgctttaattcctttcctgtatcccacatgcaaaatagcttacacagtactacaatctgtgttcactcttgaactacagtctgaaattccaacaacaaaaatatccacatactaaacaattattttctttttaagtgcaagtatttggaggatcagatcatctgtaattcagtagtaagttactttgataattttttttaaaattttttgatttttttcagacggaatcttgcactatcgcccaggttggagtgcaatggtgcgatcttggctcgctgccacctctgcctcccaggttcacgtgattctcctgcctcagttttccaaggagctgggattacaggcgcacatccatcacacctggctaattttttgtatttttttttttttttttttttagtagagacagggtttcgctatgttggccagactggtcttgaactcctgaccttgtgatctgcctgccttggcctcccaaagtgctgggattacaggcgtcagccaccacacctggcctgataattctatttaaatcaacatgcaggtaacattagttttattttatgaatgggcaatgaaattttgaagtagaatgaggagataatttgggaatgtggagtagctgtcagggaagaaaaggtggatctacataaggatttgagacaggaatataatacaaagtcctcgtaaaacaaggaagagcactagcacctgaaaaatgttgagtcagaaatgatgagaggaaaacattaacagtaaagtgcctatctcaaaatgttatttagaggaggcattttatttcctcctacaccagtctccagaactcacgttaatattactaggattagattccacttcctaggggccagaatttggactagtaccattaggattacaatttacagactggtatgagcacctaactgcatttataacatgagatacgatgtatacgatgttacaaacaattaacttaaaatgaacgtgtagaatacacatcacatataaactaaaactacccatagggttcacttttagatttgatgcatgactgaccaatttagcctcatgtgaaaaaaagatttactaaattttgccaaaatataattttttaaaagaaacactatataaaagaacttacaagtttatttttgtttcaaataactgaaattccattatagtatgattgtatttttgaaagacaacaatttactattatttctgtaaaatacagaattacttcatcatttgaggcttaaacatatgaatgtgaagtaaaaccctgctgtagatattggtatttattgaaaaagctaatcacatgactatttgaaaacatcaaaaaaatcaatcaacactaatggaactacataagactcaatataaacactaacttacctgtaaatggatctgaaaagctgggattcccaagtcccaacatttgaccttttgtgttatcaataataaatttagctacttgatccagaaacataggattcaaatcattcttctgtaagaagttgtatgcagttaaccaagggtcatcactggtattatatggcaatttatatgatggtccaccttcattgacatcaattgagaaaacataatcaaattcctaaagtaggaatataaaaaggagatacatgcttattatctgttcacatatattaatgacatatacaacataacacagatgtgttctttaataattacagtacttaaactttctccaaagtgcagtgctaaaatcttcgtttttggcagataaagattaacagcccccatctgcatgtgatgcaaaattagtatttcattaggggatgggggtgaggatgaaggatggattacaactacatattaactctagagccaaagcagagtttccaactggtttgatatcaagatcaaaattatcagctgttactgtgccctactcaccaaaacgtgctggcattttaagcactgccctgcagggtctctcatgtcttgtcaagttaaatatagccaggcatgaggcatttgatgaaaggtggcacagaagctcccaatccaaaatggctgggaacagcttttgtatagaaactactacatgacagacaattgctaatttgtctctcaaatgcagctctcactacatggaaagatacttttaaaatatctatttcaagacagggaaaaaaaagattagtttcccacagtaatggatttttaaatgtcaaaacaaaggaaattttatcactatggggcaaaggaaacctttaatttgcctaatatttaagacaatagtaattagaaagtagaagtcgacatactttcccttcatataaaacttttccagatgtttgctgattagcaccagatgagccaacaacatcaccaatttttatccacctcccttcactaacactccactgataggcttcgactttctccccatctctgattagacgagtctgtccttctctagtaccttaaaataaaaattttaagaatcaaaggtagaatggcaatgtaaaattgaaaaacatttaaatagaaaattcttaacattaaaatttacacataagagaatatggattttgtttcaaaataaaattgtatcaaataaaagatttaaaaatgtggccaaaagaaaataacagttaaaaggaaatattattaatcaaaggaaggttaacaaaacgtgattctactaggaagcaactggcccatcaaaaataaaacaagttttattagtgaatatatcttcctaacacatttcattccgtaaatggctctccattaatccagtggctcaaactgaaaagtagaaaagcctgatacctttctctcaaccccatcgctccttcggctacttctcagcacccccttcagctactgctatcagctcattctttaaaatatatctagaaaactgtctccttaatatctccatcatcatcccttggtccaagccaccatcatttctcagttgggttgattcaacggcctctttcctgtactcttggcccccgacagtgtatattccacccagcaacttcaggaattttttcaaaagtttaagtaggtcctgacactcttctgcttgaaacccatcaatgcttttcatctcacttggtaaaagcctaaactcttgagtagtgtacaagaccaaatataaattgtccacactatcctacatgaccttactttctactattccccctgtcccctcatctcccaacttcagccacagagcctttgtattagctgtttattctgcctatgatgctcttcacacagatattggcagtatttgctcctttccctctttaacaactttacacaaatgtcatgttctcaacaaggccttcagtggcggagacagctatccatcctccgaagaatcatgctcttcttccattagatacagctgtagttgtctagccagagactacattatctagtccccttgcattgggcagtcacatgatgtcacattactgagtaatggtcagtggaatctgggtggatgtgatatatgccagttctggcctagtccatcatactttaatctcccctcttaccccatcttaatctgtttcaatttgttattttggttgactacaaaaagaaaatccagcctaacacacgtaggtagttgaaaaagagaagacaagtcttttcagaaaatgtggataggccagaaatactagttttttaaacgctacagtgtacaatctgaaaccacatcaatgaatttttcatgctctattatactaaaatccactggtctatcttgtactttgaatggatcttttacccatgtctgagatggtatcagatactagtcatatggaaaataatggttcaataacttacgcagatcttctgcatattcatacagtttattattcaatattaaaaaatggcatttgttaatgttattaccactagtatcaatacaaatgggaagctactaagttcctggtggagatacatttttcctacatttcaattttcactcaaacacttgaattttatctttggcaacatatattatcagttattttccttgacggaacatgctcaatttgttcattttcaaaaaacgtctgccaaataccaaagcctgaataaccgtagtcattctttcaaataaaaatagcactccatgaaaaaactggtagtttagcctgcaactcaaatgactgcgcatgttcttttctttgagacaccacagtattttgacttactttatgtctactttaggttttctcacccggaatatttaaaaagatgtgtcaaaatgtaataaaactgataattcttaatattaatacctcatcaaggacatgcttaatggcaaactgtttttttttgtttttattgttttttttttttaaactacaactgcatgcaagtagaacatagtaacttaccagaatggtttaaagcccctggcttgatttacatactagtgaaccagtggttttacccaccattgtttttgcaccataagtgcaaacattaatacaatgtacaacattcaaataatatctagtattacaaaaattagttttgacctcatggacatcctgaaaggatctcagaatccccagaggtccatgaatcaagctttgagaagcactggtataataatgcaatcaagagatacatccaacccaagatttcatttgagatgactacggtcttctgatttcaaactcgaatgattcccaactcattacacagacaatgcttgattttaactcatttttttttttttttgagacagagtcacactctgtcacccaggctggaatgcaatggtgtggtgtcggctcaccgcagcctcaaccttctgggctcaaaccatcctcccacctcagcctcctgagtagctgggactacaagcgcatgccatcacacctggctaatttcgtatttaaactcattttaatattcagtttgtaacccctctcagagaatccaatcaaccaaaaagtattaaatgagtgccttttgagtgtctactgtaaatgatctaagtgttgggagatttattttttaattcctgtttatgagaagcttaattcaaagtcttctgtgagacagaggcaagaacatggtttctcatagtgattatatgtaatagtaaaaatcctcaaaaatcagcatctagcaatgaaaaacacaagcaaaacaacatttatttttcttctaattgttccaaaagccaaatatggtgaattttttctactaggtacaataaaatacttaccaggttcattaagatgttccctcccaggaagctgctcagcattgatgtcccctaaatcgccagttttagaatcaatggttgcgtgagacagttctttttcaaaagccttgatttcttcagcacttgctgttcgatcttctgattctgtaaacactctaataatgccatcactgtaaggaaaaataaactgattttagaagtcattgccataatacattaacattatcacacctgaatgatccatagtaaaaataatctgtgtttgtgaatatgagaaatattagcatgttattaattgctgattacagcactgtgctgacttcagcacatgctactctattatgtcaactatttaatagagaagttattgacaaagaacagagaaacatgtattttatacaatttccaagttaaatatttaccatcataagaatctagagctatagtatgtacttttaaagtcaatattttttagttattaccatatagagaagggtagtgggctagtttagtttataaagggctcaaagacccaatgtagggcttaaaattagcagatgttcagtagacaaatatggtcatcctttactatgccagtaactagcaatgtaacttcaatcaaggaaaaaaaatggcctaatgtttggattagatggccgtccttaacctcttttctcagaaaaattactttatctccatgatttcttaattcgaaattctgagataggagaagcaaattagacacttccaactgtattaatcctggcccattctacaggaaacctgtttctaacttattcgtccacaaacatgtacatcactcgttctattggtttttcttcatatgcttaggagggaaaaaaactaagcctataaatcagcctctgtcccagccaaaaaataaaacacccactttattagaccctctatcccttatagctgtcaccttctttttcttctctttttctttgagacagggtccaactctgtcacctaggctggagtgcaggggcggcaatcacagctcactgcaacctcaaattcccgggcccaagcaatcctcccacctcagtctcctgagcagctgggactacaaatgcatgccaccatgcccagctaattaaatattttttttgtatggagacagggtctcggtagctcacccaggatagtctcgaactcctgagctcaagcgatcctcccacctggacctaccaaagtgctgggattacaagtgtgagccacagcagctggccttcttattgctttcaatgctagagtagcattatagagtagtctatgatccttcgtccatctcctccaaccctttatttcctcttatttgcctttttttctatcattttctattcaaaatgtgattgatgccaaaagtcactaataacatctttcaaaccaaatccaaatgcttttcaaactttccattctttgactcctcaaacacttttgacactgatgacaatctccctccaaaatctctccttttctgtctcccagaaatttcaacatttgaattcctttgttctgtttaacctactaacttctttttctctactaatggtatatcataaaacttagttcttagtcttctgttcctcccctgtatttcttccctcagagaatggtgttctatgctttgcttttggaagctttgcgaaatctttatcttagcctcagttcttatactaagctccagttcaaatgaccatgatccactggcatgagtgtggctcaccaccactgcagacctcaggaagtctaaggccacggtcatcaccttctgtacccaaccaattctcccacttctccatttttattaatgaagatttccaatcactaacagtttgaagctttatccttttctttcatactttttctgattgttttccttctggattatctcatttacttatttcctacccattagcattgtggggccaatgtcttataacttcacactccttctgtacttgctttctaatttactttcctgtccattgtcaccagcagttaaatccaatctacatatttagtaattcataagttctgcttcaatcctatttcttgctcaagaactacaacccttcaaccccaggcaatgaatctaaaaaatgcctggcatgaaagcactaaaggttctccacagttaagccccattgtacctattatctcagcattagtactccaccattttccttcacttcctatgcatgctgcattcattctcatgaaggaaacttatactcttagctttgacaaaaatttgcgtatcttttctcactcataatctttcaaaatccagttcaaatttcttcttctacagaaagttttcccacaccaatctctaccttctctaacttcttttgtagtcaatatcttgactgcacaattgcagtacaatactggtatatcatgcatcattgactgcacaattgcagtacaatactggtatatcatgcatcccttagtatgaaagctataatatctactactgttttgtttagtaattgaagtgtccatatagtctcctcaagtcacgtgaaattccttatggcttatctctgtacactctagttcctactgaaggcctagacatataacatttaatgattgactagaatataaatacctcgcaccaaccacaatgtcaccattgtcgagcacacagcagcaccatatagactgagctggaagtcggatagtttgagcacattccccatgtttccagattctcagagatctgtcctctgctgttgtcacaaagtctaaaattaatgaatataggaagtattagtttgaataaaattaagtacatttatacataccatctttctagatacactgactttttgaaacccagagactttcaaaattacagttttaaatttcatatgtttgtcacttacaacatatacaacttcaaaatcacattttttattcatgtcacatcttacaaagtgtttcttcagatacccaagaactttttacagcacaacataaatctgaattaatataaagatggccatacaattttcttctttgtaaacaggagaaagatacttaatgaaataaatttactaaattattcaagtcatagatagtaaattaagtaatcagctctcctccctccatctcacaaatgggatggaataatgctcaatacaaaacattaaataaatagcataaaataatcttacctctacaatttggaaaaacggatatgctataaatataatttgtatgtccataatatacttcaagacactcgccagtgatttgccaccttctaatactagcatcatttgcacaggaaagaaattctgtttcactcaaaattgccaaacctcttacacagtcttcatgccctgcattaaaaaacaataatgcaaatcaataaaactgataatttggctgatggctctatacattttactaacattataaaacatatcagtgagtagtaaaaattaattttcaagttagagaaatctttttttttgttgaaagcctgataaccaaaatttgtatttaaggtttagcaatatttttttatcaccagtcttcagaagttattttacattcatcctaccttctccaaaaacctccagaaatagtattttgaccccaataatttgttttcacctgaaaattcatttttaatttttcttccccaacaagagtaatttataaaatatataatattcaaatataaaagaaatatataacaaagagtagcccataaatttaagaacaaaacattctctgaagcttgtgaagtcagatttcctatgttcagtatctgttgacttaagagtagctatcacagattaataatgacttgatacatatatatagactatatactgaagcagaaacagaaggatgtttagtcatcatccactttccatcaaaagatactttttttgtttttctttttttttttgagatggagtctcactttgtggcccaagctggagtgcactggcactacctctgctcactgcaacctgtgcctccagggttcaagagattcttgtgcctcagcctcccgaatagctgggattacaggtgtgcatcaccactcctggcgaatttttttgtatttctaatagagacagggtttcaccatgttggccaggctgatctcgaactcatggccccaagtgatccacccacctcagcctcccgaaaggctgggattacagttgtgagtcactgcacccagccaaaagatacttttatctgtacaaagggacttcttgcatattatctagggtagttaccaacttttaaggaaaaaattcaaaaaggaaaaacaacaccaattaaaattaacagtaaatacttaagtaccctacaaataaatcaatgatattactattagatagcagatgcatcagtattggcattatttaatagctggggtttaaaaagaatactcaccataaaccacaacataaacaaagcttgaaattcgttataaacaatgtgcttcaatataaagacactaataatgatttcttccatatatgaagataacactgctgactgaccatcagtaaggcttatgtttagaagtttcaggctaaaagtattaaaatgacaaccaaaaatataactatataccaaaaattacatacatatatgcagaagcacatatgcatattatatatagcttatcagacagctatttatcagtctacatttggctgttttatgagaggtttcattatctttttaaatgtattagatattaactcatcagaaaaattacattaactcaaattaatagcttaaatatactaatgtttttcaaatattttcatgcttgtaaacttctgagaaaaaaaatctgagcaaataaaaagcaatgatattataaaacttgtctaccctgatcttacctgaaaaagtcctctcacatcttccagccttccacagtttaacagtcttgtctgctgatccagtcaacattaagccctgttcaggtaagatctttaccgcccacactgcagctgtatgaccctgtgagtaaaatgagtatcaatttaagttgccacagaatcattcaacttaattattctttagaatatttacacagaactactgtacctgcaaggtcatcatgcacttgtcattcagccagactttagcagtggtgtcccatgaaccactaagtaatgtcccaaattttccagatgatagactacaaactaaggaaaaaacatcattggataacacattttcatacagaaaaatgctcaacattgaaagttactaaagcattccaattttaaaaacactctttgaagtggcagtatcttagctaactaaggctcaattcagcagagacgcataagagtacagtggtcaagagcagactctggtgccagactgcctgggcgcaaggcctagctgtgccacttacaagccacgtaactgcagaaatattactcaaaatcagattccttgtctgtgaaacgagggagcggaacttaagtgagctacacaatccttccagctttaacaaatcataatagggagataatgtaaatgattttgaaacactgtttatataaatatttaaggctgctttcatgacagtgaccataaaacctgcagccaagctcaatgtccaaaagtaatgaagtggttaattaaatgtcttactttcttgatgtgaaattatgcaggctaaaaattacaaatatgaaaaattatgccaggcacagtggctcacacctgtaatccctgcactttgggaggccaaggcaggcggattgcttgagctcaggagttagagaccggcctgggcaatgtggagagacctcatctctactaaaaatacaaaaaaatagctgggtgtggcggtatgcgcctgtgttcccagctacttggaaggctgaggtgggaggattgcttgagcccagggcacagaggttgcagtgagctgtgatcatataccactgcacttcacgcctgggtgacacagcaagattctgtctttaaaaaaaaagaaagaaaagaaaaattagccaggtggagtggctcatgcctgtaatcctagcattttgaactgagctcaggagtttgagaccagcctggggcaatatagtgagactccagctctaaaacaaaaattttaaattagtcagacatggtgtcacgcgcctgtcgtcccagtaagagaattgcttgagcatgggaggccaaggctgcagtgagctgtgagagcagcactgcattctggtatgaccaagaaagtgagaccctctctcaaaagataaaagaaaaaaaaagaaaaattatcttaggaaagaagagtatcattggcggtcgaagcacagccataaagaaccttggattgggaaacctttttcctagaccagaaggaagcaatcacaaaagtctctctaccctgagctgaggatccttgagacagctacttatttggatttcagaatggctctagatcaaaaactgttgtcttgcactgcttcctcttctgaatgagtgtttgctctgattatcctattccttttccataattgtatattgggtatggttgacagcttacttataagcatcacctctctgatgtttagaatacttagcatcactcagaggagacttttggattgtttgatgaagctgaatcgttgatgaccagaaagcatgctgtggtaactctccctttttggacacatgggagaatggtactttcctcctccatttgaagttaggcatagccatgatacttgcattagtcaccagacaaaacggtagctgacactttcagtcacacacatgtttttggtgtttttttaaaattgatttttttaattctctactactgtgacattcaaggaaggcacatgcttttaaaagccagtgccttattattattattattttttttttttttttgagacagagtctcgctctgtcgcccaggctggagtgcagctgtgtgatctcggctcaccgcaagctctgcctcccgggttcacgccattctcctgcctcagcctcccgagtggctgggaccacaggcgcccgccaccacgcccagctaatttttttgtattttagtagagatggggtttcaccgtgttagctaggatggtctcgatctcctgaccttatgatccgcccgccttggcctcccaagtgctgggattacaggcatgagccacttcgcccagccaaccagtgccttattaaccatgttgccctttgactgctccaacaactactgaagcatgtgtggagagaaagccccattagcctgggtccctgagaaaatctgatgaacagagtccctttattaatccatgttgaacatgtagggttaatgagaaatactcatatgttacatcactgagatttttttttttttttttgagatgggagttttgctcttgttgcccaggctggagtgcaatggtgcaatcttggctcactgcaacctccgcttccgaggcacaagtgattctcctgcctcaacctcccacgtagcttggattacatgcatgcgccaccatgcccggctaatttttttgtatttagtagagacagggtttcaccatgtcagtcaggctggtcgtgaactcctgacttcaagtgatccacccacctcggcctcccaaagtgctgggattacaggcatgcaccaccatgcccagtctgagatcttaatagttgtaacttgggtgctctttacattcttccacaaatcagtatgatataattggataaaataccatttcccagtaaaagaaaaaaaaaaacaggacttcttggcaaaagtgctggtttgaggtctagagcaagaagtgtacaaactgaacctagaacattctgtaataaagcaaggaagactactgaaggtcttataaaaaggtgacaggagccaatttaaagaggtttccaatggccagatatggaacaatttgagaactgaaaaaaaaaaaaaaaattcaggaaacaactccttctgcaaaccagtaaataaattgggagaagggtcaaggaaagcatttattctgtcttttctgtatagaagtcccacatggtaaccagttgatgtggaaagatctatacagaaaagtcttggcgatcaaatgcagaaataatattagaattacagtacaatcattttgtaaaccttaataaaatattgaatctaggcaatgattatcagtagctgctaaaaattaccattatgtgaaaggctgatgggaactttataatgaaagaaagatacaacacttgaacccactgatcaatcttaatatcacaaaaagatattgtgtgcttcctgatgtgatacaatagaaaatacagaataccacctatactgttgccaaaaacttgaatctgaacctgataaagctactagatctatttaacagcttacaagaaatataggtgactgaagaacacattaaaggaaacaaggctttaaccagtaaaactgagattgtgggaaattctacagctaaaataatctggttttaagcaacaagaaaaaaagaaagaaactgacagattgaaagatgtagggctgggcacggtggctcatgcctgtaatcccaccactttggaaggccgaggcaggcagatcaccagagtttaggagttatagaccagcctggacaacatggatcaccagaggtcaggagtttgagaccagcctggacaacatggtgaaaccccatctctactaaaactacaaaaaacttagctgggcgtggtggtgggcacctgtaatcccagctacttgggaggcagaggcaggagaatcacttgaatccaggaggcagaggttacagtgagctgaagattgcaccactgcactccaggctgggcaaaagagtgagactccatctccaaaacaaacaaacaaaacaaacaaacaaacaaaacagatgtggaccttatttgggtcagaattcaaatgaactgtaaaaaaagatttatgagacaactgggtaaatttgaacattcactggatgtttttgttttgttttgttttgttttaggtgtgataacaatattgtggttattcttttgaggacgtgagtgtccttatcttttagaagggtcaacaaactaatgctggtgagccacctgtatttgtatacctaacaaactaagaatgttttttacgtattgaagtaattgagagaaaaacaatcaaaggcaatcttctaacgtgaaaattatatgaaattcaaatttcagtgttcacaaatgaagatttattgaaacacagacatgctcattcatttatttactgtctatagctgctgtgcactacaactgcagagttgagcagttatgagagcaaccatatggcctgaaaagcagaaaatttatttactatctgatcctttacagaaaaagtttgccaacccctgttttagagccacataatgaaggatgtatttataaatgaaacagcagaatatcagaaattttaaaatgatgtagtggaaggaggggggaagatgaaacaaaaataagatatctctacttctgtgtacatttgatttctatataaaattttaaaaatctgtatccctctgtattgaagacttctcacacaaacacacatacaggcacacaaacatttaaaaaattctttctgtttttggtcgggcacagtggctcatgcctataaacccagaactttgggagactgaggcgggtggatcacctgaggtcaagagttcgagaccagcctggccaacatggtgaaatcccatccctactaaaaacacaaaaatgggccaggcacggtggctcaggcctgtaatcccagcactttgggaagtcaagttgggcagatcacaaggtcaagagatcgacaccatcctggccaacatggtaaaaccctgtctctactaaaaatacaaaaattagctgggtgtggtggcgcgcgcctgtagtcccagatactcagaaggctgaggcaggagaactgcttgaacccgggaggcagacgttgcagtgagccaagatcacgccactgcactccagcctggtgaaagagcaagactctgtctaaaaaaaaaaaaaccataaaaaagctgcgcatggtggtgggcacctgtaatcccagctactctggaggctgaggcaggagaatcgcttcaacccgggaggcagtcctggcagaggctatagtgagccgagatcacaagatcacaccactgcactccagcctggtgacagaccgagactccgtctcaaaataaattaaaattaaaattaaaaaataatttaaaataaaaaattatttttgttggccaggcgcagtggctcacgcctgtaatcccagcaatatggaaggccgaggggggcaaatcacaaggtcaggagatcgagatcatcctggctaacatggtaaaaccctgtctctactaaaaatacaaaaaaattagccgggcgtggtagcaggcgcctgtagtcccagctactcggcaggctgaggcaggagaatggcgtgagcccgggaggcagagcttgcagtgagccgagatcacgccactgcattccagcctgggcgacagagcgagactctgcctcaaaaaaaaaaaaaaaaaaaaaaaaattttttgtttttagagacagggtctcactctatcacccaggctggagtgtggtggtgtgatcacagctcactgcagcctccaactcctgggctaaagcaattttctcacctcaacttactgagtagctgggactacaagcatgcaccaccatgtccagctaattttttaattttttgtagagatggagtcttcctatgttgctcaggctggtctcaaactccttgcctctagcaatcctcccgtcttagcctcccaaagtgttgggattacacatatgagccatggtgcctggcacattatacaaattgtttaaaggaatttaagtgtttatgaaacatgttccaaactatttcatttatatttttaaaaaagtacacttactgcaccgattaagcatgtcattctacaataaagaactgttaagccacacagaaatccagaattatcacagaatcaggaatatacacaaatcacagaaaataatattcaaatatattaaatactcctcaataataccagagccctaaacacactgctctgggtcttcaattaaatacttttagttttctgaataaatgcattcattgcatgaaatagttaaaaaccagactcatgaagtatattcaaattatatagcctcttttattactgaacactttactttttttttttttttttttttttgagacagtctccactctgtcacccaggctggagtgcagtggcaggatctcggctcattgtaacctctgcctgccaggttctagccattctcgtgcttcagcctcctgagtagctgggattactggtgggcatcaccacacctggataatttttgtatttttagtagaggcggggttttgcaatgttttccaggctggtccgaactcctggcctcaagtgatctgcctgtctcaccctcccaaagtgctgggattacaggtgtgagccaccgctcccggccaataactgaacagattactttttacatatataagcatatcaacctttactgatcacaacaaatttgtaacagaatttttacggaactaagatagcccaaaagcgtttccattaccaaaccacagatataggtaaaacaaaatataataaaaacttgagaaaatggatatgtaaattttactttcaaagggataaaacttcaaatagaaaaacaccaaagcattattatactcaccagtatttttgtggccttttagaatataaagtggcattggactgtccagtgagaaaatgcatatattgtggtcatttccaccggtggcaattaggccatgagggtagatgtcacttgagggtatgatgcatacacaagatacaaaattggaatggccactcatacagtgcatttctgtaaagctcctgtttggactggaaagacaagataattaatagatacatattcgtaccctgacttagcctaggacataaactgtcaaagcactcattttcatttagtgtctagacaaactttagagtatatactatcttaagaatctattgttttaaaattgaaccttacataattcatatgaactactatagagaattacatgagataaagagaagtttgtttagtgtttctttgataagaatacgttaacatagagaacaaggaaaaaagaaagggcaataaataatcatgactgggttttttctcaatctccatcttcacttctacacattagtgactgttaccctaagaaatccctggttaaacgaaacatacatgcaattaagataatgaaatttattattaagaagacctaaatatactgaggactttttcacattatgaagcattgacttagagcccagtagtatagtacagcatgtgtttctacatagctagaacaggggtgtcaaatcttttgccttccctgggccacactgaagaagaagaattgtcttgagccacgcataaaatatactaacactaatgataactgataagctaaaacaaataaacaaaaaaaccccacctaatacagaaatatataaatggctagagtaatattatataatatataatgttatatataattatatatatcaatgaacacagtacattaataattgcactgggattaaaatgattaccagtttgtgacatgtatcaatcacttagcatcactgccttacttaacaagttcaaccagcagattatgatttactatgtggaaagcaataaattacctgctgagagggataaaaagaattatatccctgactcagctaaatcaaagagtttgcagtctagttgaagaagataagtgtacataaagaggtaagactcccagataaagactaaacaaactcatctattttcacttccttcccaaattccactaaaaacaataaatacttatgttttttaataaaggcttaattaaacccacaaggccaaggagaatgaaaaaaaaaatacatgaatacaactttgaatatttaaagcttacagaaaagtagtaagggccttaggagacctgagtcctagcaggcagcaggacaaccgaagaaccaatttaccaacaaagggcttaagaactagagaatattctgggaagtcggcagagtcggaagcaccaggcatctgttttcccacctagacaacgatggcactggcagaatctgtctgatgtaactattatgaaactttgcagtcatttgaaagcttgcaacttctaggggaaggcttggattgtaaattgaggttaattttgatcaatgcctgctcttggcacagtagcagttacccacacctcacccttctagccccatggcaggcagtcatgcatctgttcccagagaaccttgctcacagctgtaggaactagggttggcaaaaaggatcctgtcctccaaatatcagagatctgttctctgatcactgattgctgctttgatcacagagcaacaacaaagaggcaggcagccattgttgttgcacctcccccggttgatgcaagcctctaccacttgagctgaagtgacttccaagaggatttaaaaggctgatgcccggccgggcacagtggctcatgcgtgtaatcctagcactttgggaggccgaggtgggtagatcacctgaggtcaggagttggagaccagccttgccaacatggtgaaaccccgtctctactaaaaatacaaaaattagctgggcgtagtggcaggtgcctgtaattccagctacttgggaggccgaggcaagagaatcgcttgaacccgggaggagaaggttgcagtgagccaagattgcgccatcgcactccagcctggggggacaacagcaagactttctctcaaaaaaagaaaaaaaaaggctgatgtccattcccctaacaccttcattttcctcttctgggagcaagataataaagactaagatattcaaaaggaactacatatatggaaaaaattagaaagtgaaagtgcatgcccagggaaaagcacaggctcagaaaagactgagaagactaagtttacatcttagcccgatatttgaaacaaagacacccttcaacaacaacaacaacaaaaagataatacacaaaaacataacaaaaaacagcaaaccctggaaaaggggaagaatatgatttctagagttatattattagattaaatgttcactttcaaccacaacaaaaaaatcacacgcatacaaataaacagaaaagtatggcccattcaaaggaaaaattaagtcaatagacactgtccctgaaaaagacctggcagcagatctactagacagagactttaaaacaactgttttaaacatgctcaaagaactaaaggaagatggagaaagtcaagaaaattatgcatgaagaaaactgaagtatcagtaaagaggcagaaaacctataaagaaaccaaaaagaaattatgaagatgaaaggtatgataactgaaatgaaattattcactagacaacttgaagacagattcaagcaagaagaaataattagcaaacttgaacataggacagtagaaattatcaggtttgaagaacacaaaaaaagactgaaaaaaaaaaaaatgaacagagcctaagggacttgtggaacaacatgaggtaggccagcatacagattgtggcagtcctagagagaggggaaagggagcagagagaatatctgaagaaataatggctggaaacatcccaaatttgatgaaagacatgaatataaacatccaaagaaactcaacaaactccaagaagataaattcaaagagacccacaccaagtcacattatattcaaacttaagaaagggagatacaaagaatcttgaaagcagtaagaaagaagtaacttatcacatacaagggatcctcaataatataattagtagatttctcatcaaaaactttggaggtcaaactgagtgcagtagcacacacctgtagtcccagcacctcaggagactgagataggagaaccgcttgagcccagaagttggaggctgcagagtgctgcgaccacactcaagaacagccactgcattccagcctggtcaacatagcgaaaccccatcttgaaaaatttttttggagcattagctaggtgtgatagtacacacctgtagtcccagttacttgggaggctaaggcgagaggatcccttgagcctgggagtttgagacttaagtgagctatgactgtaccactgtatgcccgcctgggccaaaagagtaagacaccatttcttaaaaaaaaaaaaaaaaaaaaaaatggtgagggagtttgctgccatgagacctccctgtaagaaatgcttaaaggagccttctcgcacagtgaaatgaaaacacactagacagacttgaagcaatatgaagaaataaagatctcaataatggtaaatacgatagtggtttataactctaccttttgatttctatgtcatttaagaaacattacattaaaaaaattagcctaaaagctaatgatattgtaactttggtttgtaactccaaatttttcctacataatttcagaaattaaggcatttaaagtaattattactttatgtttttaggacacagagtacatacagatgtaattctgtgacaccaacaaccaaaaggggtgaagatggagctataaagaagaatttttgtttgttattgaagttaaatgtatacattcaaattagaggattacaactttaggatattaaatataatcctcatggtaaacacacacaaaaatagaatatacactaaggaaatggggaaggaatttaaacataaataaactaggccgggcgccgtggctcacgcctgtaatcccagcactttgggaggctgaggccggcggatcacaaggtcaggagatcgggactatcctggctaacacggtgaaaccccatctctactaaaaatacaaaaaattagccaggtgtggtggcaggggcctgtagtcccagctactcgggaggctgaggcaggagaatggcgtgaacccaagaggtggagcttgcagtgagccgagattgcgccactgcactccagcctgggccacagactgaaactccgtctcaaaaaaagataaaaataaaataaataaataaacaaacatataaataaataaatcaactaaacacaaaagaagacagtaatgcaggagatgagagaccaaaaaaaaaaaaaaaaaaaaccaaacaaactttaaggcatatagaaaacagacagcaaaatggcatcggtgattactttcaatgtaaatgaattaaattctccaatcaaaagacaaagattggcagaaaccattttaaaaaacataatccagctcggtgctgtttatgagactcactttagatccaaagacacaaatatactgaaagtgataggatgaaacaggatattccatgaaaacagcaaacaaaagaaagcaggagcagctatattaacattagacaaaattgaccttaaatcaaaaaaagaaaacaagagacaaagaaggatattatatattaataaaaagttcggtacaggaagaagatataacaattataaacatttatgcacataatatataaaacaaaaactgacataattgaagtgatatatagatagttctacaataatagttgaagacttcaatatctcaatctcaataatggatagaataatcagacagaaaacatgtaaggaaaaagaggacttaacaaaataaatcaactagaactaacagacatacagaatatactacgtgaaagcaaagacacctgctacagaaaaaagtatggaaattcctagaaaaattaaaaataaaattaccatatgactcagcaattccatttctggatatattcccaatggaaatgaaagcaggatcttaaagagatatgtgtataaccatattcatagtagcattattcacaatagctcaaatgtggcatcaacctaagtgtccatcaatggatgaataaacaaaatgtggtataaacatgaaattttattcagccttaaaaaggagggaaattctgacatatgctacaacatggaagaaccttgaggacattgtgctaaacgaaataagccagttataaaaacacaaatactgtatgatcccacttatatgtggaacttagagctgtcaaaatcatacagacataaagtagaatcgtggttgccagggtctgggggtggagacaatgagttattgcttaaacaggtacagtttcagtgtaaagagataaaaagagttaaaagatggatggtggtgatggttacacattatgaatatacttaataccattgaactgtacagtttaaaatggttaagatggcaaattttatgttttgtgtattgtatcacaataaaaaaactggaggaaaagaattaacagcactatatacctccagaggtgaggacaaagaggcaggaactaagataagaaagactaatcgaaagtcttcagaatctgaagcattatgaaaaagtcttcaaagaaagatacctggtagtaaccaatttcaacttgttcacttcattttagggggtgttgtttttgttttttaatgcttttgaaaccattttatcaataagcccagaggaagtcaaaagatagaacatgttttaaaatctgtattatgtaaaccactaaatctacccactatgtgtaacccttaacacttcaaagcatagatgtttgtgtgcatcttcggtagtggtctgtgaagttcttaatggcagaatccagattaggttctttgtgtcttcccaagtccctagcacaatgttttaaatggttagcattaagtatttcttaaactgattttaaaaaatacttaaggtattaagacaaaaaaaaaaacaaaaacaaaacacggggggtgggggagggatgtgcagctagacaacccagccagacaactgtcctgctagtactcagcaaaagtctgaagctttttctttaaaaagaaaatctttgaatggggggacataaggatagttgagtcttgggagtgtgaagaatgtgtatattcctactggagcccaagaccaccaaaagaaaaccctggaaaccataccctcatcctctaggcagcagatcagcccaatataatggccctaccagataactcaacagtaaaactcacaaccagcaagccccatccaggagcacagatctcccaggagcttcttaattctctacccataacactgagcacacaataaagattaccagacatctggggaaagcctccagcatgaaatacagtgatcaaaacaaatagagatgagaaaaaaaccaatatggaggaaaacagaccattaaggaggaaataccttaaaacatttttttaaattgtcattatcatccttagaggtataagatattgcaaccatgaaacaaggacataatttcacaaagtcaaggcaacctgctagagattacagccaagaaaaaaaaaaaagagagaaatttagaaagcaagttcaatatctgaataaaaacagttccagaaaaaagaagacagaaaaaataaagagaaagcagccaaagaattaattgaagaacatttcccagaatttatggacatgagttttcatattaaaagggcccgccaatggcctggaacaatggatagaagtagactgccttccagaaagaaaaaaaaaatagttcaaaaatcagaatggcttcagacttctcaacagtaacactagaagatgaaatacaatggattccatcacaattctgaaagaaaattattttaaaattagaatgctacaaccattcaaattatcatgccagtaacaaggcaaaataaaataactttcagacttgcaaggtcttaaaacatttattactgatgcactacatttcaggaagctcttagaggttatgttccaataaggcaacaaggaagaaaaccaaccaagagaaagctaaaggatactgacaataaaaatccaacatatgaggttcaaaaaagttgttttggaaacaacaatgaagggaaatcctaggattagttgtgcatcagaggtagacagaccaggtcagaaagtttgcattgtcaggagaggaaattgtaaaatatccaatgtatctaaaggccttaagaggtgattcggtaacgaacaaagactttgaaattgactcagtgataaatacatagtaagctaagcaaatgaaaaccaaaataaaacaattattagccacatgcagatcataaaattgttgaggaagagttatcatagattattccacagcttaaattataagagtcagagcacggaggccgggcatggtggctcacgcctgtaatccgagcactttgggaggccaaggcgggcggatcacgaggtcaggagatccagaccatcctggctaacactgtgaaaccccgtctctactaaaaatacaaaaaattagccgggcgccgtggcgggcgcctaaagtcccagctactcgggaggctaaggcagaatggcgtcaacccgggaggcggggcttgcagtgagccgagacagcgccactgcactccggcctgggcgacagagcgagactcgtctcaaaaaaaaaaaaaaaaaaaaaggcacagaaaaagatgcatacgtgatggggtgagtggaaggcagaaagagagctaaattctcatattctacagtaggaactaatagattacaactaaaaaatctattaatatagattaatataatcagatcctatatctgaagatgtgtcttcaagcatgggtcgtttttcaaaaggcaaggcaatataaaggcaaagctgctgaagtcctatctcactcatctctccccacccagaagtcaacgacagacttgggaaatgtaatttagcttgaagctagcttatagagacctgaagtagtctgaaacaatggcatgttgctggctcagttcaatgcccaaccaacagatatgtctccactctgaaggtccaaagactttctgggttttcaaagggcttttgtgaaagactaggtacctggtttagtctactctaaaacagaactatttctgcctccctagaactaactttccccattattcccagtccatccctacatttactaccctgatctagaaccttagcaacaacatacatggaaagcagtggtaaattcatttgcatcagaggtagacagaccaggtcagattcagtaagaggcaattcagtaatgaacaaagaatttgaagttgaatcagtggtactgattcaaatttacagtggtaaatttcatttaccacttggctacatgggaaagcaaatttcatttacgacttcactccaaacatttatagcatttcattaactctattaatatgctgttatgagctgggagtggtggttcacacctttaatcccaacactttggaaggctgaggcaggaggattgcttaagcccaggagtttgagaccagcctgggcaatctagtaagacgctcatctctacaaaaataaataaataaaaattagctgggcatagtggttcttgcctgtagtcccagttacttaagaggctgaggtgggaggattgtttgagcccagaaggtcgaggctgcaataaggcagtgatcatgccattgcattccagcctgggcaacaaagcaagaccctgtgtcaaaaaaacaaaatcacacaaatattctattatggcctgaacgtgtcccccaaagttcatgtgctggaaacttaaccttcaatgcaaccatgttgagaagtagaacctttaagaggtgattagatcaagagggttctgccgccatgaatagattaatgtcattattgcgggactgggttagagagtggctttgttacaaaagcaagtttggcccctctgcgcctcttgctgtgtgctctcctacccttccaccataggatgatacagcagcaaagaggccctctcaagatgccgataccttgataatggacttcccagcatccagaactatgaaaaatacatttcttttctttacaaattacccagtctgtggtattctgctacagcaacacaaaagagaagacatgtatcatgaaataaaaattgtcaatatgtcagatttgaggacacttttacaacattaaaggtatggttgagacacttcagttggcatcaataagagcttaatcacctaatgactatgaaacactctaaccctggggtatccaatcttttgactttcctgggccacattggaagaaaaattgtctttggccacgcataaaatacactaataattacaatagctgatgagcatttttaaaaaaatcacaaaaaaagcctcataatgttttaagaaagtttatgaaatttgtgttgggccactcttacagccacccatgggccacaggatggacaagcttgctaacctaaccagcaggatatgagagactaaataatcttatctcactacgcactaacacacactgtggcaaaatgcaagttcttcatcagtgttagataaatacatacaggaatgaattttgaaaaacaaaaacaaaaaaatcatgagttcggccaggcgtggtggctcacgcctgtaatcccaacactgggaggccaaggtgggcagatcacctgaggtcaggagttcaagaccagcctgaccaacatggagaaaccccatctctactaaaaatacaaaattagccgggcatggtggcacatgcctgtaatcacagcttcttgggaggctgaggcaagagaatcgcttgaaccccggaggcggaggttgcagtgagccaagattgtgccattgcactccagcctgggcaacaagagcaaaactctgtctcaaaaaaaaaaaatcaatagttcaatgaacaacaaaatcacttttcaaatagagaatcagttcagcccaaagttcttcaagttcctggtaagcacaaccactccagtgattaaacccttgtcaaactagtacagtcccaaaagtttaatgacaggattccattattaaaacaggcatccttgattatactccttactgcaatggttatattctactgggcttatgcttctactggattcaattttaaaggcaaaaacttaataactgtactcaaacaaaaagttccatattagtattactaagtagttttggatattatagaattttagagttagatctttagagatcatctcattcaattcaatacaggaatttgctctatactatccctagcctagtggaccatcttgtgttgattatactacttcaaaagcctccaagcaaacccacttctacacttatcccttctcaatctattctctaccatcagctagcagaaacttctcaacacggaaatcagatcatgttgctccctgcttgaaactatttgaaggcttccatctgcaaactccataacctggctcttgccagcctcaaaacctgccctcacctcacagctaattccctcctgtttgctcctccagctgcctggaatgctcttccaattcaatcctccctatttgctcttccacgaccagctccatccatctcatgcttcaaatgtcaactttaaacaaacaactcctcagagaggcttcctttaatatatctctccacctaattaactgtatgttttcttcacatgccagtttttaattatttattggcttgttttttaatctatcttccccatcagactgtaagaaagctccagaaacactggcaacttgtctgtctttattcctctccagtatcccaaacaaagaggaggcactcaacagttatcaactgaatttatggatggtgactcaaattctaaaatctctagcagtgggagacctactaaataacaaaataactaacctcaatttttctttctctgaactgcaatctgtcttctaggtcttaaatatcctgttacaaccagccaaatcagggctgaacccgtgaactcgatcaggactgattcctaacctttttcttctttttttttttggttcgtgaacccttctgataaatcctttgaaggcaatggatgctgcttctcctcaagaaacagcacatgcacagaaacaaaacatccgagaggtttcactccctcaggaccagcacagaccacagactaaaattctaacctggacgaaaagaggattcaccagtgcaatttttgagaactaaagtcttcaaaaattaaattttacagaagactacagagcatcttcttcgaaaaaaaaaaaaaaagaggacatttcagatgccttcaaactacctcacttcggagggtgcaactgcaatcagtaaattttcaagtctaaaagaaacttgggagatcatcgtccaaaaactgaaggcccaaaaggtaggagactcgtctgtggtcaagttagcacaacaaggcaggtctttggtcccccaaccctgtgctctttccacttaaatcccgatggtttcttacagagttctaatagtctgagaattggaagggagcggagagcagagggaaggctggggggagagagagacggcaggactgacagggaagggtcactctccttccactctccgggaagcgtgcaacacagccggggcaacccgactcccagcgctcacctgtctggggcccagaggcgggtggtgcggtctcgggacacggacacaaaggctcccggcggataggcgcagcacaccaggccccgtacgtccagctcgtggccccggagcgagcagctcagccggtacctggttgcgccgctcgtcatggccagtgtctgtctggcgcccggtgcccaggcactgtgcgagaccagtccgcaggggcgactcggagagcgccgggccgcggcgggagaagagcctgcaggtaaggggcggccggagaccggaagagcccgagagccggtacggaagggcggctgggaaggggcgcgccgagcgggccgagtgacacagcaagcctgacaggcactccggaattcatcatcggcctcagccctccatgacgcagagtgtgtgcgtcccaaccgccgacgccgatgcggagctgagctggctttcctccagggctctggactccctgctgagcaagagagaaagaggcccgcccttccaccaggacgcctgaccctggggtccttcccaaacccgggtctcttccgactccgggcccaacagtttgtggtaaatc

SEQ ID NO: 1708 - DNA, 9026 bp, Homo sapiens
gtgacagcagcacgtgtctttatttataatggcagggccaaatataaacacagttttaagttagtgtatttcgcataacattccttaatgtcttgagaacatgcaaatgaattggacaaaaatcactgaatcatctataggttttttttattagaaaagaaattaagtgttgtcactagagattgaaggaaattaacaatcttacaattctagaacaggcaaacttcatgataagggattcttaagttttcaaagtgtaggagctctttcacagatacactcttggtgtagggggctgtaagttttatcagatgttttacatttcatgctttaatctttgctggtagtctaaataaaataaatacacagtgttcaggattatctggatagccatcttaaataacagagtgttccgcatgaccacagcctctgcacttgtgcctctgatccatatgacaccaagaccaactatgcttttcatatgatttctccaattgggtcctgtgacctttcacagaattgttgaacatttcctatgagatctgtggaggacaaggtggagaacactggttcagagcagtgattttcaaggtgggatgggatggggtggagttgagtggagagatgcatgtagttagaaagaacacattcaaaatacccactgatttcataatacaaactccataaagtcaagcagcaaaatgattttagctaatgggcagtagcagataaccaactgtggattcatcattgtggagaaggagtctggataaacatagttgaaaaacactggcttagaggtagagacatgccgacacatggagaacagtaagaaacgcatgccaaagaggacaattgagggtcagtgagcgaatcctgggccagaacttgtcacagtcttctgaaaaccaaagagcacatccagaagaaaaccaagatggcccgtcaaccttcttggccctgtgattaagagcaagttggtccacttttaaatactgagccaaaagaggaaaaaagctgtttgtgcccccaaattcatccaccagaagtgctgtcatcatttgcaatgccatccagctcttgaggagggacgtcagcatggggcctgttctgccaggaaagaaagaagggatctccttgtaaggcaaaatccttcctttctctcattaccagaacacttacacctgccatttaaacacactctgttgcagatggccttgagatgcagctgccagtaaaatactgacagcatagaacactgaaggaaaaggccaaatgcaaataaggagactttctgaatatgggggactctaatgcccacaccaaaatagaagcagttggagaaataacatttcccatcttctctcattcttaatctaagcctaaattgctaaacatgtcccagaataggaaaccattaattgggtttgagtgcttttagtaccagtggtaaggccaggaagtgaactcagacagacatagggtgcacctgctgtgatgatatcgtagaattctgattagaagatttatagcattgactatttcatttcagagaaatcagtggtattttttcagacctttttcccccttctgttgctatgctgagtaaccatcacaaataatgtatactcattgcccaagaaatgagttattaattagcaggcaatagatacccctccaagaacattttggttaaagaaccattcatttctccctcaactaaagcagcatttacatctctctgggtacaggtctctgaattggcctgcttgggagctagctagcgctagctgtgctggggaactgggggagggaggagctcagactccaaaaccatcacggttcccttctgaaatgttcatcgccctgtggttttccacagagccaaagatctcctttaggttactgattttagaaaactttgttttggcttttgggaagccaattaaatagagttgatttgccaagtgaacacaggtaaagccaaaatgacctgtgtttcacattgcgttttgaataaatccaaattgtttaccatggcctgggtgctctggcccctgcccacctttctcgctattcttccttttcactgcacttcattcactctattcctgctttctttctgttccacgaacatcccttacctgttgccacctcagagcctttgcacttgctattccctctgcctgaaaagctcttctgcttcatctctgcatagcagtccccttgttaaccaggtctcagctcaacccttcctgagaaaggccctcccttaccatgttagctcaattttctccccaccccatgacatattctgtcacattattctattctatttcaggatttgcttgtttttgatctgtctacctctctaaaatataagttccaggttatcattttatgcatcattatattctcatgtgtctggcacatgcttaataaatatttcttaaatgaagcttgagtgaaaggatttctctcattgacacgatctctttgtaaagtgtgaaattcataagtgattgacatcaccattcctcaactcaccccaaatcatttcttcccccaaccagaatgctgtcatacagtataacaaaccacgacagaagaattccacggtctcccatgttcctggcccagcacctcacctgccactcacctgtggttactgcagagctccaatctgctttagccgcgtcagcagttccccactctgttgcaaagagactagatcactgcatccgcctatacaatctttaccaataaagactcgaggcacctaaaaaagcacacgacccaggacattactacattactagattagacagaacatttctatcctaccactaaatatttcccgtgattccaaacttttcaaatcactttaaaacctccttatgtatatgctcacaggacaggacttcctttctgttataaggggtaacattattaactcgagaatgtttttacgccagaagagttttcaagttgtgtgctatgcatgagcttgtccaacttgtcaaagggatttaaaaatttcactctacagaaacatgtttcagaaggagaattctgattggctgcagtcagaccacctagattgaactctgctttctctgcatcagggaccacacctaagattgtaaactgggtcacagcaatcaggaaggaaggagttcgtttctaaatacagctggaaaagtatttgcattacgtctctgatttttcaggtccatggtttattaagtacaatcatctctctgtgttgttaaaacacaggtgagggccaggcacagtggctcatgaatgtaatcctactacttttgtgaggctgaggtgggagggtcgcttgagcccaggagttcaagactagcctaggtaacatcgtgagaccccgtctctacaaaaaatacaaaaattagccaggcatggcggtgcatgcctgtagtcccagctactcaggaggctgaagtggaaggattgctttggcccgggaggtcgaggctgcagtaagctgtgatggtgccattgcactcacacctggacgacagagcaaaacaaagaaagcaaaacaaagcaacacaagtgagctctgtcctcaaccaggggggtgtagtggtgtttgagtctcctttaatcgctggtccatcataagatggttaactcaccccggatgagggtgcgtcacccacgccaagccacagtcatgacacctgctgaataggctcctctctagttacacacttcctccctgctgctaggagcagacacattccagaattccagagggcttttagaatcgcgagggaggaggaaataccctcaacgtggctgaatttataggccaggagtgttccaccaaggctgcctggcagtgaagaaaaaagccccatggaggtcaccgcgtcatcagagccagcgggcctctccccgagtaccaggaacgcactggaggggagggagaggtggaggcagaaagcaatgagactatttttcaaagctttgggctttcctcagaaagcataataattggagcaaattgtccaaaaagtgagaaaggtgagaaaaggggcttcattattgtggataagttcttacagcacttttattaaaaagggggtctgggtgaaggtaggcattaaaaataaagtctaaaaattaaaaacaaatcttgcacatttccatggctattccctgtgctctcacaggataactgaggctttgaaaacccacagccctggagctgccccccagcctcctgagatgaccctgaaatgtgaccaggctgctcccagcgtggagttttgtgctcagtgtctggcaaagaagcgaaaggctcctttaccctcacacccatcctctagtctggacaactgcaaaactgccataaatcgtatcagtgaatggtacccctaacgggagctgaatggcaggctgtacagacggcacgggggtgctgtggcagtgaaaccaaagcaagaagtactgttgataaagttgagcaaagaagaggaaataccctgtgctgcttcccctcctgtcccttcccgtcccagcctcctctttagaggaacttgagagtccgctactgtcaaggagaggaaagaactgccaccccaaaacgagtttggtaatcctgtggttcttattctcctgcactaggtttccccagcctcagccaggcaacatctcctgtacgctagctagggttacacaaatgcaactactcaaaagcaatttctcaacactcctcggctacctccctggtataagccaccttcatctgtcacctgaataactactatagcctcccaatgtctcccagcttcaaccttcacctttgccctactgtctcttctccccacagctgccagagtggccctttcaaaatggggtcagatcaagtgactcgtctgctcagcacccaccaggggcatctcatctcacaccgagtaccagtcacagttcttccaagctcctattagctctcagacctcacctccactaactctcctactggctcacagtgctgcaactatactggcttccttactattccacaaacctgccaggcaaacgtctaccccaggacctttgcattcactctacctgtaaattgtgtacacccatctccctcagctcctatagatatctgctcgaatgttcccttctcagtgagacccaatggctccatttaaaactggaccctgatgcttcctccctacctttcctacttttcctcatagcacgtgccacttaccaactcccaacatactgttttattactgtatttgtttgtctcccccactagaatataggttcaacaaaggcagaagggtttttttcatggcagaaaaggcagaattttttccccaatgtacataaaagtgtctggtacatagtaggtgcttaaaaatatttgttgcatccagtaaaatcatcattcaaatgcgaaggagaaatactttctaaggtaaacaaaacttgagggaatgtgttaccaatggaatcaccttgcaagaaatgcccaaagaagttcttcagagagaagggaaatgatatagttcagaaactcagatctatgtaaagaaaagtgcattagaggagaaataaatgaaggcactaatttaggagctgtgactatagcaaaacaaaaacaggttttaccaagtacatggcttgattgaagccactaactttccataatcatgtcctgctgattacctactagatacagctactttatagaataattaagactgcaggatcaggccgggcgccgtggctcacgcctgtaatcccagcactttgggaggctgaggcgggtggatcacgaggtcaggagattgagaccatcctggctaacacagtgaaaacccgtctctactaaacatacaaaaaattagccaggcatggtggcagacgcctgtagtcccagctactcgagaggctgagacaggagaatagcgtgaacccgggaggtggagcttgcagtgagctgagattgcgccattgcactccagcctgggcacagagggagactccgtctcaaaaaaaaaaaaaaaaaaaaaaaaaccctcgggagctttcagaccctttgaatacaaacacttccctgttggggatcaaacatgcagctttaaaaggcttgttcttcccctaggaggaatgcactcagaattcaagaatctgtgaaaaacatttttctaaaaatgaaaaacaggcttgttgaggtggatcacatctgtaatcccagcactctgggaagctgaggtgggaggatagcttgaggccaggagttcaagaccagcctgggtaacataacaagacccccatctgtacaaaaacttaaaaaattagctgggtatgatggctcatgcctgtagtcccagccacgggaggctgaggtgggagggtcacttaagcccaggagttcgaggctgcagtcagctatcattgcaccactgcactctagcctgggtgacagagcaagactctgtctcttaaaaaaaaaaaaaaaaaaaaaaaccttaaaagattactacaagaaatattgttgttctacaaagaaatgaaaaagcaattgttgaccaggtgtggtagctcacacctgcactttgggaggctgaggtgggtggatcacctgaggtcaggagttcgagaccaggttggccagcatggtgaaaccccatctctaataaaaatacaaaaattagctaggtgtggtggcaggtgcccgtaattccagctacttgattgcttgaacctgggcggtggaggttgcagtaagccaaaatcacaccactgcactccagcctgggcgacaagagcgaaattccatctcaaaaaaaaaaaaaaagcaattgttaaatgaacacatgaagaggtttgctttacctcctggaaaatagatgctgttgggctgagaacaataatcccaattgtgttgcacattggaatccccaagggatttttccaaataaaaatcccaggtgtggtggctcacccgtttaatcccagcactttgggaggccgaggtaggtggatcgcctgaggtcaggagttcgacaccagcctggccaacatggtgaaaccccgtctctactaaaaatacaaaaattagctgggcatggtggtgggcgcctgtaatcccagctacttgggaggttgaggagaacccaggaggcagaggttgcagtgagccaagattgcaccattgcactccagcctgggtgacaagaatgaaactgtctcaaaacaaacgaacaaacaaaactaatgcttggctcccacctctgacattgtgatttagttattgaggggcataatttgggcataaggattgttttaaaagctctctaggtgatcctaatgtgcagcaaagtttgggaaccaatggctaaaaggtcctcagggtggcagccacagtggggcccgtagtagtgtttgcactgccctttacacctctcagggcctgggcatcctatgcagctggtggtcccactaggcagcaagagcttctctcgtcattgtgtatactccaggacctcagcacacagcagtaggataacacactaagccccctttctgcaccaaaatgctgacttcttattagagagaaggggagagaaacaacctccaatgctttatactcagaacccagagacaaccttgtaagtcaaactaaaactgaaataggatatgtgcttggcctaacactgtgctgtagaattcgtgcatcgtaaaagagaacttagctgagctggtgggacatttctcatcccacctcacagcagaactgatacaggtgatgtggctggcatccctcctgaagcccaggacgcaaagccaaggatgctgaagagagggaagtctttcggatggaggagagcaatttttagagggtcccacagtctattcgtagcaaatgggactctgaggtcacctaatctggtcttgcagctgggatctttgaggactactggggtggtgacttgcccaggatcacacagccagccattataagagccaggccagaactccaggctatgattccctacaatgtggggcctggaaacatccataattaatttagaacaaggggcagataacggtacattagatttttccagtgggaggaattagataaggaagaatgagcaaattagaaaaagaaagcctagagaaaagaatgaagaacatgaatctcatgttaaataacaaacacatcacacccggccctccaccccagcttccacctccagccctgccaactgaaaactgtcatttcctggcagtgcttaaaacaaagactctagataattccccagggactcaccggcaagctgctggtcccacttaccctgccgcacagcagacatcagctgtactccctcttctgccccgtgaagacctttggctgcagtgccgccgctcattcaagtgaccgagatcctctctaaggcgccctcccccacaccccccgccccgcacagccctctggacgccttgaagtacggagccgcagccttatcctaaagaaaggcacagctctgacaagaaaaggcaatccgggagcctttccctagccgtttaaaatgaaactcaccgttcttgctcccgtgagctgttgcaaataatcttgaatctcgttagtgtggttggtggctgtgatatcgacaaattccagaagcccttgtttgatgggcaattgactgaggatctcttgggccctcctgcagtacgggcaggtgggcttgatgaacacaaccaccttcccaggctggattttgcagttcacaaactcttgagccatgccgatgggctgcggtctccccgggaagaatcctcagttgcaggtattgcttggggtattgagccccgacccagccagttggctcctatttaataaggaacctccctggaggcggagtttgcctggtagcttgctcgagttttaaagggacagcttcgaagacatttccatctggtatacttcactagttagcaatgcccaggaatgcaat

SEQ ID NO: 1709 - DNA, 9026 bp, Homo sapiens; identical to SEQ ID NO: 1708

SEQ ID NO: 1710 - DNA, 9026 bp, Homo sapiens; identical to SEQ ID NO: 1708

SEQ ID NO: 1711 - DNA, 9026 bp, Homo sapiens; identical to SEQ ID NO: 1708

SEQ ID NO: 1712 - DNA, 15255 bp, Homo sapiens
ttttctgtaatcttgagaggttccaatcaacatttattgccttattctttttatctcattcctttttgaatgtgtttatctcctaagattttatctgtgatggagatgggatgcctgtgaatacaaaagttgcagtggtggcaccagggtgggggggtgcggccggggccaccatggtctcccctgagagggggtgctgtcttaggtgccccaagaggccctcgggcagcaagcgtggggtgctgccaaaatacagctccccctgggtgggcaggacacacgtggcctcctggcagacaggtgcctgggtgagcccgctgctcctgattagtcatgaatggcacctggtctgggcgacagtcacccgcaggaagccctgagctggccaccatcaccctgggcagtggctcccggggtgccaacaagacctgggcccctcgttctttggtgctgagagccccagctgaggctgtggaggaggccctggacctggtctggtgtctgtcagaggcaggtgcccagtcctttgacttgcttctctgaattgtcataattgtgctggaattgtgccagaaactggtagtgataacagctcctggaaggcctgtggctgctgagggctgcctggtccccctcaggacggccgggggagcctctccagaagcaccagctttgtctgcaggtggacgttgaaggggggcagttgggtcaggttcagactcacacctgtggtccccacgacgctggccaggacccggtgtgtgtccctgtagagggccaggagcccaggggccgcctccatgaggatgtgtgtgtatgccagcatgcctgtccccggctgcacatcctccctcttgtcgtacctgtgggatgagagctggtggtcctgcccagggcccccacatcgccctgtcccccgcccccaaggggccctcacatggcctctgggagggccgtgctgtgtgtggatcctacctccaggcgctgttgacttggagaaaccgagacacacctgtctgggcggctgccacgtcaatgtgcagaaggacgtctaggaaaaccaggcctgccgtcagagcccagccctgcagtcggagccacagcagtccccaggcagtgcccccagcacccacctgtctgggggggcaccagctggtgcagcctctgcattgcgacgccacctgggtagttgaaatgggacacatacagggccgtggctgagtaggcggcattcaccacgaggtgtccgatcacaagcagagaccccgctttgtacagccaagactttttatagttattcagcctgaaaaaagaatggttacacatcataggcagaacgtaatgacaataaaattaatctacctacaaaacatactaggagcataacctgctgttcaacttcaccaagtcataacaaagagttcaccaccaaataaaacagagtcagtaacccgtaaaagtggttaagatactgcctcaagaattgtctgtgaaattctacccaagatgccaatttaaaatttagatgagattttaaaatatatatatatttttgagacagagtctcgctgtgtcacccaggctggagtgcagtgccatgatctcggctcactgcaacctccgcctcctgggttcaagtgattctcctgcctcagcctcccaagtagctgggactacaggtgcacgccaccatgcccatctaatttctgtatttttagtagagacaggctttcactatgttggccaggctagtcttgaactcctgacctcgtgatctgcccgcctcagcctcccaaagtgctgagattacaggcatgagccactgcgcccagcctaaaaatatattttcaaacaatcccaagtgactgtgtaggtcagagtgccacccgcgcggccaagcccactcccagcaggtctgagtgaactctctgggacagggtgccgccggttctctcacaatcgactatgccaatctcaggatcctacggcagagttagcagctgccacagacagtgtggcccacgaagatgaggctctttattagctggtccttaacggaaaagcttgccaaccctggtctaaacgccctgaacccccgatcaagactcactctcttccaaacccaccaggctcctcggagccctcttctccacaggccctgccctttgctatggtttggatctgcgtccccaccaaatctcatgtccaactgtgatccccaatgctggaggtggggcctggtgggaggtgactgggtcatggaggtggagccctcaggaatggattagcgccatcccctccatgctgttctcctcataccgagtgagttctcgagaggtctgcttgtttgaaaatgggtgacacctcccccgtccctcttcgtcctgctttggccacataaaagcgtgcccgcttccctctcgccttccgccataatggaaagttttcccaggccagcctggaagctgagcagacaccagtaccacgcttcccgtacagcctgcggaaccgcgagccaatgaagcctcctctttataaattatccagtctcaggtgtttctttacatcagtgcgagagcagactagtgcacccttgaacaatctctggtgcggtttctgagctcgaggccccacctaggatgaccgcagcctcctaagtgcctgccccaaagagctcagcactgccagggcgttcgtcctttgttcccgcccaaacctggagtgggcagtcactgtggaaagctcgcaatcagaaaccttccacccccaggactgtctcaaggccctgggccctgacaccgtgggaaacggcctgctcttgctcccagggtggccgggctgaggacctgacttcggagggggccttgctctaccctgcaccccctcatttggactccccaagtttgtcctcctccggataaggccgactggcacagcaggggcccttgcatggagcagcccctcacgcccagcacaccaggcctcaaagacacagagctgggtccagttcccactggatcttcttccctgctggaaaagcctgtcaccgaatacaatccatccgcgccgctctccccgtctttcctaccctcttttccatgactctggctggggtctgctcctcctccagccctgagccgacccctgagacgagagggagccaaaggcacagaaaagcagaggcagagctcccaggagcccccactgaggcgcggctacagcagccagaggagcccccaacccaggcacggccacggcagccggaggaacccccagcgaggaacagtcacggcagccagaggagctcccaggcccgagggcagtgcggggcagtcggagctggggggcaccatcccctcccctgtaacaagtggcaccggaaagcacctgaccgctgcctgagatcagggaccgcattgtggggcttcctctccagccagagtgggcacctctcaatgccccaggccgcggccctcctggcctgtagccctgccgcccctcaatgcccagcgtggcctgagttggcctcctgttcccatcaaggcagcaaactctgaacgggcacagagctggccagcctcagccctgggttcttccgcagcacccacagggccagcagtgatggactctcctgggcctgagccccgggtccttccccagcacccacagggcccggcagtgatggactctcctggctccctgaggcttgcaacactgagtggcagccgcgctcagaccaccccaccctcagcccaggcagtgccctccccaggccctgccaggcccccagctccacctccatcacctgctgcctgcagtccctccccgcaggaagccccctgccctccacaggaccttgagcctgggccacgctgggccctctgcacccagccataggcacctccctcaccatccccctcttccagccagatgacccgccttgacaaacgccctcaagcccgaggccctgtcaggatggccacgaacgcccttcctctacctgacctgtcgccctcagagcctcccaggcctggctgcccctgccctctgccgctgctacctatgtgagtgtcactctcccatgacagagactgggaccgctggtgcatcaccatatgtggaccagtcaccaaattaacccaagacagagaccacctgagcaaagccctctgtcagcacaatgccaggccggtcccatcccatgcagccctcagggaggagagaggactggggtcaccctcctttgacataagcgcctagttcaacacaccctgtgtttatcttaaaaaacagccctggtggctcacacctgcaatcccagcacttccagaggaggaggcaggaggatggcttaaccccctaggagttgaggggtgcagtaagccccactccagctgggcgacagagcaagaccctgtttcaaaaattaaacacacacatacatccccccaacagtaaatcagtgaacctgtttccaatgaaactataaaaatgcatgtcacaaaaagagcactcacaggtaggagcagcctctggcagccgtgatgttgagcatggggaaggcatagatgatgaagcgtagctccttgtgtggcaggagggagtagagtgccatgaagcccagtgccagcaccgtcggcgcgtgcgtccttctgtctaccaagcccagggggatgaagagcaggctgcagcccaggccgcggggcagggctgagtagaagtaccacagcagcggggaggtctgcgggctgggttaaggaggccacgcacctgtccacgcatgagcccgtgggctaggtggcagggtcaaggtggagaagacgcttgaagacagttgtgctgagagatgcagcctggaccacggctcgtgtgcacagacaccactcaggcctcaggcccctcctaaaagacagagcccaggccacagctcgggtgcacacataccacttgggcgtcgggccccctccaggcaggaccaaggcagcaagggccacaggacgttcggtctctgtacccttttcttcactgttaaaaacagatggtcggccgggcgcagtggctcatgtctgtaatcccagcacttcgggaggccaaggtgggtagatcacgaggtaaagagatcgagaccatcctggccaacatggtgaaaccctgtctctactacaaatacaaaaattagctgggcatggtggcatgtgcctgtaatcccagctactcaggaggctgaggcaggagaatcacttgaaccagggagttggaggttgcagtgagccgagatcatgccactgtactccaacctggcgacagagtgagactctgtctcaaaaaaaaaaaaaaaaaaaaccaaaaaacaaaaaacagacggtcacgggtgacacacatgttgggattcgttatgctgttccatctatgcgtgtatgtttgacataattcctaagaaagcactttttaaatgcagattgtccgggccgggcgtggtggctcacacctgtaatcccagcactttgggaggccaaggcaggtggatcacctgagttcaagagttcaagatcagcctgaccaacatggtaaaaccccacctctactaaaaatacaaaaattagccaggtgtggtggcgtgcgcctatagtcccagctactcatgaggctgaggcaggagaattgcttgaaccagggaggtggaggttgcagtgagccaagatcataccactgtactccagcctgggcgacagagcgagactcagtctcaaaaaaaaaaaaaaaaaagcagattgtccgaggagcagaggagaggctggggtaatctggggcagggctgtttccagccctcaggctgtttcctggctgagagagggcagccaggacctcacctcccatggccagcatttcccaggagcaagtgggagggaggggctccatcctgaccctgcagccacgctgcagagaagggagaagcagctgcttccactgcccatggaggcccaggagatgtggctgcaggtcccacccatcgccctcctgcacggacactgaaggataccccccagttggagcttttgttcaggacagtgttgtaccaaagcacctttccttccggccaagtgagctgccgccaaaaataagagtccacagcaaccgtcagtcctgacaaaataaaatagagtttcttagtcgcaaacacagccatcagtaaacatcccgccacaatgcagcccccatcactacagaaactacaagctgctttcatataaaagaggttgggcagggtgggaagattgctggagcctaggagttcaaggttgcagtgggccatgatcatgccactgcactccatcctgggtgacagagcaagactatctctaaaacaaaaaaagaaaaaagacaccaactgtgtcgaggacaccactgcccagaaccaccgcctggcgcagggacaagccgccctccactcttgtggcctcccccagcccaaggacaagggacagaccagtgaacaggggctcctaaggcgcacggtgggtccccctggagatccccgggcagggggcttaggattgaaatgttttcaacactgctaaatttagggtcattttatttcatggggatgaaaacctcccaaatttctcttgacctttgtaaaacaaggcaaaacaaaatccagttagaagcatcccacagtgactgacttacctaaacagaggatccctgccgggacggcgtggcgaagggctctgactacagaaacctttcggttgcccaaggccagcagcagcaggaggcccaggaacaggcacagctccaccctgaacacgatgatggcgaaggctgacagccagatgaagcgggcccactcgtgccgcagccaggccgcgagggccagcaggactgcaagacagtgcgggagggtgctcgtcaagacacagggcccacccggcccagaaaacacccggggaagtgaagggtgattccttttcctattataaaagccacacaaatatcccagaaaagaaactgctcagagccgctccccgcacctatgctgttggccaggaagtgtgtcccaacccagcatggaaaacaaagagcctggtttcaggtcacagaccatcctgaggaacccagtggggaatggccattacgggggaggcactgccatcagctgcacagcccgactcaggggagcccctgcccggcaccatgggtgtgcaggcccggccggcagctacgtacctacaggcagggccagcacattgggcagtgtccgcgtgcagtagaacatcaggtggaactgcatggccgtcacccagcagaacatggtggccaccatggccccgaagtgccgtctcacttccttttgtaacgtccagagtccaaaaatcacgccgagtccaagcactcctctaactaaacaaagacagtgacagcacctgagcctgcagtggaggagtatccagtggggccccctacgtgggtccttctacacagatctttctatatggagttttctatgctgctgcaatgccagctgacggctacgtcaggcaaagcagccttgagggcatcgtctccatgttgaaaacagacgactggacccaggccccctgcgctcctgtcgggaactgaggacccttgcgggggctgctctctgaagcatgagggaggacacacaacttgggggtgccacgagctgagccctacactaaaccagagaccccaccgggctgtggcatctccaggggaaatgtttgcaaaggccgggctcagaccttgctctaaccagcagccatgaggaggtgggatgtggcaggaacacaggctcccaggcaggaagggggtcaggacccctctccccatttgacagcaggagccacctctgggctggtggtctgatgaggaggtggtgagggggcaggtgtgcccaggacagtacccagccgaccacacatcctcaccgtggaccggcctgtcagccgctggcaagagactgaaaacaggaagaaaaatgaacttctgggtggctcttgctacctttccagaaggccagaggaacttcgaagccatgtgagaagcaactgggtccaggcagctgtgggggccaatgggcagagatacccaggcactgccaagggggccacggatgtctgagggctggacctgctgttcccagaataccccatgtgcataccaggcattttcttttcactgattgctggattcggactgcaaatgtctttttttttttctttttaaggacagagtttccctctgttgctcaggctggagtgcagtggcataatctcggctcactgcaacctctgccttccgggttcaagcaattctcctacctcagcctccggagtagctgggattataggcgcatgccaacacgcccggctaatttttgtatttttagtagagacaaggtttcccatgttggccaggatggtctcaaactcctgacctcaggtgatccccccgcctcggcctcccaaagtgctgggattacaggcgtgagccaccatgcccagtctgaatgtcttaataggacatttttcactgatactcacaagtgggtctggctccagctgctgtatttttggtgctggaatttcccccgggcttttaaacaattcacagaccccagcaaagccccgcttccccttttccccatcaggtccatcccctgcgtctcttctcttggttttccatcttcccaaatgcccaacaatctcaaccccgtgcccaacaagggtagcctcggcctcacgatcagcctcggctgcgggatcaccctcggccccgggatcagcctcggccacgggatcaccctcggccccgggatcagcctcggccgcgggatcagcctggccccgggatcaccctcggccccgggatcaccctcggccccgggatcagcctggccccaggatcaccctcggccccgggatcaccctcggccccaggatgacatgctcttcatccagagaggaaggattttggcctgtggcaggggctggggggggcactagcaattccaggtcaccttagtgggatcaggaaggacacagggtgggctcccgttcaccagctgaagctgcagccctccaaggttctgtccagctggagtccacccagctctgcccaacctcccaacctcttgctgccaaccctggaataagcagaagcttccaagggaatgtggactcagccccggaattgcctgtggacttcctttccctggctcgtggccccccaactcctccccatttggggcttcctgatgcctctacaggacatgcacggcttgtccagctgtccccgtgccatggtgggtttccgttcccaatctgccccttcaagaagcagaactgctccttccccaggaacgtgctacttcttaaagctctccacacaagctggactgactcgctggaagcatgtctgggtattaaaagcaataaaagcgtactgaaataaaaaagtggtgattgctgacttcaaaaactcaggttgtgtgactgggcgtggtggctcatgcctgtaatcccagcactgtgggaggctgaggtgggacaatcacttgagcccaggagttcaaagctgtagtgagctatgattgcaccactgcacttcagcctaggtgacacagcaaggccctgtctcaaaaaagaaaaaaaaatcggtttttagaacaatatgtacaaaacgttctaattttttttttttaaagtcctcatgtgggcacagagaaagacccaggatttgcacacaggccctgcagtggtggcctctgggaatgtgaggtttctgtttgtaacattccccaaggcaaatggtgctgcttctgcaggaataaaggctgttgaccccatgggggcttgccaggtgaggcgggagcagcaggctcaggtggcgagagctgcctcacaggcagtcggcatttctcttgtacctgccgtcacccctaatttcacagtcaagagtgtggaggcacagaggggctgactcagacgtcttaggcctgacctgagcacctgctctgagccgccatgccacggtgatcgagggcaggcaagactaacagacagcgttcctgggcaggagggaccgcggcctcgctgaggtcacccgatgacaccacagtccctcactccctcctcctttgttgaagacccccttacctattagctgagagtaaaacttggacatttctaacagcgaaagcacgtaaaccgcggggctggagaacactgcgatcaccactggcccgaggaacgtcctggggacgactccggggaactcaagatggtcgtactgcgaggagaagggcaggtcagtgcaccggggccctgccagctggtaacatgaggttttccccaaagacagcaggggcccctcacctgctccaggtcttgccagtggtagagcaggtcatgtgtggcctgcaggttgaagctctcctccactttggtgtagggacagatgaccaggtggacagtggctacggccaccagcagccccagcagcaggggccgcctgcctgatgacccctttccagccattccaggctttcagcttcacgtaccttcacaggccaacagtgcgagacaccagccgttagcactgccactccacgcatgctggaaaagtggaaacagattcctgaggttcgaaagtcacgcttgcgctcacgtttgggagatccgggtaaagggttagcagaattctctgaactactgtcttagtcgcactactacaaatctgaaaacgcatcaagatggaaagtttggagaaaaaatcacacttgagaatctttcatactgtaaccagtgatctgacacttccagctctgtgaatgtttttctaggcagaaggatctcagtcgcagaaccctgagtctgaccaggcctgggccacgagggcaatggagggtggtaaatggcccctgccccccagtctaaatctggcaggagagtcagcaaaacccaggcttggccccgagggaaccggctgaagaagacggaatgggaggctgaggggtgccagttagctgggtgggaggcaccaagctggagagtggtggacaggggccccgggagggcaagaaactgaacgtagtacagctgctgggacacagggctcgagtggccagcaaagcccccgctcccaggaatggtgggatggggctgtggacgcctgcgccgaaccccaccctgggggctgggagaagccatggccggctttcccaaaggtggcaccacactggccatgagcctgcatgtgagcctgggaagactggcaatgggtcccccaaacactaacaggacaacctcaggggcccgtggcacggagcttcctgagaggccagcaacatgtccagctgctacacgtgagagaccaagggaggggagggggcaaactcttcacgtttctggcttcttttaaaacagatttgattttattcaatccaaaccagaagggccagaagcaaagggagagagaaccccagggcttaccatttattaaaactactttaaaaattttttttaagagacagcgtcttactctgtcacccaagctggagtgcagtggagtgatcatggctcactgcagcctcaaactcctgggatccttttgcctgagcctcctgagtagccgcagctacaggtgtgggtcaccacactcagctaagttttcttattttttgtaaagacagggtcttgctttgtagcccaggctggtatggaattcctggcttcaagccatcttcctaccttggcctcctgaagtattgggattacaggcgtgggccaccatgcccagccaaaactatcttttgatcaaacggagagttaagaagtatacaaagatggcaaccaaaggaaaatctgtagattagaaggaaggagaaccctatttgatatggtgggcagggggtggagagaaagaaaaaagaaagctttaataattttacgactgaaatggtatgcagttctctcctttgccaaatataaaaacctggggccgggcgcggtcgctcattcccgtaatcccagctctttgggaggctgagggccaggtgcggtggctcattcccataatcccagctcttcgggaggctgaggtgggtggatcacgaggtcagcagatcaagaccatcctggccaacatggtgaaaccctgtctctactaaaaatacaaaaattagctgggcatggtagtgcacgcctataatcccagctactcgggaggctaaggcaggagaatcgcttgagcccaggaggcagaggccgcagtgagccgagatcacaccactgaaatccagtctgggccacagagcgtgactccgtctcagaaataaataaatagataataaaaaaatttaaaaaaataaacttggtatcaaacaaagagaaaggtcgaaggactaggttaggaatcactaactgagggagggcccactcagctgtctcccacttgctaagacacaagctttttgacggtggggggtttttgatgctggatgatttttcccaccagcgcagcctcagcaccaaggacagaggccagccgctgtggcctgaaggctgcctcgctgccacctcccctgctggactcatcctgcgggcagggcttgcttggtggactcactgctgaatcagcaaagcctgccgcacagtaggcactcaacaaggctgccgaagaagaaatcggtaaaaactcctacatggggttctcatcacaccagctcacgtgcttattaaaaattccagcagccgggagcggtggctcattcctgtaatcccagcactttgggaggctgaggcgggtggatcacaaggtcaagagatcgagaccagcttggccaacatggtaaaaccccgtctctactaaaaatacaaaaaaattagctggagtggtggcgagtagtcccagctacttgggaggctgaggcaggagaatggtgtgaacccaggaggtggagcttgcagtgagccgagatcgcgccactgcactcctgcctgggcgacagagcaagactccatctcaaaaataaataaataaattaattaaattaaataaaaatatgttccaacggccgggcgtggtggctcatgcctgtaatcccagcactttgggaggctgaggtgggtggatcacaaggtcaggaattcaagaccagcctagccagcatggtgaaacctcatctctactaaaaatacaaaaattagctgggcatggtggtgtgcgcctgtaatcccaactacttggaaggcagaggaggagaattgcttgaactcgggaggcagaggttgcagcaagccaagatcgcaccactgtactccagcctggacaacagagccagactccgtctcaaaaaaaaagaaataggaagcaagccggatgtgttggctcacgcctgtaattccagctactcaggagttcaagaccaacctgggctacagagccagaccccatctccacaaaaataatcccagctactcaggaagctgacatggggggtactgcttgaggcccggagttcaagaccaacttgggctacatcatgagaccccatttctacaaaaataaaaaataaaacggaacggggagcatctacgtgccaagatgtgggaggtgcacacagcaagtgctgcttggcagtcccccacaaccccactccacacctctccacccaggggagttccccagcaaggaagagttcagctgtggggtgaaaacattacgtgctgactctgacactcctggcgggcccccagcacctcctcggacccaacaaggtgtgccttctgctgatgaccagcacagctcactttcgagggcatgagaagaccaagggtgagtctggattctctgccaggagcacgggaagaccaagtcaacaccagcaagcacgaaaaccacgacgaaccccccaccaggcgagggtgaacggacactgtcctgcactagcccactctgctgggcagctgggcagcagctgtggctaatctaagtgacgggtgcttcgagagcacccacaggttaaaacgggcccaggccatgacactttaaaatggtggtttacagaacaatggcatctcagattagggaatgacctgcaaagaccctcttgtccccatcaatccagattttaaggcctctaccgaaattgatcaaatcaggctaagcatggtggctcacgcctgtaaccctagcactttgggaggctgaggcaggcagatcgcttgaggtcaggacttcgagaccagcctggccaacatggtgaaaccccgtctctactaaaaatacaaaaattagccggacctggtggtgggtgcctgtaatcccaacttaggaggctgaggcagcagaatcacaggaacctggaaggcggagcttgcagtgagctgagatcgcgccactgcactccagcctgggcgacaaagtgagactccgtctcaaaaaaacagaaaagaaactggtcaaatcagatgttactttttttttttttaaatgtgcagtgttatctgcactccttccttccacaggcaggagttctctgaaatccagacgctgcacgttttatttcccctaatttaaaccaggggttcctgaacatgagcgagtgttcatcacctcaagcgcctgtagaaatgcagatccccagcccccagagaccctaagtggaccccagatccccagcccccaggtgaaaaacccatcccccaggtgggaggtccggccccaggtgaggagcccggccccaggtgagaggtccagccccaggtgagaggtcgggcccccggatgagaggtccggcccccgggtgagaggtctggcccccaggtgacaggtccagccccaggtgaggagcccggccccaagtgaggggtgcagccccaggtaaggagcacggggctgtgacgcgtggacatgcgcggtgaggcctcaggaatccagcgccagcgccagctcgggtcgcgccctcgcccgcctcctccctggtctcgccgcgcgcccgcctgaaggccccggtcgcggcagcgcgcactgacctccgcagctcccggcggcgtccttcgaagcgcggctgcctgggccagcctcggcaggaagcaggacggcggaaacagaacagagcccgaatctaaagtccttgcccaaatctaaagtggctaccgcagccccggccgctacggccgcagagaccctctgtgccctgagtaaagatggccgccgcgggctgcgcgc

SEQ ID NO: 1713 - DNA, 78937 bp, Homo sapiens
tttctggctgacaaagatatttattgagggtttactgggtacagcgagaagggctgaatggcttgggatgcagagagagacccctcccctgggatcctgcagctccaggcccctgtgggtggggtgggggctggaacctatgaacattctgcaggggccactgacttctccacggtgctcccttcttgcataacctggcagctgtagcttctgcgggacctccactgctcgggcgtcaggctcaggtagctgctggccacgtacttgttgttgctctgtttggagggcgtggtcttctccacgctctgggtgatgagggtaccatctgccttccaggtcaccatcaagattcccggataaagttattcatgagacacaccagtgtggccttgttggcttggggctcctcacaggacggcaggaacagaatgaccgacggggtagtcttgggctgacctgtgtggacagaggagggggtgagagatggcagagggagtgtggggtgttgtggagcgcctctctctgtctaaagtctctgggagggttcatggtgtggccgtctggtccacccagggcctctccttccctcctcattccctcctttccactggagccctctgcagagcagacagccctgtgccttcctaggagcccttcccaagtcacctttcccaggtgtcctggcccagccctttcctctgcagcctcagtttccccgtgtgtacccagggcaggctgtgctccctccttcctggtttctggagtctgagtttggaatctaggggtctccctcacagcacacaaaactgacctggcagggtgtggggaggcccaagcctggcatggcctggagcttcccgtcccctggggcaccaggctatgccccagcctggcccactcagctctcctggtgaagcgtgggctccacccagacacaccctggggctctgccatcgcccctgtccccaccagcccaaccacaggacccttcacatcggctgggttcttggggctgctaacagacttcggggcaccgcagcccccatgcccactccagcagcctctgatacccctggacttcacctgtcagccgtggagttctctgcactcccgtttactccccactagtcacctcctgagtctaaggtgcccttcctcaaatgaaggtgggaggtcgacccttcaacagacaccgggccccagaggtgatgggactccagggacagacacatctctgcactaagagaccctctcctttcttgggactgtccagggagggctgggccttgggacctctcccagtttcacccatccctctgtgtccccatgtcctcacgacccagcagaggccacagagctacaccctagacccagagccctctctgccctccattggtctccccttgggatgacccctgtgtccacaggcccccgtgtggccctcccagcctggataggcatccagccctcagcctagaccctggggtcccagggactgtctctaaggccaccgtacggcccctcatcagaaccggcctctgtccctcattcagacatgtgccctgcccaatcccagcccaggccccaggaccaggctgtgtcccactgttggaacctgaaggcggctgctcccactgtgggagcccttcatgccagttaacctgagactagcccgcttcccccagaccctatggagaaaggaagggttccgtgcttaaggcttggagggcaaaggggaagaagccccagagaacgaaaacagatttttgcagagacaggagagggtgcgacaggctagggaaagttgtgagagccacgtacctaaaacagtgagctgggtcccactgccaaacacatgcttcactgaattatgcttggattgaaacccccagggccagcatctggcgccagtccaggagccacgctggagcaggaacctgctgggtgtgaggggcacagggctgcagtgtgtaggctgtgacccaggcacagggcaggggggtggccagtatcccagtagtgtcccccagtagtgtctctgtgcctgttctctatctgaggcaggtgccgcccacagccttggagtcaccccagcatatgtccccctctctgaagctgttggtgctgatggcaacgctgggcccagtaggtcccagcaactccctgagtgacacatcccctcaggcagctgtgccgtgtggctgaggagtcctcagctggctcggacctgtccacctcacttggcctcattttaagggcctctgaaatctgccacaagtgtctgcagtcaagccaagttgacttgctccctggaccaggacattgggtcattcctgactcaagaggagagtcctctgcttttgtatctacccatggagatgcagctcagtctcactttgttcatgaagccttttctgatcattcattccgtctgtccgtccatccatctgtccatctattcatctgtctttgcatccatctatcatctgtccattcatccacctacctatccatccatccataaatccatcctgtctaccaggcactgtttcgtgtactggggacatggtgtggtcccccaggctctcacccccatccatcccaggtcatggccaacaaggccctcctcatggtcatgtccaaggtccttctgctgtacctggtgtctctgctggatgtgacacagagctggcccctccttccagtgactcttttccccttgaggtctgactcccctttcctcttccccggcatctgtttctccacggcccatgcctggctgctgactccccagacccccacccagacctctttcttggccgtctttacactctgtgacccccactattgcccacatggtgaggctggagtctatctcagctccaaaccctctcagctcctcaactgcctactgaccttgcccagtgggctacccaacaggagtctcaaactaatcacttccagagatgaccaccttcccccagcccaactcattttctgtcttcatctcatcacaatgaccatgggcggtctcaaccccacagccagaaacctggagtccctggattcagtcacctcgcctcccacactgaaatggcttctgtgtacttagctactgcatctagacattcctttttttttttctttgagacagagtcttgctctgtcacccaggctggcgtgatctcagctcactgcaacctctgcctcccacgttctagacgattctcttgtctcagcctccagagtagctgggattacaggcatgcaccaccacacccggctaattttgtatttttagtagaggcggggtttcaccatgttggccaggctggtctcaaactcctgacctcaggtgattcccacgccttggcctcccaaagtgctgggattagaggcatgagccaccgcacccggtgacattccctttaaagctaaaataagactcaatataattaagaaacaataaaaccaccttctgagactctaaaaccacaaaaagtgtgaactttgcttttctggattttaatctcaaactctctttggtacaaggatttggtgttgaactggggcttactgggtgcaagttccctgccaggggttcagaccagagtgtttctaccttagaagctggtctagtaattggtattggttttgtgtggtaaatataagatttttaaaatttatttgttgacacagggtctcgctctgacacccagactggagtgaagtggcgccatcacagctcactgcagccttgatctcctgggctcaagcgatcctcccacctcagcctcctgagtagccggcaccacaggcatgtgctaccacgcccagctaattttcttttaatatttttttgtagaaatggggactcaccatgttgcccaggctggtctcgagctcctgggcctcccaaagtgctgggattataggcatgagccaccatgcccagtggtattttatttttcttttcctttttttttgagacggagtcttgctctgtcaccaggctggagcgcagtgatgcgactcagctcactgcaacctccgcctcctgggttcaagcaattatccggcctcagcctccaagtagctaggactgcaggtgcgtaccaccacacctagctaatttttgtacttttagtagagtcagggtttcaccatgttggccattatggtctcaaactcctgacctcgtgatccacccacctcagcctcccaaagtgctgggattataggtgtaagccactgtgcctggcctttatttcttattttcaaaaaaactttttttttttttttgagatggagtcttgctcagtcacccaggctggagtgcagtggcggcatcttggctcactgcaacctccacctcccgggtttaagcgattctcctgcttcagcctccaagtagctgggactacaggcgagtgccaccacgcctggctaatttttgtattttcactagagatggggtttcaccatattggtcaggctggtcttgaactcctgacctcgtgatctccgtgcctcagcctcccaaagtgctgggattaccggcatgagccaccacccccagcttttttttttcttgactgagtctcactctgttgcccagcctggagtgcagtagtatgatctcggctcactgcaacttccgcctcctgagttcctgggttcaagcaattctcatgcctcagcctctcaagtagctgggactacaggcatgcaccaccacacccagctaacttttctattttttacagagacagggtttcaccatgttggccaggctggtctcgaactcctgacctcaagtgatctgcccacctgggcctcccaaagtcctggaattacaggcgtgagccaccatgcccagccccaaaaaaatctttactcttttaaaactatgagaatataacaatgaagacaattaaggaatagacaagtgcatttaagaagtgcaatattgggctggcctccgtggctcacacctgtaatcctaacactttgggaggccaaggtgggcagattgcctgagctcaggagtttgagaccagctttggcaacatggtgaaaccccgtctctactaaaaatacaaaattagccgggcatggtggcgcatgcctgtaatcccagctactcgggaggctgaggcaggagaattgcttgaacctggatggcagaggttgtggtgagccaagattgtgccattgcactccagcttgggcaacaagagtgaaactctgtctcaaaaaaaaaaaaaaaaaaaaaaaattagctgggcatgggtgtgcgcctagtcccagctactcaggaggctgaggcagaattgcttgaacctgggaggtggaggctgcagtgagctgagatcgtgccattgcactccagcctgggcaacaagagcagaactccatctcaaaaaaaaaaaaaaaaaaaaaaagaagtgtaatattggctgggagtggtggctcacacctgtattcccagaacttttggaggccgaggcgggcggatcatgaggtcaagagatcgagaccatcctggccaacatggtgaaaccccgtctctactaaaaatacaaaaattagctgggcgtggtagcacacagctgtagtcccagctactctggatgctgaggcaggagaatggcttgaacccaggaggtggaggttgcagtgagccaagatcgtgccactgcaccccagtctggcaacagagcaagactccatctcaaaaaaaaaaaaaaaagtatatttatctctccctctctctcctgctacatagagccccatttccttttttttttttttttagacagagtttcacgcttgttgcccaggctggagtgcaatggcacaatcttggctcactgtaacctctgcctcccagattcaagccattctcctgcctcagcctcccaagtagctgggattacaggcatgcactaccacgcctggctaattttttgcatttttagcagagacagggtttctccatgttggtcaggctggactcgaacttctgacctcaggtgatctgcctgcctcggcctcccaaaatgctgggattacaggtgtgagccaccacgcccagctccatttttattattgcagtaaaacatacatagcatcaatatttccactttaactatttttaaaagtacagctccgtggcactaagtacattcacactgttgggcaaccttcaccaccatccatctccagaactctttcatcttcccaaccagaaactctaaacccattaactacagtcccacattcttccttccctctcgtcccagtaacatcaaatctactttttgtctatgtgaatttgcctattctaggtacctcataaaagtggattcaaatgacatttgtccatttgtgtctggcttatttcactaagtataatgtcttcaagtttcatccatgttgtagaacaggcaggtgcctgtaaccccagctactcgggaggctgaggcaagagaatcgcttgaacccaggaggcagagcgtgtgcacctgtaatcccagttactggggaggctgaggcacgagaattgcttgagtccaggagactgaggttgcagtgaactgagatctcaccactgcactccagcctgggtaacaatgagactctgtctcagaaaaaaaaaaaatcagtgctattttatcttcagtgtgttatgattaaacttctataattgtctattgcactaagtttattatttgtattaaactttagattcatggggtacatgtgtaggtatgttccatgagtacattgcaaaatgctaaggtttgggcttctagtgaacccatcacccaaacactgaccatagtacccaataggtagtttttcaaccccttccccctccttccctccccacctgtggagttcccagtgtctgttatttccatctttatgtccatttgaaccaattgtttagctatttatttatttattttatttttttgagacagagtctctctcctttgccccggctggagtgcagtggcgccatctcagctcactgcaacctccccctcccgggttcaagcgattctcctgcctcagccttctgagtagctgggattacaggcacgcgccaccacaccaggtgaacttttgcaattttaatagaaatggggtttcaccatgttggccaggctgatatcaaactcctggcctcaagtgatccacctgctttcccctccccaagtgctgggattataggcatgagccactgcaccaggcctatttttaaataatacttaattttctttcattttatttgctaataatttacagtagaattatataatgatgttgattttttttttgggggggacagggtctcactctgtcacccaggctggagtgcaatggctcaatcatgctttgctgcagcctcaaattcctgggctcaagtgatcctcccatctcagcctcccgagcagctgggactacaggcacgcaccaccatgcccagctaatttttctattttttgtggaggcagggtcttgctatgttgcccaggctggtctcaaactcctgagctcaagcaatctgcctgtcttggcttcccaaagtgctgggattacaggcataaaccactgtccctggcctaataatgtagaattttacttaatgcttcataatatgattttaaaagtttgtatctgaaatgtatttaaatatgtagtttgatcttttgaaaaacatttgaattcctaacagattataacatactagttgtgcccaggaggtggaggttgcaatgagcagagatcacgttgctgcactccagcctgggtgacagagcaaaactctgactcaaaaaaaaaaaaaaaaaacaactagttgtgttagggttcaaaccagagaagcagaatcagtagcagagatacacagattcatatataaacatatagggacacacatctgcatagatttataaaaggttggcttctggccgggcacagtggctcacacctataatcccagcactttgggaggccgaggcaggcggatcacctgaggtcaggagtttgagagcagcctggccaacatgatgaaactctgtctctactaaaaatacaaaaattagccaggggtggtggtgcatgcctgtagatccagcaactcaggaggctgaggcaggagaactgcttgagcccaggagttagaatctagccttagcagcctaacaagaccttggttctaagaaagatttaaaaaatagtccggccgcggtggcttacgcctgtagtcccagcactctgggaggccaaggcgggtggatcgcttgaagccaggagttcaagaccagcctggccaacatggtgaaaccctgtctctactaaaaatacaaaaatcagttgggcgtggtggcacatgcctgtaatcccagctgctcaggaggctgaggtggaagaattgcttgaatctgggagggaaaggttgcagtgagccaaaatcacgccactgcactccagcctgggtgacagagcgagaccctgtctcaaaaaaataagaaagattttaaaaataaaacacttttaatattttaattatttcttcctttagcagcacattgagaagttgagtaaactttttaaaacagttttagaattacagacaaattgccaagatagcacagagttcacatatacccttgtacctggcttccttgttatgaacatcttaaattaatatggtaaattgctacagttaaaaaacctggctgggcatggtaccgcacgcctatgatcccagcactttgggaagccaaagtgggaggattgagtcttggagttcaagactagcctgggcaatacagtgagaccttgcttcacttaaaaaaacatgtaaggtcaggcgcggtggctcacgcctaaaatcccagcactttgggaggccgaggcgggcagatcacctgaggtctggagtttgagaccagcctgaccaacatggagaaatcccgtctctactaaaaatacaaaattagccgaatgtggtagcgtatgcctgtaatcccagctactcaagaggctgatgcagaagaatcgcttgaaaccaggaggcggaggttgcggtgagctgagatctcaccactgcactccagcctgggcaacaagagtgaaaatccatctcaaaaaaaaaaaaattttttttaatgaaaaaatttttggagagatgtggtcttgccctgttgcctaggctggagcacggtggcacagtcacagctcactgcagcctcaaactcctgggctcaagcaattctccctcctcagcctccctggcagctgggactataagtgcataccaccatgctgactaaaataaaaaacaatttttttagagagatgcggtctcactatgttgcccaggctagtctcacacttctgacctcaggatcttcccaccttagcctccgaaagtgctaggatgtgataccatgcctggccccaataaaccaatactgatacattattatcaactaaggttcatcttgattcagatttctttactatttcccctaatctccttttcctgtcccaggatctcatccaggacaccatactatgtttagttcttaagtgtcctcaggattgctggagtgcagtgactccatctcggctcactgcaacctccgaccactgagttcaagcgactctcctgcctcagcctcctgagttactgggattacaggcacctgccaccatgcccggctaatttgtttttttgtttttttgtttgttttttttttgagagggagtctccctgtcgcccaggctggagtgcagtagggcgatcttggctcactgcaacctccacctctggggttcaaatgattctcctgcctcagcctcccgagtagctgggattacaggtgtgtgccaccacacactattttttttttttttgagacggagtttgagatggggtttcaccacgttggccaggctggtctcgaactcctggcctcaggtcatccacccacctcagcctcccaaagtgctgggatcacaggtgtgagccacccgcccagcttggctaggtttttttttttttttttttttaatgcagtagctggggtcttgctttgtgcccaggcctcccaaagtgctaggattacaggcatgagctgccgctcctggcctaggaggtcactgtgataccctgtttgaaggggacagggcctggacagggcagaggctgtgataggagccccctcttcccttcccatctatgactctcagtgtccttgcccagttttctccacttccattttattttttatttttagagacagggtctcactctgttgtccaggctggaatgcaggggtgtgatcatagctcaccgcagtctcaattcctaggcgcaaatgatcctctcacctcagccttacaagcagctgagactatatgcatgggccaccatgctgggctagttattttattactgggtagagatggggtctccctgtgttacccaggctggtgtcaaactcctggtctcaagcatcctcgcaccttgcctttccaaagtgctgcgattacaggcgaccccgctctgcctctccagtccctgaccgtccccactggccagccctggaaagcccagcaacaagggagccagggtggggcaggaaacacgtagcagcctcctctcgcgcccactttatttgggggcaggcgtgggaggacctaggcctgctgtgcctgtagtagcgcccgcacctggcagatctgccagtcgacgctggagtgctcagtgccatccagggcactgtactgctccacgctgtgcccgtattcccacatgcggctcatgtcgcctgagaacagggggctaaagagaggaagaggtgggccagggtgccaggccacctggagacagcgtggggaagggggtgggccgcacctgatggtctgcagctcccgtagtgacagctggttgagggcaacccccttggtctcggccatgaacatggctttccttggaggcctcgtgggcctagtggaatggcatctgagtgccgggcagaaaggtggcactgaggcagcttcgtccatgccctaatttgcctccactgcctgcaccctgtttttttttttttttttttttttcgatacaaaatctcactctgttgcccaggctgaagtgcagtggcctgaactcacctcactgtaacctccacctccctgtgggagaagaggagcaggggctcaggtggaggctcgggcaaggcctgcctgtgacactgggaccctgcaggcctgggtcacccctggaaaaagtgtcgtcctgcagcactccacctgaatgagggatccagtgatctcccaggacaaatcagtcttaagggaaaaagaggatggaagtggggccatgtgaaccaaggactaggtctgagctgtggggcctccggaggtgagggtttgccaggaacacccgaaggctgagcctctgtcactcagcatctccgagctgaggccagaacaggggagcaggcccgtgttgggtatgacttggccatgggaggtttcgtttgaggaccccagaaatagctggggctcattcaagggctgctctgaccagctgagacaccctgctcctcattcaagtaggtagggcagaggcagaggtgctgtgagtgatggtcctgttttcttactgtttttattttcagagacagggacttttctgttgcccagggtggagtgcagtggcacgatcatagctcactgctgcctcgatctcctaggctcaagtgatcctcctgcctcagcctcctgagtagttaggactacagagacatgccactatgtccagctaatttttaattttttgtaaaaatggggtcttgctatattgcccagggtggtctgaaactcctgggttcaagcaatcctcctgccctggcctcccaaagggctgggaatacaaatgtgagccaccacacctggcctgttttttgttgctgttgttgtttttgagacagcgtttcactcttgttgcccaggctggagtgcaacggcacggtcttggctcactgcaacctccgtctcccaggttcaagattctcctgcctcagcttcccaagtagctgggattacaggtgcccgccaccacgccaagctaattttttgtatttgtagtagagatggggtttcaccgtgttcaccatgttcaccaggctagtctcaaactcctcacttcaggtcatccacccgccttggcctcccaaagtgctgggattacaggcgtgagctactgtgcccggcctgttgttgttttaaataaaccagctttactgagatctcattcacaaataatttacccattttaagttcacattgtagcgtacaaccatcaccaaaaccaattttagaacattttcatcaccccataaagaaattctgtactcaaggccaggcattgtggctcaagcctataatcccagcactttgggaggccaagagggaagaatcacttgaggctgggagtttgagaccagcctgagccacatagtgagacaccccgtttctacaaaaaattttaaaaatttgcagggagtggtgcacacctgtggttctagccactcagaaagctgaggtgggaggatcatctgcgtccaggagtgtgggcctacagtgaactattactgaaccactgcactccagcctaggtgacagaacaagacctcatctctaaagacaatttaaaaagtcacaaagttaaaaattaggccgggtgcagtggcttatgcctctaatcctatcactttggcaagacaaggcaggcggatcacctgagctcaggagttcgagaccagcctggccaacaaggcaaaacccatctctactgaaataaatactaaaattcgctggatgtggtggcgcacacctgtaatcccagctacttcggaggctgaggcactggaattgcttgaacctgggaggcagagtttgcagttagctgagatcgtgccactggactccagactaggcgacagagtgagaccctatctcaaaagaaagaaaaaaaaaattaaagaaaccctgaactcagtagcagacactccctgtttctcctagcagccccgccccacctacagggtgacaatttgtgtgcccttgtttccccccaggtctgtgaaccaggggtcacagggagttgaggaagaggaggggtctctgacaacacatcagagactcctcagcagctccccatccaggtctgcaaggatcaaatccagtcccaaagacaccaggtgaaagcctgggatgaggccaatatgaggcagcctttggctcttttgccagatgggctagatggggacgcggagcatgggatgggagacgtggggcacaggcagggtagcaggtgagtctggctgctccaggcacagccaagctagtgccttagcttcctgcccttaaatccgcaaagggtgagttttctattttatttttgagacaagggtctcgctctgtcgcccaggctggcagtggctcaatcttagctcactgcaacctctgcttcctgggttcaagcagttgtcctgcctcagtctcctgagtagattggattacaggcgcccaccaccacacctgcctaatttttgtatttttagtaaagataaagagtttcaccatgttggccaggctggtctcgaactcctgacccacctgcctcggcctcccaaagtgctgggattacaggcatgaacccctgcaccggccccatgaagggtgagttttccttgccagctgagctagactgccatgggaatattgccgtctgcaggaaatgccccactcctggctgctctgcctcgaccctggagttttgggatgccccggtcccccagggcctggcacccccaccctgttcacccctgccacctaggtctgctgttcaggctgccatcacacctctctctgccccctgggtgtcccttgggtactcacacctctgcccaatcccccatagtcctgatgagctcccagaggaggcccgagagcgtgaagcaggtctgccacatccacaacctgaggtccgtgaccacctgtgcgaaaaggaggtagtgctcagggaaactgacatattacttccctggggagccaggaccactgctgagctctgactgccccctgggctccccaaggttgggacagcatggagttggggggtggaggggctagaggcacctggtcattccagctccatcccatgtgcgccttccctgcggtttcaccaatgatcacagaatgatggtgctaatgctcaaagtggccccgcgcaaggtggagaggggaggccaggaaggcagtggggctgcagggttcgtaccttcaggtggcacttgttggctgtgtggatgtcctcatcattggggttgagtttgaaggtgccctgggcccactcctcaaccacctatagcacgtagcagcaataccaggggtcaggtgagcaggcatcagcagccgagagcccctgccctgatcccaccttattcctgatgactgactgtccctgtccaggagctgagtcctggaagtgcaccctgggagggggcatctcgagcccagcacacctttacccataagccatgtgggccacagggatcattaaaggagagaagaggtcaaggcacacagttaaacagcacttgagtatataattagttcaacgtaaaaccatccatctcggccttggcgaggagccctgccttctccatgccccggctgtaggctctgctgccttgaatatccacctcccacaggtgctggtcgtaggctggatgtgttgaacttctccatgatggggtccactgcacccactctggccaggagagcagaacaattagtctctcctccaccatccagaacagtgcctcttgcagagtctccttgggaaacttaccaagtctgatggtagcaggggcatgggaccatcctaactgggaagacaaaaaggctgagaccttcccagagtcaccttgggagtgagcatgggaacatggctgaacaccaagacagagccaggctggactgcagtagtgcaacctcggctcactgcaacctccgcctcccgggttcgtgagattctcctgcctcagcctcccgagtagctggtattacagacacgcaccaccacacctggctaatttttggatcattagtacagacagggtttgaccatgttggccaggctggtcttgaactcctgacctcaggtgatcctcccatctcggcctctgaaagtgctgggattatgggcatgagccactgcgtctggccttgaagttggggtctttcccaccacatggcaccaccccaaggagatggtggcagggcccgaggcaccccgggaccagagcagagcttctggaacctttcctgccactgaccaaggtgccaggtgccatcctaattgatgacacaactctctggggtaggcaccaatacaatcccactatgaagagggggaaactgaggcacagggaggcatgcagcctgcccttacccggggagggagagccagggctgcagcccagcagtttaaagtcagaacccatgctcttcacccctgttccaccacggcctctgagcttggctctggtgtcctgaacttttgctgcagggacaggcaaggaggcactgacggtctccaccaagcttaagtgccctgcaactctctccctcacagcttggagtcagactaagagactaagatcccaattcctactgctcccttggctctgaagagcactctgacaccccccattgtcactggccttctaggaggtcactgggtgacccttactccccaggagccaagggtagagagatggtacgtaggcatctacattttgttcttatttttgagacacggagtctcacttggtcgcccaggctggagtgcagtggtgcgatctcggctcactgcaacctccgtgtcccaggttcaagccgattctcctgcctcagcctcccaagtagctagaattacaggtatgtgccatcacacctggttgagttttgtatttttagtagagacgggatttcaccatgttggccagactggtcttgaactcctggcctcaagtgatccacacacctcagcctccaaagtgctgggattacaggcatgagccaccgagcccagcccattttgttatttaaaaaaaattttaattcttttttagagacagggtctcactctgttacccaggctggagtgcagtggtgccatcacagtttactgtggcctcaaactcctgggctcaaccaatcctcctgtctcagcttccccagtagttcggactacaagcatgtgccaccacacctatacatttttgaaaaattttgtagggctgggtgcggtggctcacacctgtaatcccagaactttgggaggccgagacaggtggatcacgaggtcaggagatcgagaccatcctggctaacatggtgaaatcctgtctctactaaaaatacaaaaattagctgggcatggtggtgctcgcctgtagtcccagctactcaggaggcttggcaggagaatcgcttgaacccgggaggcagaggttgcagtgagccaagatcgtgccactgcactccagcctgggtgacagaaggagactctgtctaggaaaaacaaaaattttgcagaaaatatgttgagacaggatctatgttgcccaggctggtcttgaactcctgggctcaagcaatccttctgcttccgaaagtgctgggattataggcataagccaaggcgctggccacatctatgttttgaaagcgggcagaggccagggcatgggacagatcggggaagggtacagggcacctgggaagtagtcctagtgcccaggactgggggggagggtggggtggaggtgggcacgtcacttgactgacatcctttttgtggaagggactctacaatggccaatagggacatatgtcctcctctgtccccctgcaatgccccagacctctgttaaccacctggcctggggcctattataaaaactcagggttgggaggcccagatgggtggatcccttgaggtcaggagtttgagaccagcccggccaacatggggaaaccctgtctttactgaaaatacaaaaattagccaggcgcagtggcgggcagctatagtcccagctacttgaaagtctgaagcaggagattcacctgaaccctggaggtggaggttgcagtgaacagagatggcaccattgcactccagcctgggtgacagagcaagacatcttctgaaaaataatacagtacctatgtgatagccttgttttgagcattcaatcaggtaacatttgcaaattgcatgcataacatggtgcctggtgctcaggaaggaattgggaaatgccagcagttactaagggagggcaggcaggggacaggacatgtttcagctccactcctggttcttgtgtgcacccagagacctctaccgtgctctggccctgagctgtgaactgacccctccatgcccaacagccccagctgccaaaggactctgccctgcagagggagcctccgcccccaccccgtcttttgagctggtcctgccccttaccccacaagctgccccaccaagcctagatctccagcaaagcactaggtggggcctggatctttctgatcactggggccagccagtcagaattggagccagcctgcccctcagctgggagcctggcagtacctcccccagcggggtcctgggccaccctgcctgtattattagtaataaaaactgctaaatatgcaaggctgcagccaaaccaattagtgccaacctacaggaaggcctggggcaggctgaggtcacctggagtgctgggctggtccaacggcagaccactctgctctaggaccaagcgcctatccttactggcaggcataataggatgccactgggagatcagagtgaggtgcctccccttgggcactgaggagaagggaggcccagtgtggtagcagaaggtgctgctccgagccaggacacttctgggccagaatggtctcttcagggccaggggatggggcactgagttgggctgggttgaatgagcaacagtcaaggtcgaatgtacacgggaaatatcaattttggttttggggtttgtttttgtttgtttgtgttggtttgttttgagacagagtctggctgttgcccaggctggagtgcagtggcaagatcttcactcactacaacctccacctcccaggttcaagcaattctcctgcctcaacctcccgagtagctgggattacaagcgcttgccaccacgccaggataatttttctatttttagtagagatgtggtttcaccatgttggccaggctggtctcaaacttctgacctcgtgatccacccatctcagcctcccaaaggtgccggaattacaggcatgagccactgcacccagcccgcctggcccattttgtttttcttttcttttctttttttttgagatgaagttttgctcttgtcacccaggctggagtgccatggcatgatcttggctcactgtaacctccacctcccgggttcaagtggttctcctgcctcagcctacatagtagctaggattacaggcacccaccaccacccccagccaatttttgtatttttagtagagatggggttttaccatgttggccaggctggtctggagctcctgacctcaggtgatccgcctgccttggcctcccaaagtgctgagattacaggtgtgagccacccctcccggccccttgcctggcccaatttttaatatattacaggattgtggcaaccttgtgttgagctagtgtagtattggtgctatttttccaacagcacgtgctcacttggtgtctttgttcaacatttcggtaattcttattgcatttcaataattcttatcgcctcccaaattgctaggattacaggcgtgagccacggctcctggctgtttttttgtttttgttttgttttcttttgttttttttgagatgagatggagtctcactctgtctccaggctggaatgcagtggcacgatctcggctcacgcaaactctgcctcccgggttgaagcgattcttctgcctcagcctcccgagcagctgggactacaggggtgagccaccacgtccggcctggctgtttctttgtcctcctcctcctcttcctcctccgtttctttttcctcctcctgtttctttttcctcctccatttctttttcctcctcctcctcctccatttcattttcctcctgctcctcctcttccatttcttttccctcctcctcctgctccatttcttttccctcctcctcctccacctcctcctcctccaactccttctgctccgtttctttttcctcctccttttttttcccctcctccgcttcctcctcctcctcgtaggcacgagacaccatgactggcctggttgtttccttttcctcctcctgctcctcctccacctcccaaattgctgagattacaggcatgagccactgcacctagctgtttcttcttcttttttctcctcttcctcttcctcctcctccattttattttatttttagatatggagtctcactctgttgcccagactggagtgcagtggcctcactgcaaccttcacttgcctggattcaagcaattctgcctcagcctaacaagtatctggaattacaggcagcagccaccatgcccagataatttttgtatttttagtagagacgggatttcaccatgttggccaggctggtctccaactcctgacctcgtgatccgcccacctcggcttcccaaagtgctgggataacaggcctgacccactgcgcccagcccgcctggcccgtttcttttgttttctttttttttttcttaaaacagagttttgctcttgttgcccaggctggagtgcaaaggtgcgatcttccctcaccgcaacctccacctcccgggttcaagcgattctcatgccttagccttccgagtaactgggattacaggcacttgccaccacgcctgcctaatttttgtacttttagtagagacaaggtttctccatgttggccaggctggtcttgaactcctgacctcaagtgatccgccctcctcggcctcccaaagttctgggattacaggcgtgggtcactgcgctgggcctacagctcatttcttaccacataaagttttgcgcctctccacaaaactgccatcagggatgtccccagaaaccattcatcccaggcgccacgcagagaagagctgcttgttctccttttccctttacctcttccatctcacctcatcttgttcattcattcatcccttttccattctcacttttaagcgttaacctttcaaaaccctgttttcccctataagtaatgtcttgtaactcccgcaatcaccatatccttctccaacccaccaaactgccatcctgagtttatggtaagtccataaactaagaagaaatgggaaacattcattgcaaacctggcagcccctcatccacccaacgtgacagcacagatgttcttgtctttgaagacccccttttttttttttttaagacaggtctcactctgtcaccctggctcaagtgcagtggtgtaatcatagctcactgcagcccccaactcctgtgctcaggcgatctgcctgcctcagccacccaagcagctggaactacaggaacacaccaccacacctagctaatttgcttactttttgtagagaaggggtcttgctatgcttagcagactggtctcgaactcctggcctcaaatgatcctcccaccttggcctcccaaagtgctgggattacaggcatgagtcaccatgcccagtctaaagacttttaaatgctgccatattcaagatgtgttgaaactcacctgtattcgatgagcctgctttttgcaagtgagtaatataaaacagactgaaataccttaagcttctcaggctttgtaccttcctaaagtaaatccatgaggtccagtttttccttcctccttggctatgaaatagacaagaaaaaggcaagctagccatttacatctcactatagcagactctcctgtttgctttttgactgtatttgggaagcaggggcctgactgctttcctacttactaagcacaactcacttttcctaggaaatcctcaacgcaacctgcatggattaaaccagctcctcgctttgtttccaatattcttacaatcaaagtgtccagaatgggcaaggcaacctgaaaaaatgaggacgggtacattatcctatgagccaaactgccgcttacactggttagtcatgaaatcggcaaaattccagatgagctctccaaccacgtattttctgagtttttgatccagacccagatggtactgctctagcagacttttctggtagtcttcactgaacatcagaggtggatcctgggattcaaggcaaagagaatttaagagtcagaactggcagaattgtaaatgttagataaaaaataaagatccacttgatggtgaccaaaatatctgtcctcgcagggggctatagtgactgcaggactcactgatgctagggtaaagacagccagggaatgatgtaacccagagttaaaaaggaggtttaaaaaaacaacatattaattagtaactgctttatttataaatgtaatctgatattcactttttcttacttttccgtctctatctgctggtacagtcttaaggctgaactacgttagaagtaaaaatatgactttgggccaggtgcactggctcatgcctgtcatcccagcactttgggaaactgaagtgggaggactgcttgagcctaggagttcaagaccagcctgggaaacatagcaagaccccatctctacaaaaagtacaaaaattagccaagcatggtggaacacaactgtgctcccagctacttgggaggctgaggtgggaggactgcttgagccctggaggtcgaagctgcagcgagctgtgtttccaccacggcactccagcctgggtgacagagtgagaccctatcttaaataaataaataaatgtatgtatgtaaaattaaattaaaccaggctgggcatggcagctcaggtctgcaatcccagcactttgggaggtcgaggcaggaggatcacttgagcccagaagttcaagaccaccctagacaaccagtgagacccagtctctacaaaaagtctaaatattagccacgtgtggtggcacatgcctgcggttccagctacttgcggggctgaggagggaggatcgtttgagcccaggaggttgagcagtgagctgtgataacgccactgcactccagcctgggcaacacagtgaggctgtctcaaaaaaaaatttttttttaattaaactaaataaagttatcctagtcatatgtcaagacctcaatagccacatggtcccaaaacctctggataaaacctaattcccaaaacctgtggatattaccttatacaacacaagagtgactaataccttaagtggaaaagtatgttaaagattttttttttttttttgagacagagtctcactctgttgcccaggctggagtgcaatggcgtggtctgagctcactgcaacctccgcctcccaggttccagtgattcttgtgcctcagtctcctgagactacaggtgttcgccaccatgcccagctaattttttttgtacttttagtagggatgaggtttcaccgtgttgttcaggctagcctcgaattcctggcctcaagtgatctgcctgccttggcctcccaaagtgctgggatcacaggtgtgagctaccctgcccggccttttttgcatttttttttttttttttttgagagtgagtcttgctctatcacccaggccggagtgtgtggcacaatctcggctcactgcaatctccacctcccaggttgaagcgattctcctgcctcagcctcctgagtagctaggatacaggcatgcgccaccatgcccagttaatttttgtatttttagtagagatggtgttttactgtgttggccaggctggtctccaactcctgacctcaagtgatccaccctccttagcctcccaaagtgctgggattacaggcatgagccaccgcacccggcctaaagtatgttaaagattttgagaggaggagatgatcctggattatctagatgtgccctgaatgtgaccacagtgtccttgtaagacagacacacagaggagaggacacacagcagaggagaaaccagtatgaccatggagacagagactggagtgaggcagccacaagccaatgaatgctggcagccacaggaagtgggaagagactgtgaaaattgtcaaaatagagctgcggccacacacagtggctcacacctgtagtcccagcactttgggaggccgaggtgggtggatcacctgaggtcaggagttcgagaccagcctgactaacatggtgaaaccccatctctacaaaaatacaaaagttatctgggcatgatggcgggtgcctgtaatcccagctactggggaggctgaggcgggagaattgcttgaacccaggaggcggaggttgcagtgagccgagattccgccactgcactccagcctgtgcaacagagcaagactccatctcaaaacaaaacaaaacaaaacaacaaaaaacaactctgaaaaatagagccagggaaaggccatgaagagaggactctcgtgcacaagtgccccattctcggctgggtgtggtggctcatgcctgtaatcccagcactttgggaggctgaggtgagaggattgaggtaagaggattgcttcagtccaggaggctgaggctacagtgagccttgacagtgcaactgcactccagcccaggtgatagagcaagaccctacctcaaaaacacaactcacaacattacacaaaggccatcacaaccttacacaaaaaatacttctgcaaagacatctgcccaggagtggcctgtccagcctcagactagtgtcacccttatcactgatcctagtagccaaggatgataattccaaaacagttatataccaaagctaagctatgaggaagcaaacacataagaatgatataatgggccgggcgcagtggctcatgcctgtaatcccagaactttgggaggctgaggcgggtggatcacctaaggtcaggagtttgagaccagtctggagaacatggtgaaaccccgtctctaccaataacacaaaaatcagccaggcatggtagtcccagctactcgggaggctgaagcaggagaacctcttgaactgggaggtggaggttgcagtgagccaagactgcaccattgcaccccactccagcctgaaagacaagagcaaaactctatctcaaaaaaaaaaaaaaaaaagggtctgggagccaagatggccgaataggaacagctccagtctacagctcccagcatgagtgacgcagaagacagtgatttctgcatttccaactgaggtaccgggttcatctcactggggagtgccagacagtgggtgcaggacagtgggtgcaggacagtgggtgcagcgcactgtgcgtgagctgaagcagggcgaggcatcgcctcacctgggaagtgcaagcggtcagggaattccctttcttagtcaaagaaaggggtgacaggcggcacctggaaaatcgggtcactcccacccaatactgtgcttttccaacgggcttaacaaacggcacaccaggagattatatcccgcacatggctcggagggtcctacgcccacggagcctcgctcattgctagcacagcagtctgagatcaaactgcaaggcggcagcgaggctgggggagaggcacccaccattgctgaggcttgagtaggtaaacaaagcagccgggaagctcgaactgggtgaggcccaccacagctcaaggaggcctacctgcctctgtaggctccacctcttggggcagggcacagacaaacaaaaggcagcagtaacctctgcagacttaaatgtccctgtctgacagctctgaagagagtagtggttcttccagcacgcagcttcagatctgaggatgggcaaactgcctcaagtgggtctgtgacccccgagtagcctaactgagaggcacccccagtaggggcagactgacacttcacacagccgggtactcctctgagacaaaacttccagcagaatgatcaggcagcagcatttgcggttcaccaatatccgctgttctgcagcgactgctgctgatacccaggcaaacagggtctggagtggacctccagcaaactccaacagacctgcagctgagggtcctgactgttagaaggaaaactaacaaacagaaaggacatccacgccaaaaacccatctgtacgtcaccatcatcaaagaccaaaggtagataaaaccacaaagatggggaaaaaacagagcagaaaaactggaaactctaaaaatcagagtgcctctcctcctccaaaggaatgcagctcctcaccagcaatggaacaaagctggacagagaatgactttgacgagttgagagaagaaggcttcagaagatcaaactactcggagctaaaggaggaagttcgaaccaatggcaaagaagttaaaaaccttgaaaaaaaattagacgaatggctaactagaataaccaatgcagagaagtccttaaaggacctgatggagccgaaaaccacggcacaagaactacgtgacgaatgcacaagcctcagtagccgatgcgatctactggaagaaaaggtatcagtgatggaagatgaaatgaatgaaatgaagtgagaagtttagagaaaaaagaataaaaagaaaggaacaaagcctccaagaaatatgggactatgtgaaaagaccaaatctatgtctgattggtgtacctgaaagtgacagggagaatggaaccaagttggaaaacactctgcaggatattatccaggagaacttccccaatgtagcaaggcaggccaacattcaaattcaggaaatacagagaacgccacaaagatactcctcaagaagagcaactccaatacacataattgtcagattcaccaaagttgaaatgaaggaaaaaatgttaagggcagccagagagaaaggtcgggttacccacaaagggaagcccgtcagactaacagctgatctctcagcagaaaccgtacaagccagaagagagtgggggccaatattcaacattcttaaaggaaagaattttcaacccagaatttcatatccagccaaactaagcttcataagtgaaggagaaataaaatactttacagacaagcaaatgctgaaagattttgtcaccaccaggcctgccctaaaagagctcctgaaggaagcactaaacatggaaaggaacaactggtaccagccactgcaaaagcatgccaaattgtaaagaccatcgaggctaggaagaaagtgcatcaactagcgagcaaaataaccagctaacatcataatgacaggatcaaattcacacataacaatgttaaccttaaatgtaaatgcactaaatgctccgattaaaagacacagactggcaaattggatagagtcaggacccatcagtgtgctgtattcaggaaacccatctcacgtgcagagacacacacaggctcaaaataaagggatggaggaagatctaccaagcaaatggaaaacaaaaaaaggcaggggttgcaatcctagtctctgataaaacagactttaaacgaacaaagatcaaaagagacaaagaaggccattacataatggtaaagggatcaattcaacaagaagagctaactatcctaaatatatatacacccaatacaggagtacccagattcataaagcaagtccttagtgacctacaaagagacttagattcccacacaataataatgggagactttaacaccccactgtcaacactagacagatcaacgagacagaaagttaacaaggatatccaggaattgaactcagctctgcaccaagcggacctaatagacatctacagaattctccaccccaaatcaacagactatacattcttttcagcaccacaccacacctactccaaaattgaccacatagttggaagtaaagcactcctcagcaaatgtaaaagaacagaagttataacaaactgtctctcagaccacagtgaatcgaactagaactcaggattaagaaactcactcaaaaccactcaactacatggaaactgaacaacctgctcttgaatgactactgggtacataacaaaatgaaggcagaaataaagatgttctttgaaaccaacgagaacaaggacacaacataccagaatctctgggacacgttcaaagcagtgtgtagagggaaatttatagcactaaatgcccacaagagaaagcaggaaagatctaaaattgacaccctaacatcacaattaaaagaactagagaagcaagagcaaacagattcaaaagctagcagaaggcaagaaataactaagatcagagcagaactgaaggaaatagagacacaaaaaacccttcaaaaaaaaatcaatgaatccaggagctggttttttgaaaagatcaacaaaattgatagaccactagcaagactaataaagaagaaaacagggaagaatcaaatagacgcaataaaaaatgatacaggggatatcaccaccgatcccacagaaatacaaactaccatcagagaatactataaatgcctctacgcaaaaaaaaactagaaaatctagaagaaatggataaatccctaggcacatacaccctcccaagactaaactaagaagaagttgaatctctgaatagaccaataacaagctttgaaattgaggcaataattaatagcttaccaaccaaaaaaagtccaggaccagatggattcacagccgaattctaccagaggtacaaggaggagcttgtaccattccttctgaaactattccaatcaacagaaaaagaaggaatcctccctaactcattttatgaggccagcatcatcctgataccaaagcctggcagagacacaacaaaaaaagagaattttagaccaatatccttgatgaacattgatgcaaaaatcctcaataaaatactggctaaccgaatccagcagcacatcaaaaagcttatccagcatgatcaagtgggcttcatccctgggatgcaaggctggttcaacgtacgaaaatcaataaacgtaatccagcatataaacagaaccaaagacaaaaaccacatgattatctcaacagatgcagaaaaggcctttgacaaaattcaacaacacttcatgctaaaaactctcaataaattaggtattgatgggacatatctcaaaataataagagcaatctatgacaaacccacagccaatatcacagtgaatggacaaaaactggaagcattccctttgaaaactggcacaagacagggatgccctctctcaccactcctattcaacatagtgttggaagttctcgccagggcaatcaggcaggagaaggaaataaagggcattcaattaggaaaagaggaagtcaaattgtccctgtttgcagatgacatgattgtttatctagaaaaccccatcgtctcagcccaaaatctccttaagctgataagcaacttcagcaaagtctcaggatacaaaatcaatgtgcaaaaatcacaagcattcttatacaccaataacagacaaacagagagccaaatcacgagtgaactcccattcacaattgcttcaaagagaataaaatacctaggaatccaacttacaaaggatgtgaaggacctcttcaaggagaactacaaaccactgctcaatgaaataaaagaggatacaaacaaatggaggaacattccatgctcatggataggaagaatcaatatcgtgaaaatggccatactgcccaaggtaatttatagattcaatgccatccccatcaagccaccaatgactttcttcacagaattggaaaaaactactttaaagttcatatggaaccaaaaaagaacccacattgccaagtcaatcctaaccaaaaagaacaaagctagaggcatcacgctacctgacttcaaactatactacaaggctacagtaatcaaaacagcatggtactggtaccaaaacagagatatagaccaatggaacagaccagagccctcagaaataatgccgcatacctacaactatctgatctttgacaaacctgacaaaaacaagcaatggggaaaggattccctatttaataaatggtgctggaacaactggctagccatatgtagaaagctgaaactggatcccttccttacaccttatataaaaattaattcaagatggattaaagacttacatattagacctaaaccataaaaaccctagaagaaaacctaggcaataccactcaggacataggcatgggcaaggacttcatgtctaaaacaccaaaaccaatggcaacaaaagccaaaattgacatatgggatctaattaaactaaagagcttctgcacagcgaaagaaactaccatcacagtgaacgggcaacctacagaatgggagaaaatttttgcaaccgactcatctgacaaagggctaatatccagaatctacaatgaactcaaacaaatttacaagaaaaaaacaaacaatcccatcaaaaagtgggcaaaggatatgaacagacacttctcagaagaagacatttatgcagccaaaagacacatgaaaaaatgctcatcatcactggccatcagagaaatgcaaatcaaaaccacaatgagataccatctcacaccagttagaatggcgatcattaaaaagtcaggaaacaacaggtgctggagaggatgtggagaaataggaacacttttacactgttggtgggactgtaaactagttcaaccattgtggaagtcagtgtggcaattcctcagggatctagaactagaaataccatttgacccagccattccattactgggtatatacccaaaggattataaatcatgctgctataaagacacatgcacacgtatgtttattgcggcactattcacaatagcaaagacttggaaccaacccaaatgtccaacaatgatagactggattaagaaaatgtggcacatatacaccatagaatactatgcagccataaaaaatgatgagttcatgtcccttgtagggacatggatgaagctggaaaccatcattctcagcaaactatcacaaggacaaaaaaccaaacaccaccatgttctcactcataggtgggaaatgaacaacaagaacacatggacacaggaaggggaacatcacacaccagggactgttgtgggatgcggggagcggggagggatagcattaggagatatatctaatgctaaatgatgagttaatgggtgcagcacaccaacatggcacatgtgtacatatgtaacaaacctgcacgttgtgcatatgtaccctaaaacttaaagtataataataacattaaaaaagaaaaaaaaaaagaatgatataacggggtccggcatgctggctcatgcctgtactcccagcactttgggaggccaaggcaggcagaccacctgaggtcaggagttcaagaccagcctggccaacatggtgaaaccctggctttactaataataccaaaacaatttagccaagcatggtggtgggcgcctgtaatcccagctggtggaaggctgaggcaggagaatcacttgaactcaggaggtggaggaggttgcagtgagccaagaccacaccattgcactccagcctaggcaacagagtgagactccatctcaaaaaaaaaaaaaaaaaaaaaaaaaaaagaatgatataatggactctgggtactcaaggggaagagtagaaggggagggggatgagggataaaagactacacactaggtacagtgtacactgcttgggtgatgagtgtaccaagatctcagaaaacaccactaaaggccaagtgcagtggctcatgcctataatcccagcactttgggaggctgaggcaagtggatcaattaaggtcaggagttcaagaccagcctggccaacaggatgaaaccccgtctctactaaaaagataaaagttggctgggtatggcggctcatgcctgtaatcccagcactttgggaggccaaggcgggtgaatcacctgaggtcaggagttcaagaccagcctggtcaatatagtgaaaccccatctctactaaaaatacaaaaattaggcgggtgtggtgacgcatgcctgtaatcccagctactcaggaggctgaggcaggagaatcgcttgaacctggaaggtggaggctgcagtgaggtgagatcacaccactgcactccagcctgggtgacagagcgagactctgtctcgggaaaaaaaaaattagctgtgcatggtgctacatgcctgtaatcccagctacttgggaggctgaggcataagaatcacttgaaccagggaggtggaggttgcagtgagctgagatcgcgccactgcactccagcctgggcgaaagagcgagactccatctcacagtaaataaataactaaaaataaaaagagaaataagtaaaaataacaaccaaacgacaaaacagtgcagtttattcaaagagacagagactcttagaactgagaaaagggccctgttgggctctagagacccacaccctgctctcggggtcaccgtcccctacccagaggctactgagacagtccaagcaaagaacaggtggctctatgcacctgggacacccgtgcccaggcagcctgcttacatgtggggaaactgagtctcagaggggctaaggtattgccgaggtccacttgcccggtttccagggcccatgcccccatgccctgccctgctcatctcccaatctccaagcagggcttggcacccgcagctgaacaggcctggtgtacacatggttgtcaggttccttggaggccgagggcagccagagacagaggccaacaatgagcagcaccaggaccacggccagcagacccagcaccactaacttcatcttcatgactctactgcatccacggggcaaggagcagggtcagacccagcctcagacactccctggcacctccccaacagagcacagtctaaagtcgggcctcagaaacacaagttcagtgtctccttctcgcctcccagaacgtgtgcatgctgtccagtcctgggagtgggcgcctccaaggaggagcagaggcagggaaggagcaggagctgccagagaacccataagcttacctagtcccagaggggacaagaggccagccagggggtgcccagcagccctgggggacagtgcaaggcatctacacagggtgcaggacaggcaggcctctcacagaggtccagcctagcaaggaggatggggaggctgacgtcacagcagcaaggaggcacacagtgactccgcacagtaactcagcctgtcaccaggtgactaaacttcatgcagccctgggagggccccgggtgggaggtgttgtgagccggggaatagggttcccacttcccaggctcagttccttccaaagggtgctgtctgcccacgagcccctccagtgagccccaggctgggtctctctctggctctccctgtccctgttcagaacatctgaactcacagccagtgtcccagagatggctctggaggcggtggagtagtggtgcccctggcactagaccagaacccagcctaaggggcctcaccacacgctgctgtcaatgctaaaggtgtgttccgggaacatggcctggggccctgagtgcagactggttctgctgcccatccagaaacattagcaccccaggcccaaggaaccacccgaacagcccagaaaggcagggcccagagagggcctgagctggcccaagctcacacagcccagcagtgcaggcttggccacttggtaactgccccaagttactgcatgtttctgaccagcccaccaagaagtctgagccaggaacagctgcggacccagcccaggggactttggacagtgctgcccattcccctgtggccctcatctgccaaggatatgggccagagtctccctgagtcatggctccctcccctgctcctgggcctgctgtgtctacggtgccggagagcccctgcagcctccacctgaggtctattccgtgcccataacacctaccccacaatcatccttccaggctgccccagctgacagaaggggacatgaaggctgacccaatattgctgcctgcctgggtcacatagacctgtcctgtcatccactgctctcaaatgggctctggacagaacccaccagacacacaactgtgagatcctcaatagccctagggtggaggtgctatgaccaagcccttaccctggctattcctccccctgaagatcagggtgactgggaagatgacagggcaggaaccaaggccccatgacctgtccctgaaggctagacagccaacaggaacatcaggggatttggccctcctaagtggctgcattccatggcagtcagccatgaggggtctaaagtggagagccacagggctctgtcccctgccccggcctgctcagcagtttcctctctgcctgagagcatataagacaggcaggattcacagcagcaggtgggcaggaagaaagtctgagtgcgcaaaggatggctcagacccccgcagctgaccccaaaaagaaaaccctgggctggggaaagtagggagacagagctgcctttgatggggcacagccgaagcctggcagcagctgaggattccagagaggggagacaggaggggaggcactttatcaaaggacatgttaatagaggtagggcctacagaacgaaggaggcttctcctcgcatgctgagtgtgtcacattctgtcccagtcagccctctaccccctgaatgcagagagggcacctagggggaagtgggtctggggaagccatgtcacccaaggaaagactgcaggggctggcctagaagtcttctgcagaccccacagctcttgtcctgggcacataaggtagtgagttccctgtccccagaaatgtgccagcctcactcacccagagacacagactctggtgtcagtatcacccacttccaacacacgtgcaagcacgtgcgcacacacacaactgagcctaatctaggctgagcagagcagcttcccaggatgcagcagagagaggagtatgaggaagagatagacatggcagccagtctgaagtttcctggttaatccttcaacccagcttgatggctttgtcaccacaaccccagagccacaagggtgaaaccagagcacagccccaaccccattcacaggcaggaaactgaagcttagacaaaagggatttaccgaggtcagctggccccaggaggtctgcagacctgtaggtaagcccaggacccacccatcccttaccctgccagcccccagcctggagtcactatccctgggtacgagaacgcacagatctctgtggcttctccaggcctgtctacatccctggactggacgcttactacccagacctggagttggaatccatcttccacgctgtctacccatgcggtgcagtgttgagaattagaaaaaacaccccttcagtaagatttaataaccactacctgctggaaacctgttgaaagaactatatatatatccccatatatatagctgagaggtggcaggcaccccctggagttgggcaatgaccccttgcacaaatggccctgccccaccccaatccacagccacaaacagaacccaggagtgaggcaagcatggcccaaggacacagggtcccccaaccccatcacagctctggctctactccagagctgaccccccgcccccattcagggctgccagatcctcctgggtctgtttcttcatgctgcactctcccctccttttttttttttgagacagagtctcactctgttgcccaggctggagtgtagtgacacgatctcggctcactgcaacatctacctcccgggttcaggtgattctcccacctcagcctcccgagtagctcagattacaggcacgcaccaccacgcccagctaatttttctatttttagtagagaggaggtttcaccatgttggccaggatggtctcgatctcttgacctcgtgatccgcccgccttggcctctcaaagtgctgggattacacgcatgaccactgcgtctggcccactcttccctctcaattccaagaagccacggctctctcaagggcttcttcgaataagtcaggtgactctgccccagccctccctcacccaccggcatacctctctcaaacccacttagccaagaaacagaggcgccccctagcccagacgcagttggatagagaacccagggctctccccttctgtgggatccctctgcaggatgtgcccacgtgagtttcccccttcaccccgaagtgcaactcactcccactgcacaggtgcataaaccgaggctcggagaggaagaggaactcctctagagcacagcaagcatacggcagagctgagaatggaactcaggcctccagacactcctgggagtcccctggcctgagcttccccacttatgatgtccagcatctcagagagagtgagtggctcctccgggtcacacagcgctgggccacagccagctgccctcactcactggctcaccagactctggatctggtcgtccagcagcacactaaaaccaagctaagattccccgctgtgacccagctcctctcctccccgcctccccaggcagcatgggggcgggcagtgcggtgcgggggaggcattaaaggcacaagaactgctgcaggtgggacaatggctggctgctggtcccatccctggggctgtgtgatctgggaccgctgcaggtctgagtccggtggggtctcaaaccctgaatgagagacctgaactctgaaagcctcggtggggctgaatgaggctgggtttcagtgggaggcagattagaccaaaggttccctgggagatggggccacagagctgggctgcagccagatgcccacgccaggaggggctggagatgtaagcatctgaggccccacaaggtctgaggagcctagatcacctctacaaccccagggcaggggatgcctctcctaacaggccctctccccagcttgcagggctacaggtggggctctaggagctgtcactccaaggaccctggtcacctggactgaagggagtcacatgatccaggagggtccttcctcaacccccaatttcaagggtctgagcagacaggctgacagaggaccccagacagtgggagcagggggatgaggcccatccatccatcacgccctcacctgctctgccccattcaatgagatggggtgggtgcccccacagcactggcaggcccaagcctctcagccctcagatcgaggtccacacatggtctgcagcctgccagtattgtcactcttagcaaggtgcatacttaccttccttctttcattccatcattcattctctcatcaaatcctggcccctccagattcttctctcaaggagccctgacctggctgggcatgagacagtatggtcaccccagggggaagagccctacggaaggggcagacaccagaatagggcccttgggaatccagccggaggtgggattggatttggggaggacctgacaggcagaaggaaccacctgagcctgaaggccaggaaatggagccttttccaggaagtgagggctgcaggggacctcttgaccaccctaggcccgtcctgagccccgaggtgtcaaagctggaaaaggaggtggccgagctaagaccttcaaggccaggccagtctggactttgagagccctgggaggctggtcaatgtgtcaccgggcccagtaaaccattaaccctggctcactcattaagaccctggtgggtgtccattagctccttggccggtttcaggagccgggcagagggtaggggtcatgggaagaagggagtgctgattggggtgctaggtagaggctggctgagctggctctctgtgtccttattccttgaggagcgttccagggccaagctggcctccagccaggggcagctgcaaacacagcccggcgggggtgccgccccaccatcctagtgactttcatcttcttatcactcctgtgtactggcaccagcagcccacagtgcctcgggggcctcagcctgacaggaggctcaaggggccagtccagtgcctggctcagcacccagccacactgcccctctgagaaatgggcccaatgtggcctccaaagccttgtctgtttcaacgggctgggatctgccccacctctgtatctgggaaaacaaggccctggtggggcaagaagggagctcctggcataggaacctgcaggctgagaggggaagggacctgcccaaagccactcggcaagacagtgacccatgacaccaggaaggctgtgcaaaccacttcctgcaactggcgtctcattgcagccccaccccactgtcaggtccaggaagctgaccacaggaatcacccggaaatcctcgtgccctgagtgggccatgggggcatgacatcctgaactgcagtcatgaggctcacaatgagcgagcaatgcggatgggtccagatgcaagctgtgcctggcccatactccagaaccgctggaacaacatctcagggacccctgggagccagaaacccaatattatctaggacattttgtgtctcctggtgtcctgcaccaaggagacacttggtaaactggctaaatagaactgacttcaaatccaagcatcatagcattggagtcaatattaggatcacggaatctcaagtgtttgccctctgatcttccagcatcccagaaaggtcagcttacataccttccccaatggggagctcactacctccaaagatagtgggactgtgtttggttggcgagttcttcccaacattaagtgccaatttgcctctttgtaacacctgctgcaggtgggcctggcctcagatcctgcccactgtcaaaggccacagagcagagaaacaggggccaccccagatcctgtacctggccacaaattctctgagccacaaagaccacactgaaggaatgggaggaagacttcagctcaatggaagggctggtgccactcagcttgacggagggaggtcagcacaggccaactgtgggcatgggcagagctcctgtgcccccagagcctggccaacacccccagtgccatttgtagcatttgttattccagcacccacctgtgatgtgaggacacagactgaagcatggccaagtgcgtgggcccttcagaattgtcagcttgtgaatgcctgggagcacccagcagcagggctggcctggcacttgatggaacaagtccaactcccaaactcagaggcaggatggcagaggcatgggccctagagtccctgggttcaaactcaaccccagccactgatagtgtgggtatcacagcagcctttcccttcctggcctcagtctcctacctagagagcagggataactagaacagttactaggtggattccctgagacggccacgcacagactgtagggagcatctgctactttcaagacctcacagggtctcgccaggctctgacaccaggcctgtaggagcttctcacctttcctgatgagcagctcagagcaggggcccaaagggtacccctcctggccgccctgtcctccctgaccaggcaccctccacaggtagtatttatcacatcacctggtaattatctgcagtgtctgaaagctccaaggaggggttgggggtgcaggaagactgtccatgcctcagccccgacactatcccacgtcctggtctccaggaaagccaacccgaacccgctcatgtctcaaggcctccctggtgacatgcccaagcacacctgttcacacacagccccgtgacttcactgatgccaaaactgcgcagcactttccacgcacgccatgctctcatctggacttttggggacctccccctgcctcatagcagcaccttcccgacctcccttgcttcttggatactgggctcaggaatgttctcactgacgagtctgcgccctgctggcttatgtttcagacacaccagatggacgtgcccaagcctgagctaagcagctgcctccccagacctcctaccaccagggcagccagagtctagccctgggcagctgcccctgcatcctcactgggcctgtccagctgctcccacctctataccccactcccagcctcacctgatccccagtccccacaggccacccctctcacctggagactcccaatcacaggtcccagcccctctgctgtttccctactgcagccctggcaatcggcatgcaaatctgagcacacccctcccccactggaaaaaaaacactccagaggtcccccttgtcctaccttgctggcacccgtcctttcctcctttttttttttggagtggggcagctggatatgaaccgtcctttccccttgctccttcccggtctttgggactttgcactgactccattatcatggagacactcttcagacaccaatcacaatgccacctcctcctgaagccctccggcactgcatctcactctgcaggccggctgcgactgctgccccctccacagtatccacagtgcacaacaatcttcactgaatggatggatgccagctgtcaggtggctagctgtttttactaaaatgcatcttctaggactttacactgaatctacctagccacctgacagctggcatctctaatcttgtaatcccagcactaagggaggacgaggtgggtggatcacttgagaccaggagtttaagaccagcctgggcaacatagtaagaccctgtctttaattttttaattatatatatttttttacaagaccaaagaggacaaggtttggggagcttcatgtggaggccgacaggaaggtgaataagaactcatccaaggccaggcgcagtggctcatgcctataatcccagcacttccagagggcgaggtgggtgaatggcttgaacccaggagttcaccaccggcctgggcaatatagagagaccccatctctacaaaaaaaaaaaaaaaaattagctgggtatggtggcatatgcctgtggtcccagctacttgggaggctgagggggacgatcacttgagcatgggaggcagaggctgcagtgagctgagatagtgccactgtactccagcctgggcaacaacaaaaaaacccaactcatccatgtgtccaactccattaggacagaaacttctgtacttgggagtcttccagtctttgccttatattatctcttcatctgactgtttatttgtagcctttatttattttatctttttttttgtgatccgcccgcctcggcttcccaaagtgctgggattacaggcgtgagccaccatataccacgttctcacttcaagtgggagccaagcactgggtacacatggacatcaagatggaacaatagacactggggacaaccgcaggggctgagagggagaggggcaagcgctgaaaacctacatattgggtcctatctgggtgctggggatcattcataccccaaaccttagcactgcacaatatacccacataacaaacctgcacatgtaccccttgaatctaaagtgaaagttttttttaaatctcatgggattctttggaggaattaaaagaggttgagtccatccatgccccattcaaaatccaggagtggcttacaaatgctctggttttagagcttcaatatgagttttgtgatacaacacaaacaggcagaagggaactgtattcaatatacttgaaacgaaccattgcatataaaataaaacgataccatttgtggccaggcacggtggctcacatctgtaatctcagcagcactttgggaggctgaggagtccggcggatcatttgaggtcgggagtttacattcccaccaacagtgtttgagggctcccctttccccacgtcctcaccagtgttcattattgcctgtctttttgacaaaggcctattttaactggggtgagatctcattgtggttttgatttgtgtttctctgatgattagtgacactgacacaccactgtgccctcggctggccttagttcacttatacatctaacattcacacgactaaaatagtccccatgaagccaatagtgccattggtatcacgtagaaggatacaagacacgaaacaccgtgtgccagcagatgtatcctgcctgtgtctttagcaggaatcctcacggctgtccacacttcaggccaggagctattctctggatcctgctccccaagtgacacctcacgtgcaaagcagcaaggtcacatgggtgggcacagggctaccaagcttagaagcctgtgtcccaaaaagacactgagatttcttttaacagtcccatggtcaaagttttcaagggtcccagcaacggacatgcctagttacaaacaccactgcgctcagggaaacccaaagtatggtttacctcttgattttttctccaaagccagccacgaaaaagttgaccacagacttcaaaacatttctaacaatagcaaagtccaattgatggcagacttcaaaaattgcaaatactcttctctaactcgagatgcccccattgttttacaattcattcacagctctcccaattcagataatgatgaccaactctgggccatttttatttgtagtctggtaacccaacacagatgacattccaccttttccaggtttccaagggaactgactcagaaagttaacccaagttcatattcatttctagagaaagataaaaaaagttttctaactttattcatgcatacgcaatacaaggatccgtggaatttctgagagaccttcaacctcactgccaaattttcaagagctgtgacaaaccttaatgtcaaagaaagactgctttcatagcagcagaactgccatcacatctctcagctggatctgccacgggcttttttttatgacgtatcaactgcttccccatgtctctgagttgttgaaagtatcacagcggcaaacacatttttctttctcacttttttttttgctgttgagatggagtctcaatcggattatcccccaggctgaagagcagtggcgcaatcttggcccactgcaacctccgcctcctgagttcaagcgattctcctgcatcagcctccagagtagctgggactagaggcacatgccagcacgcctggctaatttttgtatttttagtagagacagggtttcaccatgttggccaggctggtctcaaactcctgacctcaggtgatccacccgccttggcctcccaaagtgctgtgatcacaggcgtgagccaccatgcccagcaggcaaacacatttctagttcatgcatacatatgccaggtgggatgaacctgccccggggcccctgatggtgctcatgggtagagcagggtgatccccaggtcccacgatggcatgggacctgatgctggcatcaggtggtctggcctgttgttaggccccctgctggtgcaagcacatgccagaagtggaaggcagggcaggtctatacccaggtccctgggtgaagtacttgggtacttgtggggtgggggttctctgggaggggtcagcctgtccttaggccctgtgggagcctgcatggacacaggttgtggttggtgggctggggtgatccccaggcccctgaatgtcatccttggggaccaggggcaggtgggctgggtctgttggcagtcctccctatggtatgtgtctgtgcccatggcaagaggtgggcagagcaatttccaggctcccaggtggcttgcttgggtggcagtggtggtgactggttgtgagtgggttgagtctgcattcaacagtcaactcagaaaccccagacaccattttccatgccaactggcctgtccaccactcagaaaggccctggacactgtgccatgtggctggccccgcattgggccaggcttccatgggaggcaggaggtctgggccctgccctggggagggagaagaatgggacacaggcagtggtcattgagcggaagagacagaatgagcacaggatgctgtgaggcggtaagtataaggaatcatggagctgaaggtgttcatctgacatataccagaaactaacataaggtaggaaaatacacaaaaccaactaatccaacaaaacttgggcaaagaactgatagacatttctgaaaagaaggcaggaaatgaacaggtaaaaaaaaaaagcttgcccacatcactaatcatcacaaaaatttaaatcaaatcacactaagacagcgtccccatccacataaaatgaatgttgccaaaagcaaaaacagaatttttaaaacgcaatcacaagtgtaaatttacagagagggaaactcttagacactactggtgggaatgtaaatgggcgtacacactatgagcaatagttggcagttcctcctcaaactaaaaatacaattactatgtcatctagcaatctcatcactgggaaatacaaagtacatggatgtattatgctccctgattacaaatgacatagaagagctatagtggtccaaacaatacggtattgacattaacacaaaaatacagaacaagacacaacgagggaaccaaataccaaacccaaattcatatatgatggacacatttttaacaaatatacccaggggatgggagaccccgggctgccttcggttggggctgcagaagtgtcctggggggacctgcagccacctctcacctgggctctggatggtttctactccatgaggatttccagagtttcccctcagccaccctcagagtcaggggggcttccatggggctgcaaccatctgtcccagtctttcctgtctctatgacacaccgtgtgacctgtgtacactgcgagatgtaggtgcgtgcattgaaaccgtacagttaagatgacctacaactgatgctactctaagtcttccagagatttttcagatatccccagagtaaaccaaactagtgatatcccatggttttgcaaaccagaaccaacaactgcacagaaacagctccttatgcgccatcagacactctccagacctgcccctcactcacaaatgtaacaaagcagcatgaacccaggcagtcttcactcctcagggccacataacaacctctatcggtcaggaagcctttgatctgggccaggctgccgacccacaggggttaattgtgcctctcatgctgagtgttgtttctcctcactggactaacccccacccttccaccaagaagggcccccagggaaactgctgtttgacatccaggagcccatgtggaatgttccagcaacctggatggccttggccacctctaataccagcctttccctctgtggggctcccttcctggctcttgctcatgcaagtcaatctaaagtggctgagatgtcctgctccctcaccctcctgggtcaccctgatggcataggcaggtgtctgcattcaagaacgagttacccacaggccaacttccctggtgtgggggacaatgcctggggcctccaaacagccagccccaggtaaacaatccagctctgacacagctcaaagactgtgtggcgtacctggagagactctctggtcctgtgccctcttctggctcactggattcttaggattattgagagactgggcttaaagctctcagcctagggcccacaatgccacagggaatcaaatcagcatgaccagggatcgaagacctctccttggctgggaatggggaatcagggttgcagagacaaggggcacagagagatgcctgtgccatcagagaagggactggggatctggtccactctgggctcctcaacctgagcgtgaggccttgctgtgccatgagctcacctgccccttgggagtccactgtgactgcagtccagtggggtcaatgtccacactgatgccggaaagaagtcctgggagatgcggagggcatcctgtagcggcaggcagtctgggtggtccacgggtgtgagcttcagcaggtcctgggaagggatgaggtggtgaattgggggccgtgtttttggggttcgatgagaagctcctgggggaatgctcagtcctcaccaaaagaattcaaagggcaggtactcagggacccacactcgtgcctgcaaaatctgaactgaaaattagaatcggagcagcagggttgattctaaaaggggctgggctcgcttttctccctgctgcagtcattactcgtttcccctggcagaggcagccgggtggaggctcatctcttcaagcagctgggagagacaccccactacccaccctgcagctgctccaaggatactggagacaaaaagacaggggctggggaagcaagatgttcctgcctcgaccaagacagcaattggccaaatgccctgaccctgctggcatggttaccgcaggccaggcaggcatattcagggctcaggatccctctgcctgacttttcaaatgggctgttctcagtgactctggccccctcccaccctgggctcactcttgagaaactcctaagccttctctggcccttcaggggccttaacgcttatgtgtaggaccaggatgctctgagtgacctacttggtcaatgggctgctacagcagagctgttggggaaggcagagagaaaaaggacaatgacagacaaagaaccactcaacacctcagagaccagctttgtcccccacccaaccgccttgctccccacatgaacacctgcttgcaggaagccaaagtgggtccacagcagcccacctctgttctcactcccagggcagacaaagcagcaagaacaggtgacacacagccccggtgaccctgtcccctccctacccgtgcctactctcccatcaaacctggcttcgagggctgcccgccagtcctgtccaggccttatctggctcagagcagatgatcccctgcacctcccaccctgaatcacacagctacacccagcacatgctacagaggcccagcacactctggatcacatccagaaactccacaataggggaggagacatgctgtttcccaggaagggcagctccccagacttggtcattctcagactcctccagtcaaaggccgggcacagccagctgggatcgccatgcttcactctgacccacacgactggccttgcctcctctatgggaagagacccctcagcacaacctcaaaccgagacataacaggacaggacaggctggatgctagagaggccagccagatctccacacaaaggctctgctcttaagcaggaggtagcctgagggtcaaaggtttcctgaagcaactcaggtgagacctcacatacaagagccccaaagaggctgcaaaagcaccagctcagccagccaagaacccaggtgtcacacccttctcagaccactgaggatcgctgggattcagcaggaaaaggtggacatgacagctgatggaccaatacttcccaacacccttccagcaagcagctgtgccccgcccctccccacatgagtcactcaacttcagtcctgcacatggatgcctttgaccatggggtcatggctttggtctcctgccataggggcagtgagaggaacaatggtggtctgggaaggaggatcctagactgggtgtcccacaagaccaggctgtgacagatcccagagccaatactcatgcgccagccagtccccaaacccaacagctacccaaagcccaggatataaatagcctgtgcactgctaagcagatacttcagggaatgatctgctggctgtgaagaagatgcggcctcagtagggttccacgagccttctgccagcaaaatcttctttgcttggatgcccattagaaacactaagggagctcttcaaaggaacaggccagacatggtggctcacatctgtcaactcagcattgtgggaggctgaggcaggaggacagcttgaggctaggacttttaagaccagcctgggtggaacagtgagaccccacctctacaaaaaacacaaaaattagcatggcatggtggtgcatgcccatagtcccagctacttgagaggcagagaagggaggattccttgagcctgggagatcaagggtgcagtgcccatgatcatgccactgcactatggcctgggcaacactgcaaagtcccgctttcaaaaaagaaacaaacaaaacaaaacaaaaccaaagatgcctgtctcctgccccatcaaataaatccaaatctctgcagggtgacacagggtattaacattcttaaattttgcctttgctgaagtaaacatatagtaatggctgaaaaccactgcgttatgtaaatacacttcctatgacttatttgtagtccttttgtatctagcaatttctacagaccctctctgtgggcttcggaagccagaatgggcagggccaggtgtgaggtgtcctaggacactgagggtagagcacagctcccagctcagggggacccatttctgaggctaaggcacccacctggggctcagcctatcttcagagggaaaatcacacctcagaacaccagacacccaaaagaaagctccagttcggcagatacctgccaatagaccctggagtggctgccccagggaaaactgccattgcactgtcagctccctccagccctctctcaggtcccagcaggagcagatttctgactaagctcagaggtctcaacaaatggcaggttgaacatcagaggagttattaataggcctatagttacctcaagactccaccttaccagggccaaaaatgagtcctgggagggcagccagaaagaaagtagggcagagaggaaacacagggagaggggccctgggaccacgtcagatatggagggaaccaggggaacgagagcagccctgatgattgtactccccacagcccctgcatgcctgtgaaccctgagaattcagggtgaggagctcactcttgcctttcacctgttcctgggctctggcaggctggcctgcttcctgccccagcctcacccactctccgcactcctcgccactgatgtgggcagctgatctctccggtttgctgggctctcaccctctgcccaatggcaccaagttaacttcttcgcatgctttattttctgtgattaaaaagggaaacaattctcactaacgccatttctcagaggagaaaacaggcacagggatgttctatgacttcctcacgatcaccaagctacaagggggagctgggctttgaatggaggtctacccatgctcctaaagttgaggcgtcctccaaggaaaggacagcacctataaaagctcaatgaatggggcggcagtgtcaccactaagcccgaccacgctgctactctgatatccaacttccagcctccagaacagggagaaatacagttctgtttttgatgagctccccaggccgttacagctctttctttgctgtaacagcctgaactagcccagaagtgctattccatcatctgtgtcatattccatcattcagaagggagtcactaacccctcagtgctgtctctgtggacgctgcccaccctaggctgagatgaggcacagggtctgggtctaaataaaatgggaaggcactggaaggtgcaatgtcataggaggaggatgtctgaatttcatttaatctcaacctctactggtgcagcatgaaagatgaggcccagagcaaaagtgtcttttcccgagatcacactgtggaccccaggcccactggagttgcattagacgttacctctcaccccttcttgtatttgttccatttctaagtgtgtgcaatatccacagggaacaccacaccatgagtttttaaatatttatctcaaacataacctcatgagttccctaggaaagagatgctagcataacccccattgtgcatgctggggagaccccaaaacaccaaaggagttctctagggtctcacaactgctaaaataaaggctgtttgacccagcactgtctcctcaaacctgggaccctggttatatccaggtcttcccaaggtgctgaaggggcacactttttcataatggtgactacgtaaggagttgacgggggagggtgagcggtcagaagcccagaggggcctttgagtaggacttatggaaaggaggagcttacaggatggaacctacaagatgtgacctcacttccttgccgacagacccccaacagaacttacaattctggtaactaggcacccacattctagagacagccccatttccagctcacttcgtaggcgatgctcgagagaacaacatgttctcctgctgtatcccgacatgctgccgacctcctcgtcgcacaagaggccaaaatgagagtctttcccgagaatatagacattggttcaaccctcaccctcgacgcctctggccctttgccagaaggcacccacaggtaacacagggcccagggcaggcccatccaggctaggcctcagctgtgcccatcagggcagcctcaggcccctccccacttgtttgggggaaacaggagatgaggggccctccctggataggagcaggtaggttgtcaggtgtttggagcctggtaggtatgtcaggttcacagcccaggcagtgcctggcaggatgggaaggtgagtgtcaaggacacagtttgtctgctcagatctgaatcccaagtcctcaagctgtcatctgccggagacctcaggcttctctggctggaggtctatgcagatgctcctatgtgccaaatcctgttggggaagggggtgccagggatgagttctaatgggggtgtcccactgtggggtcagccagacaggccactgacacctcttggcccggctctcgggcactctctttgcagagctccacacaacagaccaaacaagagctgttggatggattcaatttctccatattcttcaaagggcacgtgcaccacaccaccaaccacgtccagtgccggtctgcggtgagattgggcacagaagggtctccacagacaggacttgtgaaaaccaaggtgggcccaggactcagacacgaatatggggactccctaagctccatcctagggcgttcccacttgagtgacccactgtcctctcccaaaggaatctggctgccattagtccccagtggcaacttggttacaggcaaagtccctttcacctatcagaggaagaccagagaaaatccttctgttttcactttaggctatgccaggagtatctcggcatgttgctttaagaattgagtacaatggtaacattgcagcaaaatactcacactgttatcattttaactccccaccctaagtggatctccggcaacaggcaggcagctccgctgccctgccagacctcctccaggacttaaaatccaacacttttgcacaaacaaggggtgggggtggggggggtgcattgattacaacaaaagaaggtgaagcgactctatgcattagtctttaaagtgtcatctcacagaactcatccctgcagccccatcaggcaggagttgtaccctcgcatgtcattgtaacattccttaagggaggccattttccacagcgggtcagcctctcagtgctggtggagcctgtcatgataaaattccctttcgaggcagcctttctacaaggagcataatcctatgcgtgtcctaataggctggagcagtttgccagggctgccataacacggcaccctgactgaagggcttaaccacagaaatctggttcctcacaattctggagactggaagtccaacgtcaaactgtcagcctggggtggtttctctgggcctctctccttgccttggagatggcggacttctatctcagtcagcacagggtcttctcttgaacttctctgtgcgctgaccccctctccttgtaagaaccccaggcatgttaaattaggggccaccctaatgaactcacttcacctgaattacctcttggagtactctgtgtccagacacagtcacattctgagtctctggggttgagaatagaaacagttacatttggggaaggggacacaattcaacccataaaataaacaaatcccctgcagcagacagacacccaggaaagggatatctgggtgaaaggatatgcagatatcaactttcaacagctctagctagttgactttccaaaagggctccagctggtcacacggtcaccagcagcctctgaaggtagctgcttctctgaacgcagcctcccctgaatactaacacgcttttaacttttcgccaacctgctgtctgtgtggcagagaaaatccttgtttcatttccactttcaaacatacatttgcgtaacctttcacgggttcaatacctgcctgcgttttccccaagtcgcctcgcagatcctgggccttgggacgcgcttcctcccaccctggagtcttccggcattttccccttggccagggctgggatggccgtagctgtttctccagactcacgttcatgttaaaggaacaaaaacaatcatatacctttaagtcaaagagttcttctagagcgtattgtcctgtgtgctgttgctgaaatgaggaggggatgaggcctccccaggccttgaggacttgcagggatgatgctcttcatgcaggttgctgacacagagggtgctgttgccccacagctgacaaacaccgggacgatgccttgaaggcaggaatcgttttatcattctccatcctcacatgcaatgttactttgaaagcctagaacgcttttcaccatgggcacccaggttctccatatgcacaagtccctgaagggttggtgcttcttggtgtgagttccagatcccgatcctctggtggtccatggtgttaccactgactcccatgtccctccttgtccccctagtatgaaaatgagatctgcaggatgctaactttccagcccggcactggggagaagctgttgggagtccctggttccagcctttctaactaaacccatctcctcctatgccacctgcctgggcccctcctgggactttatcactgtgccacactttttggaactactggttagaaggtgagtgtccatccccctccaagacacagaggtgcctctgtcccctactggctctgtcttgaagatgcacctctcggagcctcggttggctcctctggaacagggagtagtgagaagacgaacctcacagggttcttgtagggactcaatgatctaagacacagcaaacaaaggggtccctagagcctaaaactctggaaaatctgctgggggtgctgtgattcatgtttgttacttttctcttccccctcacttgaagcagctctcagcattctgcctcaatggcctgtatcactcactgtttggaaaaacacatagaaaccaagtctgcgatggcactggtaaaggatgtctgagattccttctggctggtctttctccttgacacagacagaagaggggtcccttggtgctgaaaaaggagccacaggcccactcagacatctggagaggctcactggggttctccaaaggttggggttcactcattcaacacatacattcaaaacacctcatttgtgcatcgctcttcttggggcttggcataatttcataaacaaagcagatgacaatcccccggccttgattctactcagagtcaggcactcacagtagacagaataaacaagtcatatctacagaatgttacaggtgagaccctcatggcctcctctacgtatggtggcatcctcccagattctgactagaatgacgcagcccagcaacaaatataaactgggtggatttagggttctgaagggccttttcacccacaaaacatgggggaaaatatgtggactctggctggggagagactaaaggagctctggggctcatacttcttataattcccacgagaaggctgacatctggggacttcccccacaagaggcaaatagtgagttctgtaaatggagacttaggtcccctgcaaagcagaggggaggctggggtcacagctggccactgagagacccatccccctcagcaccgtggcttcccagctctccctgtcctcctccccccgacatctgccccttccctcctaaccccaggaccaggggacccagatctggagctttgatgaggaagctgctcacaaatctgcctgcagctgcagtcttgagtgcccaggtgtacagtgctgtgctccagggcctttgggaagagaatgtctgtgggacgccagggcgcacgagggtctgtacagccctgctgtatggccaggtctgccccttccaggacagcactgatggcttacggtagggtggggctgtcctccacactggcagcaacaggccagggacccagaaccacgcaggggtgccctggagggttgtgtgggagaaggccaggcctctgactcagctgtctactccatcaccagcaccatcacctccattttgttcaactggccccccgaaaacacttcagtttactatcagcccccgcaacggtcatctttccggataaagctggccttcaggaacctctcctggcctggactgggcttggaggaccatcaggaaattgtcctaggccagttggtgcttccggagcccaacgaggccaagccagatggtgagggggcttgcagtctgcaagactttccgggggtggtgttttggggctacaattcccttaaattccacccggtcatttctgtgcttggaaaacccagtgaaaaatgactggtgtggtgaccttttctccttttccagatcctgctccacgtcctgggcaacacgcattaacaatgccggccctggagccagcaccaccactgctggcggacctggggcctgctctggagccagagtcacctgcagccctgggtccaccaggatatctacattcagcaccagggccagcaccagcaccaggggaagggccccctccagggacagtgctggagccacagtcagccccagagtcctcctgtccctgtcgtgggtctgtaaagaaccaacccagtgaggagctgcctgacatgacgaccttccctcccaggctgctggcagagcagctgaccctcatggatgcggtgagcagctgagctttgcaggctgtgtctctggcaccagctgtctcagaccagcctctccctgaggagcagccaatgccctcggtccaatttcagccccacttcttaccaaccgtgggatctggatgagtttcctcacccacaagccttccctgtctgcatgtggacggcagagatgggacatcaccagcgccagctgcacagagtgactgtgcagactgagtgacaggagatggacagaaagcagggcagggcaggtgctcactgtggggcaggcagggccatgggtcactcacccagctgctcaggagcctcactaccctcagcacttattaggtacctgatgcatactggattctatggtagacacccaaacagagcccatagttgcagctgccacaaggaaagtgcaccggtacggagaggagtagtagagggctgattgggatgggaggaagacgaggcctcaggatgggcaggcctgagccaccttctagttcttagagtgtggatggcctgggagaaaatgtcactctctcttcccacccttgttgggttctaggccatgatgcattcaggtccctcgggggcagaaaaccaaacccagggactcccacaagtctggagcccattttaaagctttctgagctccagcttggttcctgccagagaccgtggatgactgtgagctcagtccctgcctgggactgtgggtgactctgagctgcagtgtgctgtgtccgtgacactctcctcctcccccaaaggagctgttcaagaaggtggtgctccacgaatgcttgggctgcatctggggccaaggacatctgaaggggaatgagcacatggcacccacagttcgtgccaccatcgcacacttcaacaggctcaccaactgcatcaccacctcctgcctcggggaccacagcatgagggcccgggacagggccagggtggtggagcactggatcaaggtggccagggtaagctatggttgggcctggggattccctctttaaaaatggggaacttcctcttctcctccatcggctttcaggatcggcatctgtatctctggcctggaccctgcacatcccctaggctcttcttgccagagcttcactcaccttgactcccacggcccagtggtggctgctcacttccgacctggggtcttccttgggttgaactaaaatcctcctagatgagtgacatccactcggccccaggtctgccctcctgaggctccccaggcctctgcttcatccaggaggggagatctcagcagagggggctgaggctgtagtgggccaagctccaactctgaaccgcacagctcattcttccctctccaggagtgcctaagcctcaacaacttctcctcggtgcacgtcatcgtctctgctctgtgcagcaacccaataggtcagctacacaagacgtgggcaggagtgtccaggtgaggagggctctctccatggcagcatcagggttgacctagggactcacaggtctccccccatgtgccctcaatgactctgaaaggttcttggagtccagggacactggaggcagggatgggccggtggctgtggtcactaagctgccctggactcctaggcaaggatttccaactcaggactaaggttttttaaccatcaggaacagactggagccaactggaggctttcaggtgtttgtacccagcagtggaactctgtgtccagctgaaagctaactgtaaacacgcagtggctcatgtgaagtggagatggggcccaggggaggagcatgagaggtcccaccctggtcctctggagcccctgtgatcagaggactccactgaaaactctcacccagtaagctgggattcactgggttttcaaacaaaagggactggaactcacaaatctcccctgattcccaaatttacccttctttctttcctctgcccatagcaaaagcatgaaagagctaaaagaactctgcaaaaaagacactgcagtgaagagggacctactgatcaaggtacagtggagtctgggagatgcaggacaagtgtttaagggtcagagaaaagagtgagtttggaagggcattggaccaggtgtcgagtggttattttgtttggttttgacttacctactaaaagtggacttgaaaaattccctccatgcctaccttgggccaacaggaagagtggtgtgtcggtccatgggcacgtgggggcatgggggcaggaggccctggaaatgggatgtggcaatggctgctgggctgctgggctgctgagcaggggtgatgagctgcagcattagcagggctctggctcccatgctggtccatgctgctggcatggagcttcctccaggctggagggtgatcatggtaggtgggacttccttccttcctcaaaccggccagcaattcctcaggaagccaggcctctgctgctgctgctgctgctgctgctgctgctgctgctgtctgcagcacacctccatgggcagggggccttggcctgcactgggggagagggggaacaacaacagaggaagctcatgtggcagggagtccagtaactgcccagctttgggtaccaatgggcatactggggacagacgtagctgtttgctgggactccccactctgccctttgcagacacccaaaaacggtcatgtcagaggattctcaccggttagcagcgacgcatgctcatgacaagtatctgggggattcatacattgctaggggatcctccctgaccagatctcagaatcgtccatgcaaatgagaaggcaacatgtcaccccacccaggactctggaaaaccctgccattgcagtcagagatggcgcatcaggaggctacttcctcagtggagaaagagagagttccgtgcacggaactcccctgggggatcattggcgaggcgaagcctttggcatggctcaaacccagtttgcgtggcagagattccagtggggctgggataggcaggtgccacttaaccaggtctcctaaaatgccctgtccctttcccatcacgactgtatgtggctggagacctagacactcaaagactccagagaacacgaccctgatgggtggtggtgctgggatgtgagctgaaggcagccgagacggagcctccaggagcagaaggaggcgtcctctctttgggggccctggggagccactgcccgctctgggcctctgtttcctcatctggaaaatgaagggatgctgagcctgtagtgcaggcctcacagggtagaaatgaagttcaagaaaagaaagcaatttgagggtgctcgtgcctggttcttcctcagagggatgacggtgagaacaacggcaacagctacaggaaactgagccctcagaggccctgtgaggtagctgtggtttgcatcactctttacagaagaggaaacagtctcagggaggcccggctgcaagactgggtgacacacacagggagtgtggatctgggccagtggtatgagcacggtgccaggtggctcccgccactccctggggatccaagtgcggggtggctggggtgtaactgggggagaggaggagagcctcactgtccctgtcgctgacacctggcaggcggggagctttaaggtggccacccaggagaggaacccccagagagtccagatgaggctgcggaggcagaagaaggtgagtgagcctgtggcatggacgggccgcaggggatcagaggacagggctcccttccccgccagctggaggcctccatatcaagacagcgggggcttcctccccagccctgtcctcctgtggccactgggcctggaaaaccttcatttgagagaccagaggaagggtctgggaaagctggactcagactagatgtggggaagggtaaagctgggaccacaggcctttgtgacttgttaaaatcccaccatagaggttaacaaggagtgcttgctagacttggaggtcagctgggatacaggaggcagagaattgggaaaggcagctgagggtctttggctgctccaaccgggagacctgaggagggggctctgggagacaggggctgatgggatttcatgggacaggaccttgggcaggcacctgagggccaatactcatcaccactacccctcccacctccccacccctccttggcacagggtgtggtccccttcctgggggattttctgactgagttacagaggctggattcggccatcccggacgacctggatgtgagtgagcctggggcagggtgcttgggaaccaagatcctgaagcttgggaggagagggtcctggaccgagcctttagatctcagcccttggcaaacctcctctcctaagagcctcacagctgctcctgtgggtgggggtgtcaggcccatctcatcacctctgagtgatggaggctccatggcagccaccaggccctattcctgagtggtgaagctgcagagctgcctgactgcaaagctgctgaggtgtgggctgaactgggctcagcttctccctagggtagtcccgtaataggagggtgaaattgagcctctccaagggcaggcagttccaaggtcactgagcgctttctttctatgagagacctcagtttccctgtctgtcatcacagagggttggggcagaaggtccctgggcctcagctcccattccccctgctctagagcccggagcctgaggcaggtccaagtcctgtcgtgtgcacatcccctgaccctggtggccctggcagtagtgcagcatgggaaggggtggggtggggctggttgtgggccaggggcctttctgatggactctgtctgccttccagggcaacaccaacaagaggagcaaggtgagcagctggggcactcacgttggatgagggtggggatgtggacgtcacagtccaccctgggcaggacactccctggctccatcctctacatcttaggcttactgggagtgtttgacacacacaggaggaggggacctatcccaggagaaaatgggaaaagcactggaatcaaagaccaattcctgcaggaggggctgtttatatccaactctgagaacaggctgggggcgctgcatgggaccccttcagaaaactgccccagggaccagccccttctccctgcctgccaaaggcccccacagcaacttccacccaggccctgtcagcatcctgtcctctgtctctaggaggtccgagttctgcaggaaatgcagctgctccaagtggctgccatgaattacaggcttcggcctcttgagaaatttgtcacctatttcacaagaatggagcagctcagtgacaaagagaggtgagggcctagcccatgggctgagggtgggagaaggctctccattttttttttttaacatggtctggctctgtcgcccaggctgcactgcagtgtcaccatctctgttcactgcaacgtctgccttctgggctcaagtccttcctcagcctcccaagcagctgggactaccgctgtacaccaccatgtccggttgttctgctgttgttgttctggtacagatggggtttcacgatgatgtccaggatcgtctcaaactcctggcctcaagcaatccacccacctcagcctcccaaagtactgacgttacaggtgtgagccaccccacctggcctagaggaggctctcccgtggccagctgcagagagcctatggccatgcctccacggccagcatcaagccctgttgcatggggaccactggggacccaggattccagctgggcaggcactgacaggggacctgatgtgtggctcatggtggcctcacagctgcttctctgtcctgcagctacaagctgtcctgccagctggagcccgaaaacccgtaggctggcaacatcctgcagtggctgggaacccaccgggatgctggccagaacaccggctctgcaccatccctcacccagaccgtagacaccagggaaccacatctaggaggctggcagctcagctgcatcttgccctggatcctcatcaccaactgctcctgctggccaggatcaggccatgggacttttgtgagtcaggcgggagaccattttatgtttattttctttagtgtataagtaagggttttttcttaactttcgttaaaataaaattttaaaaaactattcaaaatgttctgtagttgttggaatgagaaaagtaactccagtgcggtaaccatataccagtctttaggattcatagcctagcatgtcaaattgaggctatggctgaacaagttatggaatagcattcacattacacatgccaagcatttaatgttttccttctttattcaaattattgttaactctgcttaagaaaacaaacagaacaaaacaaaaccccttaaaagccatagtatgtcacccaatctatgtcacccatagtatgtcacatttgttctactgaccagctattctcaaacttaaattctagttaaattcaagttccactgggttactcaattttcttaaggtttaaatatttaacaaatcacttaaatatttactgaagggctggagatgggaggtatttaagcaagtggtagggctggccttctccagaagtcctgggcagaagggagctggccatcagtctccacgaaatacagataaactttttccactgtggatcttcccagaccttctgacacctctcccctaaatgaacatcaaggaaggtgagaactgtttgaactcagtatctaaaagatgtcccacagcttaatttgaacacaacccccattgtgggatatcagacaaaaacatgccaaagaaatcaacatttcagggtctgaaacatgtaatacccccaaatcaacacaaaatagacacctaaatccaatcctggagccgcaaagctcctataagaaaagcgggagtttctatttcggcaaaacttgtatctatgcacgcagtttgcaaaaaagaaagaaaagaaaaccaaaaattatctatggcaagaaaccctttgaccatgcaattgatttggcaatactttttcttattttttattctttttggatggaaaacaaaaatgtgaatacaaacacataggactaaacatcattttagagcttccgcatggggaagagaaacaatgaaccattaaagaaggcatcctacagattgaaagaaagttcagcagaatcatctgtgaaaggggttgttatctaacatgtacaagaaactaacactactcttaactggaaaaatgaacaaaacctaatacccaagctaaaactgggcaaagaacctgaacaggcacatctgaagagaaaacacgaaattgactgacaggtcaaagagaagttgctcaacttcactaatcctcacacaaatgtctaactgcaaaccagactcagatacctctcactctaattagaatgaaacttaccaaaaacaacaaaaaacccatatgttcacaggcagtggccaacgtagaaacgcagaaaaagacacttttataaactattggtgggaaggtacattactagacacacgaagcgaagcagttgaaggtgccttaaacattttacattacaactacccgttcacctatcaatcccaccactggttatacacagaaagcgcatggaatctgttatgttgaagagatatcggccttcctatggtgactgaagcactactcacaatagcaaaggtatccaatccacctacctgttcatgcacagataaagggataaagaaactgcagcacgcagtggaatcctcttcggccgcagaaattcatgaaatcatgtcatctgcagcaacgtgcagaaacctggaggacatgaccttcaacaaaatgagtcaggcagagaaagacaaacagcatgatttcatgcatgtgagaatgagatcaactttctctctaaacgactttatctcctagaactagaaagttccacagtggtgaagagaggcggggggttggggagtccgggcaggaactgggaaatggatacaatgttacattcagatgacaggaataaattcagctgttctactccacagtagggtgtctagagttaacagtatcctaccatattttccaaaaaaggctgaaaagaaggattctgcatattgcaacgacagagaactaataaataataactacacaaggtaacagagacagtcaatgccttgctttcatcattacacaaggtatatatgcatgatcaaaatgtcccactctactctttaactgtatacctttactacagagcaaattggttttaaggacacagaaataaacaatgctggagttcatgtgacaccaggaaatgcccggcatttccaaagcaattctgagaaatccaaactacattggatgcatcacattctctgatttgaaatttcactcaaactctagggacctgcttccacatggatgagtggaagagaacctgaagtaaacccacacacctcatacgacctgattttggatgaaatacacaatgataagtaatggggaaagaactcccttttcaatagtcttggggtaagtggcgagccatatgcagaacagtaagtaacactaggcctctacttctcaccatgtgcaaaagttcactccgatgaatgaaagatgtaaatggaagacctcaaactacaaaaatcctacaagagaccctaggaagtacccttctcgacatcggctttgacaaagcatttatatgcctaagaccccacatgacactgcaacaaaagcagtaatcaacatgtgggacctaatacactgaagagccaccgcacaacacgacaaattaccaacagagtagacagacaacatacaggatgagagaaaatgttcccaaactatgcacctcaccaaggttctaatatctagaatctaccttaaagaccttatagaaatcaattagcaaaaccccccaaataactaataaatagacaatggatatgaacacacacttcttgaaagatgacgtacaagcaaccaacaaatctgaaaatatgctcaacctaactatcagagaaatataaatcaaaagcacaaggagatatcatctcacactggtcagaatggcgattacacagttaaaaaaaaaaaaggacactggtgtggcagcagagaaaggggacactggtccacttttggtgaaaatgcagagtagttcagacaccatggaaagcacttcggagattgctcaaagaacttaaaccagaactaccatctgacccagcaatcccaccactaggatatacacaaaggaaaatgaatccttctgaccaaaacacacatgcacacaaacggtcctggcagcactatttacgatggcaaacacgtgaaatcaacctaggtacccatcaacagtggatcagaaaaggaaaatgcagtacatatataccacaaaaagctaggcagccattacaaaaaagaaggaaatcatgtccttggcagcaccatgaaaggagctggaggccattatctaaagagaaataaggaaaaaacagaacaccaaatgacacatgttctcacttacaaggtggagctaaaattgaatacaccctaccgtaaaagtgaaaacagcagacactggtgactatcagacgaaaaagaagggacaaggtatgtgctaaagacctacccggtgggtgcacctgttccctgcgtgataaggtccctgggaccccaagtctcagtggcatgcagtataccaaaggcagtaactaatctgcctttgtaccctttagtctataataaacgtagaaattatgttaaaaaatacacttagaagctaaaaaaatgaatgaaaaacacaagcttttataattatccaaacaatcctttattggtataaactaagaaagtggacagaatgagtaaaccaaatactcaaccccaatttacatatagtgaacacattttttcaaaagaacaccaaaaagacacaatgggaaaaagagactgtttaatagatgattttgagcaaactgaatattcacatacaaaacactgaaataggacccttatgtcatgcaacacaaaaatcaatgcaaaatacattaaagacctaaaactcaattctgaaaccacaaaactcccacaagaaaacagggtgcgcatgtattttagaaaagaaatccatgcacgcagcctgctaaaggtataaacaaaacattaaaacaaaggaaacactctaagaaaacatccatagacaatgtaatggcttggcattttcactgaaaagctggggacccggttccacagagcagtggaacagattagaagacccagatataaacccgcacaactgaaaccatctgatgcttgaaaaaaatcaacaaaaataagcgatggagaaaggactccctatcagtaagtggtgctgggataagtggctagctggatgcagaagaaataacactgggcccctgtgtctcaccatgtacagaaagcaactcaaaatgaatcaaagattgaaatgcaaaatcccaggctgagcacggtggctcatgcctgaaatccaagcactctgggaggcagaagtggtcagatgatttgtggtcggggagttcgagaccaccctggccaatatggtgaaatcccgtctctactaaaaaagcaaaacttagccgggcatggtggcacgtgcctgtactcccagctacttgggagactgaggcaggagaatcacttgaacccggaaggtggagggtgcattgagccgagatcgctccattgcattccaccctgtatgacagagtgagactcggtctctaaataaatacataaatacataaaaatccaagacctgaaactataaaaaaatcctgcacaggaatctagtaaatacccttctcgacagaggcttcggcaaagcatttatatgtcaagtccccaaaaccaatggcaacaaaaacaattactgataagtgagacctaatgcacaacagagctgctgcacagtacaagaaactaccaacagagtaaacagacagcctatagaatgagggaaaatattccccaactatgcatctgaaaaacatctaatatccaggatttatcgtaaagaccttaaacaaataaaaccagaaaaaaaaaaaaaaaacaacttataaatgggcaagggacatgaacacacacttaaaaggaggtgtaccagtaaccaatgagcatgaaaacatgctcgatctcactgatcatcagagaaatgcaaatcaaaaacatactgagataccatctcacactggtcagaatggcaattacgacacacagtccacaacaacagaggctggaggggcagatgagcaaagaaatgcaggtccactgttgggggaaatgcaaactagttcagaccccctggagagtagtgtggacatttctcaaagaacttaaaagagaactaccaccccacgctgcaaccccactccgaaggatctacccaaaggaaaatccttccaccaaaaacacacatgcactcatctgttcatggcagtactactcacaatggtaaagacatggaatcggccttggtgcccatcagcagtggatcagagaaaggaaatgtggtatatacacaccacggaacgctacacagccataaaaaacaaatccatgcccttaccagaaacacggacagagccgtagtccattatgaacaaaaggcaagaacagaaaaccaaaattttcaaaacagctacaaaggtcaattgtgaatattctctccacagagaaatcataactctggagctcacagagatgctagacactgcaacttcattatgatgccacttttacatagatcaaattgtcccttacagcagctggttatacacacatactctacggcaatgaaattgctatcccattctggtaacattcattctcagtggagtgagatgatatctgagtgtggttttgacttctcgtgaggatcagtaatgttgattcagaatcttttacctgtgcatccgtctcaggtcttcaggtcctttgcccagtcttacacattaaattgaaacaagttcacaataacttggcaaacatcactcaccacaagcaaaatgtaaatcaaaaccacacttagataccatctcattctaactagaatgagtgttacaaaaaaagacaaaaaacattgaaagaaaggcaaatgctggtgtgtgtttccagagagagagagagagagagagagacactcttctccagtttgtgagaaggtaaactagtacacacgctacagaaaccacttggaggttcctccaaaccttaaaagactccaactaccatttcaaccagcaattctactaggaatacgctcaaagccattgaaatcaggacaccaaagatagatctacccacccatggggattccagcactgttcccaagagccagtataagcaatcaacctacctgcttatccacagatgaagggataaagaagctgctccacaggtacatactgggatactcttcagacagaaaaccacaatgaaatcatatcgtggggaaccacacggttgcacctggaggacatgatggtaaattaaatgagcaaggggggagagacaaaccttgagtcatctcactcatgcagaatctgagaaactctatctcaaagacctggcgaccacaatattggtttccagagattgggggaaaagaggggtaatgggcaggaactgtaaatgggtacaaagttacacataaatgagaggaagaaaattctgttgtgctattccactgcagggtgaccacagttaacagtatcagcacatcactttcaaagcagcttgataggagaatactgaaggttctcaccataaaggaataaacaatgggaaaaggtaacagaaacactaagtaccctgacttcatcattccacaatgtatgcatggaccataacgccccactctaccctctcattgtactgttcctttactatggaacacatttgtcgaaagaaatagaaatacacgatgctaatattcacgtgggaccatgaagcgaactgagtttcatcctcagcaatcctgagacatccagactacatcggatacatcactccctgatttcaaatttcatggaaaagctagggatccgcttccacacacagcagtggaacacaagagaggaccaagaagtaaaaccacacactgaaaactatctgatctaacacagaatccacaaaagtaagcaaagggaaaaggacaccctattcaatcaatggtgctgaagtaagtggctatcaatggtgcagaagaataacactgggccctccctctcaccagacacaaagaggaaatcaagatgaatgaaagatttaaacgtaaaaactcaaactattaaaatcttatgagaaaacttgtgaaatatccttctccacataggctttggcaaagcatttagatggctaagtcctgaagagcaaaggcaacaaaaacaaaaattgacaagtcagacctaacacctgaaagagctgctgcacaaaagagactaccaacagagtaaacagacggcgtacagaatggaacatgttcccaaactgtgcatctgaccaacgtctaatatgcagaatctacaaggcccttcaacaagtcaaccaggggaataaacagaaaaagaatatcccattaataaacgggcaagggatgtgaacacacactgctcaaaagtcgatgtacaagcaaccaacaaataggaaaacgtgctcaaactcactcattatcagagagctgccaatcaaaagcatgacgagatgccattccacgcaggtcacaatggtgaggaccacgcaggcaaagaacacatgctggtgaggcagccgaggaaaggaaacgctggtacacttccgggtgggatgaaagctagtacagacaccaccgaaagcagatcggggatgtctcaaagagctgaaaacagaactaccatctcacccagtaagcccactcctgtgcatctacccaaaggaaaattaatccttgtatccaaaagacacaggcactcgtatgttcacagcagtgttactcacaatgtcaaagacatggaatccacctagccatcaacagtggatgagaggccggcacagtggctcacacctgtaattctagcgctttggcaggccgaggcaggtggatggcttaagtccggaattcgagaccagcctgggaaaaatggtgaaatcccatctctacaataatacaaaaattagctggatgtggtggtgggcacctgtattcctatctaatcaggaggctgaggtgggaggatcacctgagcccggaacatggaaactgcaggccactgtcataagtgaactaaggcccaaatagaaaaccaaatgccacatgttctcacttataagtggcattcagagctaaactttgaatggactcaaacataaagaagagaacaacagacacctggaatgaccaccagaccaataaaaaaacaggggagaggaagagtgtgctgcagacccaccctgtgggccctctgctcactgcctgggttatgtggttgttgggaccccaagtctcagtgtcatgcaataaacagatgtaactaacttgcatatgtaccttttaaactctaataatgagagtagaaagcattaaaagaaaaatccaaggttagaacccaagaaaataataaatgaaaaaacaatctgtagttatccaaacaatccatgactgtcacaaacacagaacgaggacctaagtgacagaatgaggcagccaaatactctatccaacatgatatgtaaggaatacatttttcaaaaccccaaaaagatacaatgggaaaggaagagtctggttcaattgattttgagaaaactgaatatccacaggtaaaacactgaaatagggcccttacgatgcacgatacacaaaatcaacacaaaatgaattaaagacctaaactcaatcttgaaactgtaaaggtcctataagaaaatagagagcgggtgtatattttaggaaacctgtatctatgcaaacaggctgcaaaaggcaaaaaagcatcataacactaaaaaaaaaacacccacagacaatgcaaggcatggctgtgcgtgtgtgtgcgtgtgtgcgtgcgtgcacacacgcatgtttctgtgttttgtggaagtggggtgttaaacacaaaaatcactgctaacatatgcaactataaccatatgagactagggacactttgcaacttctacagggaaaagaaaacaatgaaacaaacaaaggcatcctaaagactgagagaaactctaaaaaatcctacccctgaaagaggttgttatctactacatacagtaaactaatatgactaagtgtaaaacaacaacaacaacaacaacaacaaatatccaaggtaagaggatctaaatagacctgagtgaaaaggtggcaggaaattgactcacaggtgacagtttctcaatatcactaatcctcacaaaaatgtgaatcaaaaccatactcggttaccatctaattccacttagaatgagtattacaaaagacaaaaatcaaaattgttgaaggcaatgatcagtgtagacttgcaggaagaaaaaaatcttctacactctttgtggaatgaaaattactatacactctataaaaaacttttggaagctccttaaaaaagtaaaaggtaggctgggcgcagtggcacacacctgtaatctcagtactttgggaggccgaggcaggtggatcacctgaggtcaagagttcgagaccagcctcaccaacatggtgaaatcccgtctctactaaaaatacaaaaattagccaggcgtgatggcaggtgcctgtattcccagcaactcgggaggctgaggcaggagaatcgcttgaacgtgggaggcggaggttgcattgagccgaaatcgcgccactgcactccagcctgggcaacaagagcaagactctgtctttaaaaaacaaaacaaaacaaaactaaactaaaggttaaagtacaactgccactccagctaacaatcccaccactgggtacatgtttagagaaaatgaaatccctgtgttatctgccttttcatgtgtcctgaagtactagtcacaatagccaagatgtggaatcaacctacctgtctatccacagatgaagggataaaggaaccacagtatatatacacaaggaaacacacttcagctctaacactttgggaaatcatgtcatctgcaaccacttggagaaatctggaagacaattaggtgaaatgaaatgagtctgctagggagacccacactgcatgacatcaggcatatggaatccaaaacacattgtctcctagaagcagaacttccaataggggttactacaggctggggagagcagggagcctgggcagggatgggtaacgggtacagagtgatgctcagatacgaggaatccattctggtgttctgttacacagcagggtgactaggtgactagggtcaacagaatctacaaaaatttttcaaaatcagctggaaaatacggttctgaatattctctccacagagaagtaacaatgatggaaggtcacagagatgccagatatgatgatttgatcatgatgctacatatacatgtcaaaatgtcccttgcactcttacggttgtgtgtgtttgtgtgtgtgtgtatatatatatacacatacacacacacatactctacagaaacaaaactgccatcaaatgttggtagtattcattctaactgcagtgagatgaaatcttcagtgtgattttcacttatgcttttgtgtgaatcagcgatggtgagaatcttctcttctacctgtgcctccacctcacgtcttcaggtcctccatccagtcctaacaacaaattaaaaacaaattcacaataacttagcaagtaccacttatcatacacacacaaaaatcaaaaacacactcaagattccatctcactctacatgcaatggatgctacaagaaaaaagttgaaacattaaagcacaaaaaaatcaaggtgtggatttccagaggaggaacttgtctccacagttgctgggaaacggtgaactagtacgcacactaaagaaaccacttgggtgttccttgaaatcctaaaacttcaactaccgttttctccagcaattctattcctaggtatatacacagagcacgtgatcaggacatggaagagattatctgtcatcccaggtggaattcagccctatgcccaaaagccaagataagaaatcagcctacctgtccatccacagatgaagggatgaagaatctctagtatacagacacaatgggatacttttgggccatcaaaattcatggaatcctatcatttccagcaacatggctacacctggagatactatgttcaatcaaatcagaaaggcagactaagaccaagcctgcatgttctcactcatgtaggagctgaaaaatttaactgactgaaggtggaaatacagcagtggtcaccacaggctagctggaggagaggatatcaaggattggcaataggtacacaataggtacacagagagttacaggagaggaatacattctggtattccactccaaagcacggcgacgatacttaacaacatgatcatgccattttcaaaacagctaccaaggaggatactgaatgttcacacatcgaggatataaaacctatacgtggtcacaagcatgggaaactccctgattttatccatactcaaggtatacaaacaagtatcacaatgtcccaatgcacccctaattctggacatgaagtatgaaacaaacgttttatgaaatgttaacgatacatggctaaaaattcacatggaaccaccaaagacccaaagaacctgaatatgcaaagcaatcctagggaatacaaactcaattggaggccgcacaatccccagtttcaaattacaagtaaaacctccactcatccaaagactacagtagtggcataaaaatgaatccacgaacctagggacgtaagagaacctaaacacacacctgtacgcagtcaacacatttttttcaaagaacacctagaagatgcaatgaggccgggtgctgtggctcacacctgtactcccagtgctttcggagaccaagtcgggtggatcacttgaggtcaggagtttcagaccagctttgccaaaatcgtgaaatcctatctctagtaaaaatacatgcaaaaccaggtaacccagccaaagttgggcaatgaacccgaagagacatttctcaaaagtcccagctactcgggaagctgaggtgggagaatcacctgagccccgggaggtcaaggatgtagtgagctgagattgcaccactgccctccagcttgagcaaccagagccagacactatctcaaaaaaaaggaaaaaaggagaaagaaataaactacacagagaaagacaaacatcacattttctcactcaggaggaatccacaaaactttatttcatagaactagtaagcataactgttcttaccacgggtgggggttgaaaggtggggcatagtcagagattggaaacggcataaagttacatactccgtgagaggaatgaaacctgtagttctattccacagcagcagggtgactaggtctaacattatcagagcgtacttttcaagaaagctagaaaaagaggatactgaatgtcttcacctcaaaggaataataactctatgaggcaagagagatgctaaataccctgatttcatcattacacaatgtacgcatggaccaaagtgtctcattctaccttctggtagtacacctttaccatagggtaaatttttataaagaaatttaaggaaacaggctgagcatggtggctcatgcctgtaatcccagcattttcagaggctgaggtaggtgcatcacttgaggccaggagttcgagatcagcctggtcaacatggtgaaaccccatctctactaaaaatacaaaaattagccaggcatggtggcacacgcctgtaatcccagctactttagggagactgaggcaggagaattacttgaacctgggaggcggaggtttcagtgagccaagatcgtaccactgcaccactccatcctgggtgacagcacaagactctgtctcaaaaaaacaaaaaacaaacataaaaaaaaacgtgtatttggccaggggcagtggtcatacttgtaatcccaacacaccaccacagggaggctgaagagggaggatcacttcagcccagtagttcaagaccagcctgggtaacatagagaaaccacatcttccctaaaaaataacaaaaattagctgggcgtggtggtgtgtgcctgcagtcccatcagccccaagtacttgggaggctgaagtgggaggattgcttgagccaggagtttggggcggcaacgagctacgatcttgacgcagggtaggtagtcaaggaagtgaccgtgtccttcggacgtgccaaccacggcgctgagacatctgatgtgtgaacaagcatgtacagctacagcccatgtgcacccagaggatgacccagaacgtgcttagagtaacacctcttccaactccttaggaattcatcatggaagactcccagaaagggagtttccccagtaataatcagcgctctctcatccttaggagcagactgccctgaatcctctctcagggtgaaccgtgtattttggacttcacgatctttttttagatggggtctcgctctgtcacccaggctgtctcagcctcccgagtacctgggattatataatggagtgttgcaatctcagctcactgcaacctccacctcccaggttcaagcagttctcccatctcaacctccctagtagctgggattacaggcataagccactgcacccaggctattctgcacttaacttgcaaaatacttttccctttacaataaattgctctatgctgcatcacctttgctgtgtgatttcttatttaaattcttttttatttattttaattattcattctttttgagacagggtctcactatgttgcccaggctggtctcgaacttttgagctcaagcggtctgctgaccttggcctcccaaagtgctgggatgacaggcattagccaccacacccagcctaaattctttgaaacttacaactgcggccccacaacagctgtcaatcatcgcaccactgccatccagcctgggcaacagtgcaaggcctcatctcacaaaaggaaaaagatatatttaaaaaaaaaaaaattaaaaaacatttttttttcttaaagacagggtattccagccatgtgcggtggctcacagctgtaatccttgcactttgggaggccgaggcgggtgaatcatttgaggtcaggagttcaagaccaaccaggccaatatggtgaaaccccatctctgctaaaaaaaaatacaaaaattagctagatgtggtggaaggtgcctgtaatcccagctactcgggaggctgaggcaggagaatcacttgaactcgggaggtggaggttgcagtgagcccaagattgcaccagtgccctccagtctgggctcctacagagtgagactctagcttaaaaacaaataaaaataaaaaagacagggtctccctctgttgcccagaccagagtgcagtggcgtggtcacagctcactgcacccttgacctcccaggctcaacagattctcctgcctcagcagctgggactactggcatgcatcaccatgcctgacggtttttaattttttgtggtgatggtctcgctatgttgcccaggctggtcttaaactcctggcctaaagtgatcctcctaccaagtcctccttacaaagagctgggatgacaggcgttagccaccgcacccggcccctcgaagctgcctgttccttgagcacaatgtgtagcaaggggagctagagtgagagcagcaccgtggggaagggacaggattgccaccctgagctgtgtgacgttaggccagacccctcttctccaagcgagatctaccacatgggtgatttcgggagcccacgccggctcagacagcctggattttagcttcataggtggatgggaacctatgaaggtttagagatgctgggagagctttccaaacagagaacaaacacagccaccctgggccccactgagggaggatcttaccagaagccctcaccactgtctcgcttcacgccggtggtgacggtgacgtcatcgatgtaggtggggggtgtcgtgtatagaagcagagaccacagcagtcctgcgtagctgaagaagtcaaagtctgtgttctggacaaagtaacccttgggatacctagggcgggagaattgtggttcgctgggcccttgccatgggtcttttgacctcagctcacatgcctccccagatccagggcctcctctctgcgaaggccaccctgtccctggcaggaagaccacagggtggggcgggaaggtgggtgcgtgcagtggaggcaggatggtccccacttggaggtgtcggtcatgtacagatggtccctggtggcagggttggggggtgagcgtgttgttgatggcgatagtgatgcagaggtgggagggcaggggctccacctggaacaggctgctgatgtcggcctcaaaggggaggtagcccccttcatgctctaccgtgtcgaccccatttacccactgcagacataggagatatggggagggggtggcaggtcagggcatgaggaggggcactgctatcaggcactccctcacataacctgcagtatggggatcgggggcctgccagccagacgggaagaatgacatcccaatggggtacatcaggccacctatccctctacacagggcacagcctccagggcagggcaaggacccccaccgtcccaccccagaagacaggctatgggtggtagctgagggtcccatgctgttcagcagctgtgcccacccacccgccctgcctgctcctggcctcactgaccacgatggcatagaagtgggcactgccaatcctcagcaccactcttgtgcacaggtcctggatccatcgctccagcagggtcacctcccgttcataccacaaccagctgacaaaatgccgcagccgccagccctggccgatgtcgttgaagctggagggaaccggcatgtccacggtggggcctgactgcgaagagaagggctgggctcagctcctaggccccccaaagggatccaggaccagtgtactgcacagccacgcccccaggcctagcgcaaacactgacacacggtggggactcctggtggaacagacagataacttgctgatgacaggtcaattgccagggcggtttgtacacctgggccagtggggccaggagttcctccttggagcggatggaacccagtatctcccaagacaggggtgagcccaggggcacatcccagcacgaggcaagaaggttcagacctgtgactaagaggcagatggcccactgcctgtcacagggaggaaggctggttagggggatggggggtgctttgcttaggacactgtgagtggggcacacgctggcacccagccttctcctctctttctcctgtactgaatgccgtaaagtcagaaaaagaggatgtaggctgggtgcggtggttcacacctgtaatcccagcacttcgggaggcagaggcaggcagatcacaaggtcaggagttcgagaccagcctggccaatatggtgaaaccccatctctactaaaaatacaaaaattagctgggtgtggtgggcctgtagtcccagctactcagcaggctgaggcaggagaatcacttgaacccggaaggctgcactgagccaagatcgtgccattgcactccagcctgggtagcagagagagactccgtctcaacaaaaaaaaaaaaaagaaagaaaaaaagaaaaagaggatgtacaccaggcaaacgcggcccaaacctcatcggatcccacttctctgctgaccacatccaagtcaggaggggaagaggggtggcgtccttggcctgaggtcacattctgtcctctatctgaaccgtgaaaaccaaggtaccttcccaccttggcagagctgacctcaaaatatctaaactgtcgcctcctcccgatccccgggcccagctctgggcagcgcctgcctctcaggcctgacgagtgcctgggtggctcatgcctgtaatcagcacttcaagaggttaatgtgggaggatggcttgaggccaggagttcgagacgagcctgggtaacttagcgagacctatatcttaaaaatacgaacaaaaaaaacaaaaaaaattgattttgtttttaagacggagtctcactctgtctcacaggctggagagcagcggcgtgttctcggctcactgcaacctccgcctccctggttcaagcaattctcctgcctcagcctcccaagtagctgggattacaggtgctcaccaccacgcctggctaatttttgtatttttagtagagatggggtttcaccacgttggccaggctggtcttgaattcttggcctcaggtgatcggcctgcctcggcctcccaaagtgttgggattacagacgtgagccacgagcccgaccaagtttgtttgtttgtttgtttaaattagccaggcatggtggtcccaggtaacttgcaaggctggggcgggagaatcgcttgagctcagaagttaggattgcaccactccgctcccacctgggcagcagggccaaacccggtctcaaaagcatttcaaaaattaaaattaaacattagaaagaaggacactgcccgggctcagccttcgcctaggaacgggactcgacaggagcgcttcttcctcctcccgcctccaccgctccggccctcgcgggtcccccaggtactcccgttctccaatcccgcgcccccaagcccgttgacctttaacctcctccgggcccccagctccggggcactacggtgaaggaggctgcagggcgccggggcttaccccattcccaccgccgggcttccgggcgactcctggccctgccccgagtccgcgcctccgacagcggtcgccggtacctctgctcctcgaagccccggcgtcggttgtcggagaagtcggcgcggaagcttcagaggccgtccagctgcttgcgctgccacgacgggctctctcggggatacagcatcccgtccggtagcgccaacgtgcagccatacaacagcagccggagagccgcccaggccactgccgccccccaggcgaggcttccccctccccgtctcggccgcagtctacggggataagagctgcgcgggaggagcattgcggcaaggtcgcgtgacgcgccggtagcgtgacgcgacttaggtcgtccgcgccatctttgttgag

SEQ ID NO: 1714 - DNA, 8317 bp, Homo sapiens
ctaaacccatctcctcctatgccacctgcctgggcccctcctgggactttatcactgtgccacactttttggaactactggttagaaggtgagtgtccatccccctccaagacacagaggtgcctctgtcccctactggctctgtcttgaagatgcacctctcggagcctcggttggctcctctggaacagggagtagtgagaagacgaacctcacagggttcttgtagggactcaatgatctaagacacagcaaacaaaggggtccctagagcctaaaactctggaaaatctgctgggggtgctgtgattcatgtttgttacttttctcttccccctcacttgaagcagctctcagcattctgcctcaatggcctgtatcactcactgtttggaaaaacacatagaaaccaagtctgcgatggcactggtaaaggatgtctgagattccttctggctggtctttctccttgacacagacagaagaggggtcccttggtgctgaaaaaggagccacaggcccactcagacatctggagaggctcactggggttctccaaaggttggggttcactcattcaacacatacattcaaaacacctcatttgtgcatcgctcttcttggggcttggcataatttcataaacaaagcagatgacaatcccccggccttgattctactcagagtcaggcactcacagtagacagaataaacaagtcatatctacagaatgttacaggtgagaccctcatggcctcctctacgtatggtggcatcctcccagattctgactagaatgacgcagcccagcaacaaatataaactgggtggatttagggttctgaagggccttttcacccacaaaacatgggggaaaatatgtggactctggctggggagagactaaaggagctctggggctcatacttcttataattcccacgagaaggctgacatctggggacttcccccacaagaggcaaatagtgagttctgtaaatggagacttaggtcccctgcaaagcagaggggaggctggggtcacagctggccactgagagacccatccccctcagcaccgtggcttcccagctctccctgtcctcctccccccgacatctgccccttccctcctaaccccaggaccaggggacccagatctggagctttgatgaggaagctgctcacaaatctgcctgcagctgcagtcttgagtgcccaggtgtacagtgctgtgctccagggcctttgggaagagaatgtctgtgggacgccagggcgcacgagggtctgtacagccctgctgtatggccaggtctgccccttccaggacagcactgatggcttacggtagggtggggctgtcctccacactggcagcaacaggccagggacccagaaccacgcaggggtgccctggagggttgtgtgggagaaggccaggcctctgactcagctgtctactccatcaccagcaccatcacctccattttgttcaactggccccccgaaaacacttcagtttactatcagcccccgcaacggtcatctttccggataaagctggccttcaggaacctctcctggcctggactgggcttggaggaccatcaggaaattgtcctaggccagttggtgcttccggagcccaacgaggccaagccagatggtgagggggcttgcagtctgcaagactttccgggggtggtgttttggggctacaattcccttaaattccacccggtcatttctgtgcttggaaaacccagtgaaaaatgactggtgtggtgaccttttctccttttccagatcctgctccacgtcctgggcaacacgcattaacaatgccggccctggagccagcaccaccactgctggcggacctggggcctgctctggagccagagtcacctgcagccctgggtccaccaggatatctacattcagcaccagggccagcaccagcaccaggggaagggccccctccagggacagtgctggagccacagtcagccccagagtcctcctgtccctgtcgtgggtctgtaaagaaccaacccagtgaggagctgcctgacatgacgaccttccctcccaggctgctggcagagcagctgaccctcatggatgcggtgagcagctgagctttgcaggctgtgtctctggcaccagctgtctcagaccagcctctccctgaggagcagccaatgccctcggtccaatttcagccccacttcttaccaaccgtgggatctggatgagtttcctcacccacaagccttccctgtctgcatgtggacggcagagatgggacatcaccagcgccagctgcacagagtgactgtgcagactgagtgacaggagatggacagaaagcagggcagggcaggtgctcactgtggggcaggcagggccatgggtcactcacccagctgctcaggagcctcactaccctcagcacttattaggtacctgatgcatactggattctatggtagacacccaaacagagcccatagttgcagctgccacaaggaaagtgcaccggtacggagaggagtagtagagggctgattgggatgggaggaagacgaggcctcaggatgggcaggcctgagccaccttctagttcttagagtgtggatggcctgggagaaaatgtcactctctcttcccacccttgttgggttctaggccatgatgcattcaggtccctcgggggcagaaaaccaaacccagggactcccacaagtctggagcccattttaaagctttctgagctccagcttggttcctgccagagaccgtggatgactgtgagctcagtccctgcctgggactgtgggtgactctgagctgcagtgtgctgtgtccgtgacactctcctcctcccccaaaggagctgttcaagaaggtggtgctccacgaatgcttgggctgcatctggggccaaggacatctgaaggggaatgagcacatggcacccacagttcgtgccaccatcgcacacttcaacaggctcaccaactgcatcaccacctcctgcctcggggaccacagcatgagggcccgggacagggccagggtggtggagcactggatcaaggtggccagggtaagctatggttgggcctggggattccctctttaaaaatggggaacttcctcttctcctccatcggctttcaggatcggcatctgtatctctggcctggaccctgcacatcccctaggctcttcttgccagagcttcactcaccttgactcccacggcccagtggtggctgctcacttccgacctggggtcttccttgggttgaactaaaatcctcctagatgagtgacatccactcggccccaggtctgccctcctgaggctccccaggcctctgcttcatccaggaggggagatctcagcagagggggctgaggctgtagtgggccaagctccaactctgaaccgcacagctcattcttccctctccaggagtgcctaagcctcaacaacttctcctcggtgcacgtcatcgtctctgctctgtgcagcaacccaataggtcagctacacaagacgtgggcaggagtgtccaggtgaggagggctctctccatggcagcatcagggttgacctagggactcacaggtctccccccatgtgccctcaatgactctgaaaggttcttggagtccagggacactggaggcagggatgggccggtggctgtggtcactaagctgccctggactcctaggcaaggatttccaactcaggactaaggttttttaaccatcaggaacagactggagccaactggaggctttcaggtgtttgtacccagcagtggaactctgtgtccagctgaaagctaactgtaaacacgcagtggctcatgtgaagtggagatggggcccaggggaggagcatgagaggtcccaccctggtcctctggagcccctgtgatcagaggactccactgaaaactctcacccagtaagctgggattcactgggttttcaaacaaaagggactggaactcacaaatctcccctgattcccaaatttacccttctttctttcctctgcccatagcaaaagcatgaaagagctaaaagaactctgcaaaaaagacactgcagtgaagagggacctactgatcaaggtacagtggagtctgggagatgcaggacaagtgtttaagggtcagagaaaagagtgagtttggaagggcattggaccaggtgtcgagtggttattttgtttggttttgacttacctactaaaagtggacttgaaaaattccctccatgcctaccttgggccaacaggaagagtggtgtgtcggtccatgggcacgtgggggcatgggggcaggaggccctggaaatgggatgtggcaatggctgctgggctgctgggctgctgagcaggggtgatgagctgcagcattagcagggctctggctcccatgctggtccatgctgctggcatggagcttcctccaggctggagggtgatcatggtaggtgggacttccttccttcctcaaaccggccagcaattcctcaggaagccaggcctctgctgctgctgctgctgctgctgctgctgctgctgctgtctgcagcacacctccatgggcagggggccttggcctgcactgggggagagggggaacaacaacagaggaagctcatgtggcagggagtccagtaactgcccagctttgggtaccaatgggcatactggggacagacgtagctgtttgctgggactccccactctgccctttgcagacacccaaaaacggtcatgtcagaggattctcaccggttagcagcgacgcatgctcatgacaagtatctgggggattcatacattgctaggggatcctccctgaccagatctcagaatcgtccatgcaaatgagaaggcaacatgtcaccccacccaggactctggaaaaccctgccattgcagtcagagatggcgcatcaggaggctacttcctcagtggagaaagagagagttccgtgcacggaactcccctgggggatcattggcgaggcgaagcctttggcatggctcaaacccagtttgcgtggcagagattccagtggggctgggataggcaggtgccacttaaccaggtctcctaaaatgccctgtccctttcccatcacgactgtatgtggctggagacctagacactcaaagactccagagaacacgaccctgatgggtggtggtgctgggatgtgagctgaaggcagccgagacggagcctccaggagcagaaggaggcgtcctctctttgggggccctggggagccactgcccgctctgggcctctgtttcctcatctggaaaatgaagggatgctgagcctgtagtgcaggcctcacagggtagaaatgaagttcaagaaaagaaagcaatttgagggtgctcgtgcctggttcttcctcagagggatgacggtgagaacaacggcaacagctacaggaaactgagccctcagaggccctgtgaggtagctgtggtttgcatcactctttacagaagaggaaacagtctcagggaggcccggctgcaagactgggtgacacacacagggagtgtggatctgggccagtggtatgagcacggtgccaggtggctcccgccactccctggggatccaagtgcggggtggctggggtgtaactgggggagaggaggagagcctcactgtccctgtcgctgacacctggcaggcggggagctttaaggtggccacccaggagaggaacccccagagagtccagatgaggctgcggaggcagaagaaggtgagtgagcctgtggcatggacgggccgcaggggatcagaggacagggctcccttccccgccagctggaggcctccatatcaagacagcgggggcttcctccccagccctgtcctcctgtggccactgggcctggaaaaccttcatttgagagaccagaggaagggtctgggaaagctggactcagactagatgtggggaagggtaaagctgggaccacaggcctttgtgacttgttaaaatcccaccatagaggttaacaaggagtgcttgctagacttggaggtcagctgggatacaggaggcagagaattgggaaaggcagctgagggtctttggctgctccaaccgggagacctgaggagggggctctgggagacaggggctgatgggatttcatgggacaggaccttgggcaggcacctgagggccaatactcatcaccactacccctcccacctccccacccctccttggcacagggtgtggtccccttcctgggggattttctgactgagttacagaggctggattcggccatcccggacgacctggatgtgagtgagcctggggcagggtgcttgggaaccaagatcctgaagcttgggaggagagggtcctggaccgagcctttagatctcagcccttggcaaacctcctctcctaagagcctcacagctgctcctgtgggtgggggtgtcaggcccatctcatcacctctgagtgatggaggctccatggcagccaccaggccctattcctgagtggtgaagctgcagagctgcctgactgcaaagctgctgaggtgtgggctgaactgggctcagcttctccctagggtagtcccgtaataggagggtgaaattgagcctctccaagggcaggcagttccaaggtcactgagcgctttctttctatgagagacctcagtttccctgtctgtcatcacagagggttggggcagaaggtccctgggcctcagctcccattccccctgctctagagcccggagcctgaggcaggtccaagtcctgtcgtgtgcacatcccctgaccctggtggccctggcagtagtgcagcatgggaaggggtggggtggggctggttgtgggccaggggcctttctgatggactctgtctgccttccagggcaacaccaacaagaggagcaaggtgagcagctggggcactcacgttggatgagggtggggatgtggacgtcacagtccaccctgggcaggacactccctggctccatcctctacatcttaggcttactgggagtgtttgacacacacaggaggaggggacctatcccaggagaaaatgggaaaagcactggaatcaaagaccaattcctgcaggaggggctgtttatatccaactctgagaacaggctgggggcgctgcatgggaccccttcagaaaactgccccagggaccagccccttctccctgcctgccaaaggcccccacagcaacttccacccaggccctgtcagcatcctgtcctctgtctctaggaggtccgagttctgcaggaaatgcagctgctccaagtggctgccatgaattacaggcttcggcctcttgagaaatttgtcacctatttcacaagaatggagcagctcagtgacaaagagaggtgagggcctagcccatgggctgagggtgggagaaggctctccattttttttttttaacatggtctggctctgtcgcccaggctgcactgcagtgtcaccatctctgttcactgcaacgtctgccttctgggctcaagtccttcctcagcctcccaagcagctgggactaccgctgtacaccaccatgtccggttgttctgctgttgttgttctggtacagatggggtttcacgatgatgtccaggatcgtctcaaactcctggcctcaagcaatccacccacctcagcctcccaaagtactgacgttacaggtgtgagccaccccacctggcctagaggaggctctcccgtggccagctgcagagagcctatggccatgcctccacggccagcatcaagccctgttgcatggggaccactggggacccaggattccagctgggcaggcactgacaggggacctgatgtgtggctcatggtggcctcacagctgcttctctgtcctgcagctacaagctgtcctgccagctggagcccgaaaacccgtaggctggcaacatcctgcagtggctgggaacccaccgggatgctggccagaacaccggctctgcaccatccctcacccagaccgtagacaccagggaaccacatctaggaggctggcagctcagctgcatcttgccctggatcctcatcaccaactgctcctgctggccaggatcaggccatgggacttttgtgagtcaggcgggagaccattttatgtttattttctttagtgtataagtaagggttttttcttaactttcgttaaaataaaattttaaaaaactattcaaaat

SEQ ID NO: 1715 - DNA, 334814 bp, Homo sapiens
agatattttaaaaactctgtattcaattattcacaccaaaggatatccattaaaattatgaacatttctaaatatatttcatgtatcatacatatatatattttatgtgtataattacatatcaacaaaagaattcttgctgctttaaccatgtaagtaaaacaaagattttgcaatataacactcatatatgcatatatactggctgtttgaattatgaatttatttacaacttgcctagattataataaatgattactgttctattatacaaacataacagtaaatgttttttaaatacaaagactgcaaatgaatacatgaaaaaattacacacatgtacaatatttataatttataaatgcaaagttaagacctctttaaattattgcacttgcgcattttacaaagatttttgtcatacatataaaatcattttttaaaatttactaacatcaactatgataaagttagatactgttaacttgaaattctttctccttccaatagagagcctattaaaattctggacacaggttcattgactctacaaatcagttcttcatgagcattgtatttgtgatggcatataacctgtgttactctccagtagtttttggtcagcaagattatcaacagcaaactcttagatgccttagctacgttatggatctaggatctcttttgttcatttgttcatgtaaagaaaaccatcttgtcttctcagaaagaatgaagatgctgcatttgtacaaattttggtaactatttcacagtgtgttgggcaagcatgtaatttcaaataggtaggggcattgtatagaaacaccttctctgggtaaatctattacactctgaacttgcacacgaaatgaacacatagcatatacaccatacaacagatcatatggaaaataatattcctatatgtcatttatataggctatcagagatacagcataggactgggtattaaggtgactaaagaaaaagacaaaggctgtaacgcccaagatataatatttcagttgggctagagtatcagattatacacttttagaacctaacttacaatagaaacaaaacccttctgcttaaacttctgcaaatacacagtacctcaaaaacatcagaggaaaactgaaatatgtaaactgacttccctacttagtaagccctggattcagctgtaagtttccaccttggtcctgaggtgacattatcctttgcctcacagggccacacctggccctgtgtgccattgattagttttctcccacttgcaggaaagagcacgtaggctctgtacggctttgcaagccctgctctccattgctgggttgagaagagaaacatcaagtgaggacagcattgcttcttcggatgttaaatgtgtttcttaggtaacattaatgtctttctctttgttctatcttcttaatttagaaccagcacaccgttgacactttttaattttttcttgctatttttatcatataaaatgcttccaacgctacagacaaccaaaatattccgttggaaaaaagacaaaaaagtgtgcactgcattggatattactaatttaaacaatataaatggttaaagaagtcagcaaaatgtgtattggctaaatacttatgcacatgtaaaaatctcatggccatgcgctgaaagcatggggaaactataacggatgacatacttggctgatttacattttacataatttaaaaatcagatgaatacttgcagtagaagagatccactatagtgactaaatgaatatagtctttaaagaattaaatcctaaataaaatctgcaaagtgtagaaagcaaacatatgttcgaaatatgtaaagagagaagtgattttaaaaatcatgcttaggtacctgaaaccccccaaaatcacatcataaccagtgtcacagttctctgaagttcttgccgaaaagactgactctgaacagttcactggttatagtcaccagggtatatgtcaatgaagtcaaataaagaacagaaatctgatgaggagagaatggtcctattcattcaacttgataaaatgaattgtgcgttcctgcaaatattttcaattatacttaagcaagaaaagcaaaataataaatacatgaatgaagaagtaaaattgcagtatttaaaataaaggcacaggccaaggcaggtgaataatttagtcctattaaagctcaaaccttaattttgagttaaaagaccagaaacacaatacccaaacctaaacctattaaaaaacccaggtatctaaggatttatgcatctatttatatcctgtacaatacaggatttgtctcgcatacacaaatataccaataaagaaaaattaactgagattttacaaaatgaaaaaaaatctaaaaagcatgccaaaaaagaggaaatctattattgaacacatctagtttccaattagttgcttttgttgtggtgagaacgagtcacctggggcaccactgtaaacatctgtaccttccttttccattgaagagtcaggaatgggaacgattgtgtctaatattttggtctcttttgcaagatgggtttttcatacacctcttagagagaagtacagctgggaaatggaccagagtctctgccctattaatagggctattttttagaattagtttccacatccattgtatttcttttgacccttttctaattaatcaattcacattgcccgaattcaatattccatgttattggcaggcatttatgtttccaaggacatttttagctaaaaaacatattcactgtgtccaaaaagataatggaataattgcatatgaccataaaacttgtctattataaaccaacataaccaacaaaagtatctgcaaattgaatatcctacatatgctcatagcgggttactaaatttatactgggtggaaaatttggcacaatacacaatacgaccttaataggaactcatcaaagctgttgttagtaaaaaccatctcttggcttctggtgtcacactgttcttttaagaaaagatctgggaacaagacaagaaacatgacccgaaagtctgtctcctaaacatctgacaaaatacaaaaatactcctaactgcatgttttccaaaacaaatcattaactaaatatcactgcaacccgggtccttttattttaggtaaatctgtgattactaagtaaatcttacacatggtaaaagcaatattgacagtttatatcagaattcagtcttttgttcaagctgtgcttctattatgacaatatttcacaagaaattaaccaaccagtaaatccaatcacattcctttgggaaactgttctaaatagagattacataatacacttgactataataaattaagagaattttctgtaataacctaaaaatgtaaatgtagccatgagattcctaactccataattattttctatattaaaaaacagaattcatacattcttttaaaattcttgtaattaaacaataatcttaaataatatatcccttcctgaaattccatctccaagcgaaatgagataactaaactaacttttgtgactaaagctgtgtttggtagactccagcttcataaatttgtatgcagaaaaatatgtatcttgttcaaattcaattatatgatacactaacacaaaaatgacactttcttgtcaactgtcaagtgatatgcattttccatcaagaaaaatcattgttcttaaagaatgggagaatggggctgatttatattttttcctacatgtttgcttctctcttcctctctttccttctgtctctcgtgtgtgtgtatgtgtatgtatcatatatacacatatgtatacgtttacatacatgagtgtgtatcctatatacatctatgtgtgtgttctacatatattacatccatccatatatatatgtgtgtgtatatatctagccacagtggtacttctctctcttttgttattacattttacctcatagtgtataatgaaaatagcaaatggagctccacggagggaagatggcaactttcagaagcccacaagaaaactgaacacatagtgttaattttaaaataagaacaatgtttatgtagagccaactttgctacaacataaataaaccatgttgtagaagcctctgatttaattttgcacaaaccaggctcatatgaacaaaacgcctatggtggtaaatatgtagaagcatatttttccattttattaaaagcgatattccagtttcctgccacatgaaaagtgaataagttatttgatatgatgggcctgtcacttcctgagtgagtctctgtctaattcaggtttggaggttaccgtgccattgcactaaaaatctttaaattattaaaatgcgccagaagtgactgctttatcatctttgtaggaaggggtgcagagtattactttcgtattttttaaaacacttacattgtatagtaatactggtcaaccaaaaaggtgtatagaagaaaccatcgaaacccacaggcttctatggagtgatctgatctgtgagaagagtaaagagaacagaaagaaggtccaacatgattgtactactttctgctctgtttctgtgctatggacagaaagctcatgaaatacgaccgtgcagtacgtggaagagataagtgagaggtgactgcggcaggtcagagtaaaattacaaaatacactttttatggtttgatgtttaaaagagaactgtatggtattttaattaaacaatgtttaaaataaacttttcattgtgaatgagagtctaaaattctgcaatgacacaaagtgaaaatataaaggaatcattatgaaaaatgtacccttcgtatccataagacttgtccattaaaaaaattacaatgccgagcttttattttgttctttatgcaaagggttcagtaaaactgccaagacaacaacaaaaacaattttaaaaactgacatcttttgaactgctacttgaagttctgagatttattgtaacatatacctcatctcttctcaaaaagacaggaagtctacttcgtctagtgttaaatttattgatctcagccctttaggttgaacttaaagaattatgtttagtctaactaaattcatgaagctctgaaataagagtttgacgttttgccatcatttcttactctgtaacctcaacgacatttgtcctgaggctgtggactacaactcaagttaattacaagtaggtcatacatgaacattcaccattcacaatagtaatgtgtaaaaattcctatttatatccaacaacatcaaagcaacattgatgttaaagcccaagtacaataccataatagtaccattttaaacccttattagaaagatacaatggaaaagtaccccttctggataatttttgtccatttcctttaaggcctcagcaatattagcctattagaaaaggctggtttgcaagtcaaatggagtcacttggccagctgatttctgaacgtgggggtggtcctggttgctcagtgtctatgatgcctcacagaagagattggcaggaagtcctctgcttgacttatttatttgatgttaccttcttgaagaggtttgcaccccagttaccaggtgcaggttccccccaccccccccaaaaaaaggaaaagaatgtcaaagaagcaagatgaggatctgtaggtgggacagcgtgtcagggtgaccagtgctcaatcttcagatgcagctgccttctgagccacggatggggatgaaatccaggttgcagtctcctcccctcgaatcaccttctcccactgactgagattatccctagggataaaagatgcagtttcaggagaagctgaataaaggatttctggactttgtcttgaaaactaaccaaacagtcctgtggcacagctctgcacaacggcattgtgtggggccctccgacatggttaccagcacgacgtggccaggcaggttcctgtgatggctgttcaggaaagagattcagaggtgccagagggtcaggggcaccttggtccatccgctctggaccgcgaaagcagcagaaatgctagggctcagcatacgtcctttcttagaaagaaggattaacttgaacagggaaagagccctagggtttactactgaggaatacgcgggatcgtgcaaaggaggtggtcccagagcagtaggaacacttggtgacaacacggaccttcctactgagaaatgtcgacagtgcatctcccaggaggcctaaacctcatcatcttacacttgttcttattctgaacagtgtgtcgtatgtacaaagtcatcctaagttacacctggcaaaacttcggaaattttcttgttacagtaaaaccgtgtttgtgctctggtaagtcctcacccgaggcagtctcatttctcgagtcctctaatctttctctctcagtgtctgtggttcaagcttcacaggcatcgtcatcttctctaactgcgtgatcacaaccactgcacaaccatcttactctacatggctaccctggcagagctcttagccacattcctgtgtgaagtcacatgggaatcttggcattgggaaatacaaaactcctatgagacacagttttaaaattctctcaaatttcttttagcaaacatgctaagacacattcagatagacaaaaccctaaaatataactgaaaagtgtagcccttttaacttttgtaacatatcatcaagtattatttttccagaccctagagacttctgatatattggaaaaagccatacactaattttggtatgtttccttggacaccgatgatacatcatacgctttttaagcgttaataagattaaaatggcctttaagaagttatgtggtccagccaagtatactgaagcaggaatgaggcagagctgcccacacagtggacaccgtgttctcagagctccacaaggaaggcacctccatagcgccctacagcgccgggcacgcgcctccatagcgccttacagcgccgggcacgcgcctccatagcgccctacagcgccgggcacgcgcctccatagcgccctacagcgccgggcacgcgcctccatagcgccctacagcgccgggcacgcgcctctatagcgccctacagcgccgggcacacgcctccatagcgccctacagcaccgggcatgcacagtcagcactcatgacctggcttccaagtacctggcataaaacacacagaatttctggacaggaaaggacttttgaagatattggtttaaacaacatctttgaatttacattgatatcccactttctctttaattttgcacacacttttataacctaattccttcaagaatgatctggcctcacactccatattgcccattatgacttaggcctttgtaataaggtaagattttaataaactaaccagggattaaggtcaattaaggctcaacagaacaaggtgggatgctacgtttatatccacaggagcaggaaggaaggagaaaccgtttcttaaatattatatatataaaatttttaatattgcttattggtctttccttgaaaaaagcagaaaaaaaatttcaacagcagaagataagagtatactaagtttctggttttgtgtaaaactctctggccagtgtctgttctccgtcctcccacagggcatccactccaacccaccccaggcagagctatggctaagtagttaaaacatggcccggagccaattcacctagaaaagactcacacgcacagctgctggctataaccctttgacttcctcagagggaatttataaagtaaaatgaaaatctttaaaaatatccaaggttcttaaccgagttcactctttaaaaaggataagaatggaatagggagaaataatgaatctagaagagataacgatgcttaaatgtctttctggaatgagaaaaagacttaaagaggaagcggttattcaaaatttaaggtccccttcttccatttaaacaacaaactgtgtgatctagtcagcctcttcctgcacaggcatcctcaatagacaccattaccttgtctttttaaaaacagcattgggcaggtcctctgcaaaataacaataataataaaaacttcttcctcctttttggtgtatgaaggacttgatatgaatagacactcttcacatatacatagtgtactacatagggacatactgtggctgtacgagtcatgagagccaggggcccctcttgcaggactgactccatgtctcacttagcagaataaggcagcctggccaagggcttctatcccaggcctgaggacctccagggacaaggtcccttcagcacagatgcagctctcattaggcttgaaaccaagctgccttgcaagaaccacacacatgccctttctcaaagaaagacctggcaccccactcagactgaacgtgggcataagaaagcgagaagggtctcccacaccgagacagaggccctcccagtcactcggtcatctgggccctgactgtgtctggccccagcccccagcctgttcccactgtccctctcttcagagtgtggccagaagaagctacccaagcacccaaggtgcctgaggctcgtctttgaggagaattgaaccaaaggggagaagtcgtggccctggggaagccaggtaaggaggccccgagtccctgagcacaacaactcgacatctagacaaacacacagaccacaacacactagtggggtacaaaaatcctatacagatctcagtgttgttggaaacaatatttttacggcttgaaccatagtacatacctgcatgctttcagaagaggctccgtgggagggaggatctgggtaagggttgtatagcagggaatggccacggcattgtagaacccaagctgcctccatgcaaaaaccacggacaagaaacaaaagtgcacattagcaattccagtgatatttatatttcttaagtgactgttctgtttctgaggcctaattataaaattgcatgttctagttttgctgtatgtgatatctgggttccatgaatactattatagactgtattttaaaatgcattaaaatggattctagaaataaaacacatgaagattcaaaacatattacaaaggttaatacctactgaaatctggccgggcgcggtggctcacgcctgtaatcccagcactttgggaggccgaggcgggtggatcacgaggtcaggagatcgagaccatcctggctaacaaggtgaaaccccgtctctactaaaaatacaaaaaattagctgggcgcggtggcaggcgcctgtagtcccagctactcgggaggctgaggcaggacaatggcgtcaacccgggaagcggagcttgcagtgagccgagattgcgccactgcagtccgcagtccggcctgggcgacagagcgagactccgtctcaaaaaaaaaaaaaaaaaaaaaaaaatacctactgaaatctaagacccaagtacattaaatgacatttcgctaatagatcagtcagttgatcattcaagtcctgtgttatctccagtcacctttagtgctttcttgcagacacttcaacgtaaagcctgctattctttcatacatatggctctttccgccctcgtgctcaggtttacagcagtgctttctgcttgtctgttactcttggctttggtgccttgtgtggtgtcccaatatttactcatcctcccagccctcttatttgaactaaaataaatgtcattggttttatcacagctcttcccatttactgtttttccaatatatcacatttcaaagtttaaaaatctgtagtattttaaataatacataaataatattttattaggaattctgggtcactgtgcaaataagactggcttactgaagtccagatgtaaaagatatgtgactatcagccagataacacagcttgtctagtcataagtcactggccaagtggctgcatcatgtacgagacaaatagctctctagaagaggtgaccccaaatcacagcttaccaatttctcgaaagtactgaacttcagtgatatgcatcgaagcatacagaaggatcaaatttattcctttttgctttctcctgttataaagtctatcgtcatagcactcttactagaatagcgcctgtgttatttccatttttaactttatggctcatgcagagactttcttattctaatatttaacagatgtcatggggcacaagatcccagaaaagatactaatattagaaattagagtatttcattattatggcaaataatttcacagtcatcaactatttagaagcaatatggttggtaaaatatgaactgatcatagaaatttttctttaaacctttattaggctgtaaatgaaaatcaaactattctaaaacaaacgattatcttagttaaaaacactagagcaaaacccatatgctgacagcatcaatgagaaatttccagctataccatgcattcttgggatgactgttaactactgggaaggaaagaaattgtagatccctatcttaaataatataacaagatacattccaaacaagtcaataaatcaaatggaaagtaatcaagaagaaactaaagaaaatataggcaaatatatttactctcaagatgggaaagaacttctcaaatacaatatgaaaagcagacaccgaacaggaatgactaacagctgtgactccatatatgggaaaattccatgaacagtggtaaaatgcgacaaaaacttcaaaatacacctgcagtaaacacgataggtattcaggatccatttctaatcaagagggaaaagtgaccatgccatcagaaaacctagccagggacataagtggaggcaatggccattcattcagcctctttgttgtgctggtaccctctgtgagctgtggacttgtctaaattttgtataaatcaattttaaataaagtagggaaatttgagaacttatcaaaaaccaccatcctgtggacttttttaaacatttgttaaacttatctgtatcataattatttatttgcccacaactaacttccttgttatgccattagaagatgagacagttaacgaaagccatactctcagaaatatatgacaccacacatacacatgtgcaaaactagcgaggcacaagacctctcaaaacattcaaaagcaaaataaattatgtagtatgacctgaaaagaggataattaatgtcaatttatgttgagacaaaacataaaatgtactaaaatactaagcattatttgtcagaaaaaaatgaacctgaattaaaatctataatgtaactctccaaaaatatctttgtttagccaatgacaaaatattttctgcttgttaaaaataaaacaattcaaattcatccaccccctctatttcaagtcagaaaagaaagcctatttactgcaacggcagctgtagaaaggagtcgtggccaaggtagtatgaattctttcagtccacagagatttcctaaccttggtcttactccatctaaatggagaaggtttcaagtggttctagcttctgtcctctgagcactaagtccctccagtccacaaggcagccagaccctcaggattcctcactgtggcttttagccttgggaacaaaatcagtggttagagttggccgtcaaactcagattaagagtataaactcttttagagtctacttttctgagtgtcttagcaagtgaaggctcatttgagtagatgattattcagggtaaacagtttttctttttctagttctcaatcttgtaagataaatttctgaagtttctatattaatcaccagatctgcctggaataacccattcccttaacataatatatgatgacatgctttccatttatgtatgattttatgcccaccttaaactatttggctttagcaattacaatttactttaataattcatacctggccttgggggacttcatccttcttgtctctgtccatcataggaataggctgtattcccaatttcttcatttcatcaccctaagatgaatggggagaaaatcatgctttctcaaatttcaaattgctatactattttgatattattgaattattccctttattccttaattttcttcaaaacaaataatgtttgtggttgttaacccaagaaaagtacatcaaaataaagaaaaacttaatgtatcattattttgtactttatcctgattttctccactactgaattaccagaaacccagccattattactggtttcattttgcagaagttagtaaataaatgttataataagaggagatacagtaaacagtgaggagaaataacaataacaagatatggaataacctccaggcccttctctcttccaaatgatcttccaagtgcatggaactcagtgaagtttggctttccagaggaatatttacagaggaagataaacatcaccagtcgactaaaatgtgctagtaaagacgcagtacaacaaactacacatatcatctaatttacaattataggtaatacttactaaagattaactatgttagttactgaaggttcacgtacagttacaggtaatagttactaaagattcactatgttagttactaaagattcacttacaggtaatagttactaaagattcactatgttagttactaaagattcacttacaggtaatagttactaaagattcactatgttagttactaaagattcacttacagttacaggtaatagttactaaagattcactatgatgcaggccctgagctaagtaatttgtaaatattatttcatttaatccttatgaaatattctaggatatgctgttcccattttaaagattttagaaattatcttgctttttatttatttgttaaaggtaaaacttgtacaatcttcttaagatttcctagtatttttcctaacttcccactcttccctcatagtttttattattttagtaacgttggtcatgtttttagaaatcagaagtacagcctagaaacttcccagacttgctaaaatagggtctacaaacaaactactatcaccataattaggtatttttatgtacaggaccaaagcacttgtcctgacaaagcaaagccacttcaagcatggctgctgttccattgttaccactttaaatttaaaatcagtggtctcaaaccttttgcttctctatccaaagtgagtgagacatactaagtcccttgctctcaaagacttgacaagtccaacaaggaaacagctttttaaacaaacgatgatttgaatatgtactcgaaacaaaaatgctaaaaaggaaaagaacccagtgctacagaccatggctctaacagagggctgagccaatctgaggctttcacagaatacagagggcaggagcatgctccaggcagagactgcagggaacaaagacctaaatggcagctaggggctgagatggggaatatgcctgcacagacagtgggcagggggccagccatgtggggctctccacacggaggtcatgattttggtctgtattacaacaagaggatcagaagcagggtacggatggaatccgaattattatcatccctatctcataaactggcctgaggttaaataccaagtgccaaagcggaattttaatttcaagcaacctggcaccaaagaccacattattaattacttttgcacaaattctaaaaggtaatggcaaggaattcagttagaaagttgcagtactcaaggcatgagttggtgatgacctgaagaggggaaagattgtgaggatggagagaagagacaggactttatagatactgggaacaactgtcaggacttggtgaatatattcctgcttcttcctgtggactattgaggttggtgaaggctgcacctaagagcatgcagagagctgaatcattatctgtggactgaataaccagtgaataatataaaggaaaaacatctccattacatattggtcacattttggcattaaattctccagcttttaatcctgcaccttccttttactttaagttgtcatttaatgactgcacattttctacatttgtctagaatatagaaatcatattacagtctatagttatgcctttctcatagcaatcctgtacctgaacaaaacgtgcatttttagtatgagataaaaagatatttcacaaacagtgcaaggtttttgctcctgttgtcatagctgcagtgatggcttcatgaatttccttttctttttttgcaacgatccttacacgggattcatttatgttaacatggcggcaaccacagctgcagacttcagtctagggaacgtatcaagcaactcaactttttcttgtcatgtcatgacttttctctgcttcttgggagcacttccagcatcctagtgtaactctgtataggtgctatggtgttacggaggacttaggtattgcactaaacacaatgaaaactatgcaagaaccacgagagatcactttttactgtgatacacaatttactggagagacgaatagctcagagacaattagcatcacagagcattttaaacacagcattttaagtggatacttgtaacacttgagctcaccgtaacagcaaaagaaggttgctgcaaaattattacagtactgccgtatgtactatggttaactttacgcagttacaatttaacacggcatctgtttgtttacatttctctccagtctataagtgtgtatataagttttgataaattttaacttatcatagatttttgtatattttatggtagtaaatgataaaatcgactagtatctacatatattttatgcacttatggcatacttaaattttttatatttctaggatatgttgttctgtatttttgtcatagatctccaaaaaaatctttcaatatatttattgaaaaatatctacatataagtggatccacacagttcaaacccgtgttgttcaagggtcaactgtgcattgaaatcaatcttcctacttgagtctgatggtaactaggttctgacacatacacaataaaataaagaaaaagctcatgcgagaccacgcatatgcgatgtgtaaagcattctggagaaatcatgccgggagtataatcaactcaaggtctgtgatcctcatacagtaaacatactttggctttattattatgaaataattcaacatgataaacctttcccactaaacttgtggctgaatgatttgctgtttatgttttacatacattcttctgtatgaatgagatatacgattgaattatcagctgctttgtcctccaaatttacttttatttattcaaaccagaagaggtactcaaaagatttacagctttcttcatagagtagtttttgaatatgcaaaggcctaggtatccgtgactcatttggatgggagaatgatattctacttacttacatacaattccatcagcaaattgagcagtacaatgcacatcactgataaattagataagtcagtcaagaaaaggcgttaataaaagtcatttacgtgttgtttcaggagtattatgaatgaatattccacacattctgcagaacacataatttgcaggtgagctattggttatatttacatattctcaatgtctatggtgcaaaacaattattctcctgaatttttaactgcaggtggatatatcctgtattatgggaccctctgagtactttgtccagtgcctatctaaagtagatggccagtaatgtttattgaatgaatgaacaaaagatcagctgttaagtaagataactgttatactactgttcagtgagtaagttcctaaactctttcagttgagctcagagaattagacacacatgtaagtaatatgtaaaagaatgatcattctctctttgtatctgcataagtgctaaatccttcagtatgtgactcaccacagttctctgaaataactatcaacatgaacaactaaagtattcttagcaattgatccatacgttttatttctcctcactatctatgtcaatataagaatcaaggacatacctcagcccagaattctgcatatatatcatttgccgtcaattttgtaacgggccacagttttgtcacagaacaaaggtcacaggcagtcatcatcaaaccaattacacggtctctagaacacaacaatataagactggtcagcatagcatttgcacatttatagtaaggactagaaagacttctgtatttcaggagtgaagtttaagtatgtattacttcattaaagagcacacagaagtgacagccaggacagtaaaatggaattaaaaattagtgtcattttcatcataagaacaagagtcacttctatcacaagtcccgtgaggagtgcatcatatgttcctgttgcctcaatgctactgaagaaatcaaatataatgtaggctctgactaggctgccatctaaatcccctggtacacttttatggctatggatcaggctttcattttcattgaattttggaaatttagagtgggaagacgtcttaagagaaaatctatcccaatcctttcattttatattagcaaagtctgaggtgcacagaaatgaaatgacttttctaaagggacaggaatttgtggcaaggccagaggaggaggtagctgtgcaacctggttcctcactctccccgtgcaagtgtgtgagctggatgcagcctccaaacactgtgcttctcattagcagatatttcttttcaacaccagcctttcaaccaaaatgacttttcccttttcagctgcttgcattcataactaggtgctccatgtctgactttattttctaaatatggcttggtttaatctttcctcttgaagaaaaataataacttaaaaaaaatcaaagacatatcccctgcaatttgaatagatttggtcttgtgatatgtggctaccctaagtgaagtctctacttaacagaataattaagtggtagtaattaagacagtttaatgtacaactttagcttttgtaaagcaaattatataattttaaaagacaaattatcaacaaggatataaaagtgtgtaatgagtgagacgatgctcttacttctagctcctatctcaattcgaatgagtttaagcaatcccctgctgttaaccactgccttacctcttctaggtccacattctccaactgcgggcacagtcctgccctagctcccgagcctgtcttgacccaggcagacagcacattaggagcatccatctgtcaatctggcagagactctgctctagtagtgctcttagcacatcttagctcaagctaagatgtttggatacctggaataccctgattcttatgataccatcgatcacagagttctttatttcctgtcagctcgcttcctttagcccatttaaggaatcatcagttttactaccttgctttttgtaagggcacatttcaagagggtatcaggtctcttacaggttagactaaatcactttacaaacattggttagatttatgcatacccttcctgtaaccccaaacagatgctatgtgaagatccaaatcccttacaagtggtcagggaaactataagattttcttaatgaggtcgtttctaagaactttgtgtcttgaagatatttatttttggatttgaacttctaacgtaatgaatatatgaccttttttttcaacaggtaaattcatttaaacacaaatcgaatgtgaaaaactaccatttacaaatatttcatatgtttaaaataattcaatcttattaatttatattcaccaaaataacgtatatcatggtgaaataatctaataaggtttatctcaaaaaactttcataaatctgtaaaacaaaagaaatgtcaatagaattgggcattataaaacacatgaaagcaattttcttgctggaaattattcccaacataaagttgccaatataaggactgaaaagattataaaacagttatttagatttcactgtcaaaattacttagacaaagcacaaaaaataaaacagattagaaatttggcatcaaatgtctttagtaaatgtaagtactcatttttttactcccaattccaaaccagttagatggccatggctatacagaaatattaattgggatcaacattttatttctatccatgaatggaatgtagaactgactgctaactgaggtagatccttaactccaaatatgctttaataaccaattgtgaaaggatcatgttcatgctaagcctactcttggtttgagatcatataacctagtcgctaaaaacaatcaaggaggagcccaacacaatgcctatgataaaacgattcttaatcacataatttcagaaggtttaactacattcatttatcctcaaaagttgtgaatgcctgcatgtatctggcagttacagcaaagaaccaaatagacccttttctcagagtaataatgtcctaatagggcaaggcagacagtcaacaggtcaaaactttcatgaagcaagtgctgggtaaaaatcaataaatcaataaatcaataaagagaggctaccacgtgaagatctgggaggaaggtccagcagagaggagtgcacgtgaagtcctaatgtggaaacaagcaaggcaggtttgaggaacaaaaagaaatgccattatggctgcgacacagtgaatgaagtgaaacatggaacgtagttaagtttggagaaacaggctggagacaagataggagtttaacttttattccaagtttgatggtaaaatcttggtgtcttttcccagaggagtggcctgatacaggtattaaagaggatcactcaggtctgctgggtggagatgactcatagacctgtgaaggggcaagggcaggttcggagtgatcacttaggagaaccctacagtagttcagatgagaggtgagggcagcttgaagtatggtgacagtagtgggacagggggagtaggaggattccagacattagaggtagagccaaatgcaaattattaacacccataagagttataaagacaaggcatttctctctcccgtcttcgtttccttttccctcctttctccccgactgccatgtattaattatcccagatcaagtggagcagataaagagcacaggctctatcacaggggtgcagatattccaacctcaaagaggcgggcacctctccgcagcgtgcatgtttgcctgctaagtgccatcctatttcaagattttcttcccacatcagaagatcatggaatcacagaactttaccaaaggaaggcaaaatagaccacacagcctgcagtagtacttcagatgagttactgatgggcaagaaggaagcccagccctcccacactgcccacaatcccacgccacacactctgtaaacctggccagccaaggatatactattttgttggaaaagaagaaacacccattctctaattttataatgattatttgaaatttcttttgaatttctgtattcaaaagtatactgatgtataagcaaagaccagaattctgttatgaggtagtcttaattattactgtgagagtggttaagtgttatcaagcggttaactaaaaagcaaaggtgggggatgtacagtggatgttttgtttagaagctgtcatctagcctcattttaattattttactttaaaataaagtaacacatagaatttgaaaagaaactaggttcaattctttttttctctaaattatcaccttaatgcttttttttttatcttgcttttaaactcattttcaagggattttaaatcattgggttgagtaatttaaatcatatctgtaataactactataccttcatcaaaatgtgacctattttgagtaatttagtaaacattaaactagcctaagaataatacagtttttctgaaagtattatttgaacagctgcatactcaaaatcatagaaaatattttaaaatcttactgtttccaataacataaataactttcatataagtataaacatgatatagtaattatctcactaaaatatactttaaatttaagttctaaaatcttaataaaaccctaaatgttacttcttttaaaaatacattttttccatcacagaaataagttgcttcttttaaaaatacatttttctccattacagagagaaaaataaattataaacgaatggaaaatgaatcttaggtaaatgactaccacagagggaactgctgttattaaagttaataccagagtattattcctagagttaacaacctttacatggtctcacagagtaccatacataactttaatccaaatgggaacattagtgatcttgctttagaatttcagttccccacatttcaggttcttcagttgagacatcaaacattcctggcagagggaggcctttatgcacttacagtcctacagcaggtaaaggctggaggctgctgccacatttgggaaatgctaaagaaactacattatggcatatatatatataaaaaacaggtaacacatcacatagacacatttgttgttcttcaaagcacacagcaatagctatgtaaaaatatagaacttttcaagttctatttctgaattatttgaagaattaacaaagaattgttaaagtgtttaatattgtaccctttctttgacgtgcacgtacctgtaccctttctttgacatgcacgtacatctaaattaagaaaagacttcaagggaagtggagcaaagggattgcttttgaagggtacaaatattatctgggactaagagaataaacattttcattttagaaagataacaaaaataagagaaattatgatttttaagctgccatttcaaattatgaaattagtttatctttacaatttgtgtttacgaaaggcagttcttgcatgaaatacatgaaagtaaaaattttaaaaactaccagcaacttccatatttgtcatcttaatacttaaaaggatacttttatctgatatcatagcttaaaacgcaccatggtcttttctgaatttgctgaaatggttcttagttaagactatacctggttctatttagccataatgggaccatgcttgctaatttcaacaaaaaacaataattctacttttgcctacccttggcttgagttcagagctggtttccagacatgacatttgtttttagttgtagtcaggaaaagtgctttgaagggaaatttcagtgcagaaatcaagcagttcacagatgattggtggccctgcattacgtttcctctctctctcttttctgttcctagcaaatcctttcataagctagaattaaactgtctgatatagttgtcccccacccaaatctcatcttgaattgtagttcccataatctccacatgttgtgggagagatgaggtggagataactgaatcatgcgggcagtttcccccttcctgttttgtgatagggattcagttttcacaggagctgatggttttataaggggcttccccctttgctgggcactcatttttctctctcctgctgccacgtgaagaaggatgtgttagcttccccgtctgtcataactgtaagtctcctgaggccgccccagacatgaagaactgtgagtcaattaaacctctttcctttataaattacccagtcttgggtatttcttcatagcagcatgagaatagactaatacagtaaattgatactgcagagagttgggtgctgctataaagatacatgaaactgtggaagcgactttggaactgagtaacaggcagacgtaagaagagtttggatggctcagaaggcaggaaaatatgggaaagtttggaatttcctagagacttggacaactcagaagacaggaagaagtgggaaggtttgaaacttcctggagacttgttgaatggctttgaccaaaatgctgacagtgataaggacaatgaagtccaggctggtccaggtggtctcagatgtagatgaggaacttgttgggaactggaataaaggtcactcttgctatgcaaagagactggtggcatgttgcccctgccctaggaactgtggaactttgaacttgagagagatgattgagggtatctggtggaagaaatttctaagtggcaaagcattcaagggaaagcagagcataaaagtttgaaaaatgtgcagcctgatgatgtggtagaaaagaaaaaccaattttctggggagaaattcaagccagctgcagaaatttgcttaagtaacaaagaactgagtgttaatcaccaagacaatggggatgtctccagggcacgtaaaagaccttcatggcagctcctcccatcacaagcccagaggcccaaggggcagaaatggtttcgtgggcccccctgctctatgcagccttgggacatggtgccctgtttaccagctgcttcaactccagtggtgacgaaaaggggccaatgtatggctcaggctgttattttactgggtgcaagccccaagccttggtggcttacatgtggtgttgggcctgagggtacagagaagtcaagaattgaggtttggaaacctccacctagatttcagagaatgtatggaaaagcctggatgtccaggcagaagtttgctgcagggccagagccctcatggagaaccctgctagggcagtgtgaaagggaaatgtggagtcagagcacccacacagagttcccattggggcagtgccttgtggagctgtgagaagagggccattatcctccagattccagaatggcagatccacctacagcttgcatcgtgcacctggaaaagctgcagacactcaatgccagcccatgcaagcagccgggagggtaactgtatcctgtagagccacaggggcagagcttccgaaggccgtgggagcccacctcttgcatcagcatgacctggatgtgagacatggagttgaagtatatcattttggaactttaaggtttaatggctgtcctactggattttggatttgtatggggcatgtaacccctttgttttggccaatttctcccatttggaatgctatatttacccaatgcctgtacccccattgtgtctaggaagtaactgacttgcttctgattttataggctcataggtgggagggacttgtatcagatgagactttggacttgaacttttgagttaacactggaattagttaagaatttgagggactgttggaagtagaggattgtgttttgaattgtgaggatatgagatctggaagggggcaggggcagaatgatatggtttggctgtgtccccacccaaatcccatcttgaattgcagttcccctaaccctcacttgtcatgggagggaccaggtggagataattgaaacatgggggcagtttccccaatcctcttctcatgatagtgagttagttctcacaagagctgatggttttgtaaggggcttccctcttcgctgggcactcattcatctccctcctactgccatgtgaagaaggacgtgtttgcttccccttccatcatgattgtaagttttctgaggcctccctagccatgctaaactgtgagtaaattaaacctcttttctttataaattactcagtctcggctatgtctttattagcagcatgagaacggactaatacactgtctaagaatcgatttctaggatcccaaattcacttgtcagtctttgccatttataaagtttaaaaaaaattattattaagtgtaaggtatttgtgaagtctgcactgtatgtcttatgtaaacaaattattcatctgcatttgaaacacacatgacaatgactttatacacaattgggctttggttgtttcatttttaaaataaaatatcataaaaaatacctagtgtctttaatcacagttgtggtcacaatgtcaatatgagtaaatggcataatagctaatgacatcatagtaaatgtgaggggtaggtggtaagggccactggtaaggacaaaaggtgggaagcaagtgtcagaagattaggacttccagcaaaagtcaagataatgtaactccagaatgaatgaaacaaagaatgaaattttttaaaaaaaattaccaggacaaaaaatgccaacaatcaaagacatacatgagtatatgaccacatgatacaacctataattcaaattacttgctattttggattatttgtttacttgagaaatatttgctgaacacctactatgtgctagacactgtcatagttatccatacctctgggccttaccactacacaaaagcccagaatgtgactccttccattacatgacattccatcattgcaacaaggatggtatgccacataatttatgttcaagccaatacagttttgagagtaaaagccagcactgctatgaattattttagctcaacatgtgttagctgagattgatcgaggcaaactgtggagcatggtcactctaattttaacacaaaatatccataaaataaataatgaaaatataacatttgagaattttttttgagactgagtctcactctgatgcccagactggagtgcagtggtgcaatctcagcttactgcaacctctgcctcccaggttcaagcaattctcctgcctcagcctcccaagtagctggaattataggtgcctgccaccactcccagttaatttttgtatttttagtagagatggggtttcaccatgttagccaggctggtctcgaactcctgacctcaagtcatccacccaccttggcctcccaaagtgctgggattacaggcatgagccactgcacccagacaatttgagaattattctaaaaatattaactttaagtattaatttttccactaaacgaaaatgcatttataagttgcacctttctatctacttatggtacagaaatacattgattcttaatacaaataaggatgcctggctctatacattgggcaacttgagttctcaggccaagtctgccatttatttctccaaatgaaataaacactccttctgtgttttagtattaattttggatagagagaggccactgactgtcatccatcaactacccaagatagtaattataattgacatctccaaaaaagatcacctaagaaatattaccatatattagctataaagtttcaagcaatatcagataaattgatccattaaaagtataaaaccaatgaaactaagttggatatttaccaagctcataaacaacaagcattttaaaagttatagttccatttttaacaaatggtgccagaacaactggacatctgcatgaaaaaaaaaaacacaatgcatctagacagagaccttagaacctttagaaaacttaattcaaaatggatcacaaccttaaatataaaacacaaaactgtaacacagatatataacatagaagaaaaatctagttcatccagaatttggtgacttttaaatacaacacaaaggcatgattcatgaaagaataagctagacttcattaaaaattaaaaatgtatgccctgcaaaagatactgtcaaaagagtaaaaaggcaagccacagaccgagagaaaacattggcaaaaggcatatctgatcaaagactgttaccacaaatatacaaagaaccctcaaaattcaacaataagaaaacacccaaatataaaaatagggctaaagacatgaactgacacctcactaaaaatatatataaagatggcaaataagtatttgaaaagatggtccacatcatatgtcatcataaatatgcagattaagacaatgagataacactacacatctattagaaaggccaagatccagaaaactgacaatgcccaatgctggatatggagcaagaggaattctcattcattgctggtgggaatgcaaaaaggtacagccattgtggaaaagagtctggtatatttcatacagaattatgaaataattcataattattcataagtatttcatacagtatgtcataagacatactcttataatatgacccagtaattatgctccttaatacttacccagaggagttggaaatttatgtttacacaaaaacctgcacatggatgtataggcagctttacgaatagttgtcaaaacttggaaacaacagtggtgtccttcagtagatgaatgggtaaataaatgatggtacatccacacaatgcaatattattcaatgctgaaaagaaatgagctatcaagccatgaaaagacatggaagaaacttaaatgcatattactttgtggaaaaagccaatttgaaagtcaactactctatgattccaactatatgacattctggaaaaggcaatggtatgaggactgtaaaaggatcagggattgccaggagttgcggagagtgaggaatgaataggctgagcacaagggatttttagggcagtggaattcctccatatgatactaaaatggtggatacgtttgtccagacccatagaaggtacacatcattaagcctgcatcctaatgtaaactacagactttaggtgataatgatgatttaatgttggttcattaattgtaataaatgtactattctggtgcaggataccaacagtgggggaagttgtccatgtgtggggaccaggatatagaggaactctgtactttctacccaatctttctgtgaatctaaaattgctttaagaaataaaattggttaatgtaaaaaagaattatagtttcaaataagatggaaaattagtaggctaagataaatgcccacatcagaaataacagctaagttccaaaagaaaagatgaattggtagtaaaggcatgatgccacattgataaggaaaggtaaattgtatagtgaagaaaagcagtctggaagtgtatttctgacttaagaccgtaacttaacagagaaaaaaataattttggagaagtatcctttttgaatagtatggagaaaactcatcagccatcctgaataaagaacaaccagcagtggaggcaaatgtccattggataaccacattagtcctaaggccaatgacatcagctaagagcatacttaatcttgtttcttttgaacatgaattgtccaaacaagaaaataaggagttaagatataaaagccactccaagctggagatggtatcttcacatcggcacagatgggaattcagttatttgaataattcaaatcagttgttcaactgagttactgaattccaattgagttatttctacaactgaggtaaagtgtccatctgcagacttcagatgggagaaacaactgtaaagatatagatggtgccacctagggaacatgggaagcaaacccaaatctttgaaaaggacaggtggaggagtccacatccttgttacaggggaaatgatgtctgtgttaactcgagtgttataaggaactctagaaaatggtgaggagaagagaaaggtttccaatagccatgaaggcatttctacgctggtggtaaaagccttccagtgaccaaattctacacagtccatctcatatgacagcaaagaatggcttgtgttaggcaattccttacataattagccatcacaacaatgtaaatgtgtgaattttgaactcattattaattcttaagtagattataactttactcattataatgtagaattctgtggattgcttccatgagcttatcaattcctaatcacctcacagtgagataagatctcacttggtgaattaaggatcattccatattaatcttttaatgatttcctttaaagtgatactgaggtaatcgacatcttaagaacaaaatacttcaaacaaaatgctttgtattttacaaaatgcagatttatagatcatactttttttatactttaggttatgttatatagaatgaaatgcataaatttgaaggatattagtgagtatgaaaatatatgcagtctgtaatgaccacaccaatgatgacaagtaatgtttttatcacccagaaacctcgttttctagtcaatgtccctcatcgaaccccagcaactgccagtttaaattccagcacaatcactaacattattgttttgcctgttgtagaactgcattacaatagtatcatatagtagtatgtaaccactttgctcaaactaacatttgtgtgattcaaccatgttgtctcatgattcagagttcataactttaaaaattgctgaatagtacagtattccattgtttaaatgtccaaagttgtgtatctagcccctgttgctggacatttaggttgccaccaggtgggatatactaagagtaatgttgctatgaatgtgtgtcctagcctgtgtgtgaaagtacactttcattcctcttggataaaaatacctgagagtgaactgctagaacacagtataagaacatgttcagctttattaaaacaaaacaaaataaaaacaaaacaactaaggtgttttctaaagcagctgtacaaattctatactcttaccagcaatatatgagtatttcagctgcttgacatccttgctgtattagtccattttcacaccgctataaagaattacctgatactgggtaatttataaagaaaagaggtttaattgactcacagttccacatggctggggaggcctcagcaaacttacaatcatggcgaaggtgaaagggaagcaagtattatatggctgcaggagagagagagcaagcaaagtgggaggtgccacacactttcaaacaaccagatctgggtgagaattcattcactatcatgagaatggcaaagggaaaatctgtccccatgactcaatcaccgctcaccaggcccctcccttgacacatgcagattacaatccgagatgagatttaggtggggacacagccaaacaatatcacttgccaacaactgataatgttggtctttgtaattttggccattctagtgggtgcataatggtacatacaccaccctggttttaccttatgattagagatgttgagaaaattccatgtgtttattggctttaaattctgtaaaaatctttcatataatttttttcttgggttgttttattattgactttacaaagttatataataccttcgtcaaacataaatactgagaatattttctcacattatgtggcttgtcttttcatttccttaaaggtaccttttaaggatcttgttttttagcatgatgaagtctcatctgtcatttatttgtttaaaggttcatccatttttgtgcctaccctaaggtcatgaagattttctcccatgttttgttttagaaattttataattttaattcttatatttaggtctctcatccaactaaaactggtaaagaaccatttgcagaaaagacagttgttcatatacaaaaaatataattgattttttaaaaaatgttgaccacatagcctgtaaacttgcttaattcgcttattaattctagtacattttttggagatgacttaggtgtttttcagtagatggcatgtaatttaaaaataaagtcagatttacttttttctttcaaatctttatgcctttcatttctatttctttctataattcactggctaggacctccaattcagagtactacagaactagacagagggggtattacttaatatatgaactatcatcacgggggctatgatgtgttcatacactttttacaatattaaagaagttccattgtattcctagttttctgagatttttggccttcataaatggaggtgtaattttgtcagatgctttttctacatctattgtaataatcatatgatgtctcttcttcattctgttgtggtgaattttggaaatgttaagccagtttcctaatcctgcaataaaattcttgttatgacatatgatcttgttatatgtgattgaacatgttatattttgttatgaattttacagttatacttttacagttatatatggtcatgagttttatagttagatccaaagggaatactgaacttgaatttactgtttttgtgatgtttttgacagactttggaaatcaggattatttagccttcataaaataaggtaggaaatggttcttgtccttcttttggaaagcttttgtgcaagattgtttgatagcaaccccacatgaagctgttgaggcctggtcctgagggatgggtggtttgtttgtttgtttgttttaagattagatttcttcaatgaaatattcagagttctttttggttcaagtatagtaagctggatttctcaaaaaatttatccggttcatctaagtttcaaatttattagcatattatttataatactctcttattatcccaatgtaatctaagtgctatcccctctttcactgtcaacattggcaattggtgttaatattttcttttttttccttaattagtcagaattgtatccattttaatagtcttttcaaagaactactggcatttcgaatcttccttctgttgcttgctttatgttttattgctctcttatccagattatttacttcccacaagttaggctttaatttactctttttttctagctgcttaaggatttaaatcactgatgaacatacacattgaaagttatacatttccctctcagcactgttttagctgcatcctacagattttgatatagtttgttttcactgtcattctggttgaggtattctcggacttcccgtggagtgtctcttttgactcatgggttatttagaagtatactgtttactttccaaatggttggggttttccagatagcttatcattatttttaatttaattcctctgtggtaaaataatactcctaagacttcaatcttttgaaatttattgacaaattaggtcacaatagtgtcgtttagatctctgttagccttagcgaacttttacatagttcttctgtaagttacttaaggagggatataaaactctccaactaggattttggatttgtttactttttagttctgtgtttttttgttcgtttgtttttgaagctttgttattaggtgcatgtacattctgcatttattatgtcttttgtacattgaccatttcagagtaaacttgacctctttatatctggcaatgtttcctatcttaaagattattttgtacaattttaatataggtacaccagttttttttttttaatgctgttgccatggtatatctttatcatttgctttcaacaaatctttctacttaaagtgcatacgtcatagacaacatggaactcggtcttgctatttagctggtctgatcatttctggctaattcagatattcagtctatgtatatttaatttaattgttggttttattaggttcaaatgtaccatcttgggatttgttttctatttgttgaatctgtttttgctcctcttgtcctgcttccctgtggttttatcaaatgtacttttactattcaatatttttgtctacttttaaaagctatacagtttcagtagataaatatgcatattctaatctctagggaaactgtaaaaagagcaaatctcttttttttactctttttacagtttccctggggattataatatgcatacttatctactgaaaattaatgttcttccacttaacacttcactctacccttcacaaatgtaagaaacttataactatagaatatatagaactataattctacatagtctcatcctttgtgctgttttcatatttaatcactacatatgatacaaaccctatcttaccctagtattatttttgcttgaaccactcattcattttttagaaaaatagaagaaacagtattctgttaatatgttctatttatctacatatttgctactttaccttcctacagactgagttttcatctggtaattcatcactctgaggtttctcctttagtatgtcatgttattcctgtctgctgacaacatattcttccagcttttatttatcacaaaaatgtccttatttcagcctccttttttgaagaatgtttctaatggacataggatttggaacagacagtgctttgaatacgtccatgtttttgctctccatgatttctggcaagaaacacgcatcatgtgtagtattttaccctgtttgttacgtgttgtttctccctggtactttattattctcaaatttctttggggctcaattttataattttcacttctctgctaaaattctgcattttttcactccttaaaatcaatttttgtttaacaccttgaacatatttagagtcactgatttccagtccttccctgctaattccacaatctaagtcatcttgggctctgtttctcctgactgcttatgtcttcttgattgtgggtcctattttcctgcttctttatatttgtagtaaagggccagatagtaaatacttcaattttggtgggctatatgtaacatctgtcacatatctttttttttctgttcttttttgtttaccagtgcattacaaacgtaaactcatcccagtttgtgggctgtgcacacagacagggcacaccagatgtggcctgaggctttagagtgccaacccctatttctgacagtccattatgagaaatctgggtcatgatgtctcccttttgagtttatttctgccaggctgttacttcactagtggatctccccaatcctgtggaagtttgagtttacgctttggttaggagaatcaagtattgtctttgttccacagtgtggtccatacccacgatatggctttgctgatactctatcctgtggtgtggacaagctctctctactctagatgagctgaaagtctgtttccaaatactgtgtgatccctacaatctccgtgggatgcttaactctgcacactgtggcactctcaactgctctgctagggcctgtgaaattccaccccaggtatgagaaactcaggcccagccactgacccgtgaggagcttctgcagattcttggcatctcagcacaattcccacatctcccggattctacccagtgctgctataaggctctgctttcgttccactgccctgtcccagagtcaggaaattatcctcaactggataaatgtaggagttcatatgtttcacttttctcaaggattacagtcctttatcacctaccatccaatgtcagttgcctagaggtactcccataaagagtggatgttgtaggaggaggcaactgggaggacatggatggatttattggagatacaggctcaactgtagtttggaaaaactgctgaggagaaactggggaagaggtggctgggaggagccatcctatggtgagacaaatctcaaataaccgagtgctggaaacgggccttgaaagggcccatatttgactgactctgtctgtaaagcaatgtctcccccaaatactgttgttgtaaacaataaagccaccagctgatggctgttggaacttaagagtagggtgtgggtcaggaaaagagacagtcaaagagacatgccaaaaccactgtccttccaggtgactgtgggtacaccaatgctgtcccctttgaggatcaacatcaaaggcttaatactggggggttcattacttaagggaaaaagacaatttgctttcccccaaagaacaggaacaagaagaatgcctgctcttgccacttaaattcagcacaagccagacatttatcaaatagaaagaaaaggcaaacagattaaaagagaattgtataactatctctatttgaagatgacataatcttatgtgtgtacagagatgcctaagcattagaagtaataaatgcgttcatcaaggtttcaagatacaagataagcagtacagaaatcaataaacaggcctaaaagacatgtacagagcactccaccaaacaccacagaatatatattctttttgagtacagatggaacatcccccaggctaaatcaaatgtcaggaaataaaacaagcctcattagatttaaaagaataaaaataatataaagtatgttctttgaccacaattaaatcaataacaaaaagaaacttggaatcttcaaacatttatggaaatttaaaaacatattctcatatgactattatgcacgaaattgtgtccctcaaagagatatgctgaagtcctgacagttcctcagaacgtgaccttatatagaaatagtgttcttccagacataattcgttaagatgaggaaatattggaaaagtgtgggcccttaatacaatatgactggtgtccttataggaagaggaaagtgatacaaagaaggaaagacaccaggggaatacagagacacacaggtatctcatcactggcatgtgatgatggaggcagagattggagtgatactctcatagactacaaatgcctgaagttgccagtatctgttaaaaagtaggagagaaacattgaacttactgtccttctgaaccctccagaaggaaccaacgttgccggtaccttgatttcagacttctggccttaagaattgtgagaaaataaatttctattgttttaagccatctggtttgtggtatactttgttaacagcagtcctagaatatgaatacaataacaaatgtatcaaagttaagaaattaaaaaggaaatgtgaaaatcccttgagatgtatgaaaataaagacacaatatatcaaagctcatgggatgcagttaaacagtagttagaggaaaatttagagctatgaatgtctatattaagaaagaagaaataattcaaattaataacctaaactgccttaagactgaaaaaggaggagctaactaaaactaaagcaaacagaagtaagcaaataaagattacaaaagaaatacatgaaatttggatgagaaaaacattagaaaaaaatcaatgataccaaaagctggttatttgaaaagatcaacaaaactgacaaacttttaagctagactgaccaagaaaagacagagagggagagggagaaaaagaaagacgattcaacttaataaggaacagaaacgaaaaagggaactttactaccaatcttacagaaataaaaaggatcataaagaactaccatgaacaactgtatgccaataaagtagacaagttagttgaaaatggacaaatttctagaaagacacaagtgactaaatatgacataagaagaaatagtcaatgtgaatagacctataaaaagtacaaagactgaattagcagtcaaagggaaaaataacaaccacaaagaaacatctatacccacatgacttcactggtaaattctatacatttgaagatgaattaatacaaattcttcataaactcttccaaaaaaacagtagaggagggaatacttcccagctaattccatgaggccagtgttaccctgacaccaaaataagacaaataccacaaaaaagaaaagtacagaccagtataatttatgaatacaggcactaatgtcctcaacgaaatatcatcaagccaaatccagcaatatatagaacaactatacaccattattacctgatatctatcataggaatgcaaggttggtttaacatctaaatatcaattaatctaatgcaccttactaatagaataaataacaaaaactgcttgataatctcgatagatgcagataaagcatatgacaaaatccaacacccattcacaataaaaaaaataaacactcaacaaatcagaattagaaggaaacttcctcaacctgataaagttcatctataaaatacccatatctaataccacacttaatggtgaaagactagatgctttccccctgaaatcagaaacaagaaaaggatgtcttctcttgtcactgatattcagcataagccaaaccaatgattaaataaaaagaaagaaatgggccaggtgccatgactcacgcctgtaatcccagcactttgggaggctgaggcaggtaaaccatgaggtcaggagttcaagaccagcctggtcaagatggtgaaaccccgtctctactaaaaatacaaaaaatagccaggcatggtggcaggtgcctgtaatcccagctactcgggaggctgaggcaggagaattgcttgaacccgggggaaggagggtgcagtgagctgagatcgtgccactgcactcccagcctgggcgactgagtgagactctgtctcaaaaaagaaaaaaaaaacagaaaagaaaagaaagaaagaaatgacagattctgaatgcaattgtttgtacaactatctctatttgaagacgacatgaccttgtgtgcacaaagagaaacctaagcaatgcaccaaaaaattattagaagaaatgagttcattaaggtgtcaagatataagatcggtagtacaaaaatcaattatttctacatactaacaataaaaaatgtgaaaataaaattaacaaaattccacttacaatattatcaaaacaataaaatccttagtaataaatttaacaatagaagtacaaaatatggacttgaaaactagaaaacatggttgaaaaatattaaagaacaagtaagtaaatggaaaagcatctcatattcacagacttaatattgttaagacggcaatacttccaaaattgatttacagattcaacattttctgcatcagaatcctagctagcttttctttagaaactgacaaggtgattcacatggaattgctagagacccagaatagtgaaaacaatatcgggaaagaagagaggaaggaaggatcagtaacagaaaagcacttactgttattctacatatttgtaactctagataatacaagtttctatagactgaatgtttctttcccctaaaattaatatgttaaatcctaatgtccaacatgttagtatttggaggtgggacttttggaaggaaggtgattatgtcatgagggtagagccctcatgaatgggattagttcccacataatagaaacctcagagagctccctcccttcttccatcaagtgaggtggcagctagaagatggctctctaggaaccagaaaacaggccctcactcaaattgagacactcaaactgccagtagcttgattctggaatactcataccccaaatatgtgagaagtaaccttttataagccacccagtctatggtatttcgttataatagcctgaagggactaagacacacatataatctataaagaaagaacacattgatttctatgcctggggtagggaaatttgattggaaaaaggtagagtggtggcagacttttttatacctttactgtgactctgctagtagttgcatttgccaaaacttaaaattagtgtaattacacctaaataaagttgctttaacaatcatcttttctgtcttggccaggaagaaaatattgatcaactataaaattttaacttaatagttatattctttttacaacaatccaaagaagtctctaggaacaaaataaaaaataaaaaacaagcaaacatccaaagtatttcgaaattagaaaattactttgaaataacctctacatcaacaaggaaacaaaagcagaaataaataatctaaaaactaaggaaaagtacttcatcaaaacttgcaaggtatagttcagtcaatgcccagatcataatacatataatctgattatttcattactattcaatcagagaaacaagaaaaaaatccaaaagtatagtgaaagcataaaaataaaagttaaaattaatgaaagaacagacaacaaataaatgaaaaattttataaaagttagttttattaaaaaggagtaattaaaaattcccaggcaaaatggattatataagaaaggaagaaataaaaatgtaaaacactgaaaattagatataaatacaaatttagtaatatcaattaaattttaagtgaaaataatctgtgcatacattttttatgaagttttaaatctcaaggcaaaagataattttgtagcataatacattgaccaagagatggaataaagtggcaaaaacaaaacaaatccccaaaccataaaagacactgaaagtttgttaaatatttttcatttaaaaaggtgacaggctggacatgatggctcatacctgtaatcccagcactttgggaggctggggtgggaagatcatttgagccctggagttcaagaccagcactggcaacatagcaagactctgtctcaacaaattatctcaacaaataatgacaaaaaatgtagccaggcatgatggtgtttgcctatggtctcagctatttagctacttgaaagactgaggtaggaggaacccttgagcctgggaggtcaaggctgcagtgagctgtggttgtgccactgtacttaagcctgggggacagagaaaacccggtctcaaaaaagtgaattaaattaaattaaaatttaaaaggtgactggatagtttcacaaatgagtaattcccaaaatgattaaatgaaccttcccaaaatggttaacattagttatttaaagtcttccagatcagaaagaaagatcaatagcttctagcaaattataatgtacaaaaaagacaactatatgtcaaaattaatagattacatgcaaatatgctaaaaaagaaaattttatttcctcagcctattaaagaactaattccatggaaaagtacagttcaggaaattaaggagtggcacaaaattagaaaatttaaaaacctattcatcaaataagaaatcagtaacactaagaaattagagaaaaaccttctatccatggaacatggatacagataaaccttatacatgataaacatgatttatcaagatacatcaaatactaccttaaaaattaaaactctaaactcatgtctattaaagtcatgcacatattagaatgtgcttgctttcttcacaataagctaatattgtgttgtaaattctagctatgcagtcagatcagaaagcaaaatacatacaaacatcagaaaagtagaacaaattttattcatttgtagatgacattactatataccttaaaaagccaagagactaaaataaaacttttcagctgataaagagtatataatgaaatggctagatactaaacaaagttttaagattctggtaatcatagaataataataataaattctagatagaactaaaaacaaatcttgaagatgctgtctagtacctaaaaactggcgtaagtggaagaagatttaaacgttgaaaggcaagaccacgttgggtgacatccttatttacacagctcttctcctaagggcatgtcataaatacagcccaaaagaaagtcagggcccattgagaagggagagtctggggatgtcagagcacacacaagttgaggagggaaatcctagaaagcagggagaaccacagaagtggaagtccccaaattggaattcatacaaatccctgacagagtacaccaaggccaaaacagaaatggaaccacccaactaaagcttaaaggaacatactcatatatttaggatgattgatgagaaatgcaactggccactaggataaaagttaattaccttcagagaaagacaagagcatccagaaagataatggagcttgttgcccattatgtaatatacaaatataaaaaaattactagccatgtaaagaaactgaaaaatgtattacactgtctagagtaaaatcagtcaacaagacaaaactcatagaaaacccagatagtgaaaattcagacaacaatctctaaataatgtacagatacgctaaagaatcttcaggaaaatatatatttagaaaagataggtgaagagatggggaatttcaggagaaacatagcagctataaaaatgaatgaaaaggaaatcccagaacttgaaaatattacatatatatatatacacacacacatatgtgtgtgtgtgtgtgtgtgtgcgtgcatctgtgtgtattttctaaaaatcacaacatgaggttaactacagattggacagaatattaggaaaaaaaacagtgagattagacagatcacaacaaaatacacaaaccattaccagtgaaaaaccatacagagccttaataacctgtaacacagtataaaggggtctaacagaagtgtcagagtctcagaagaaaagagacataatggggcagaaaaaacatctgaagaaatgtaatgcttgaaacttctccaaacttcactgaaatcagcagcccacagacccagaaacctcagaagacaccaagaagaatgactgtaaaagcggtcagggtaaaagatcacagtatactgaggagaacaacaactgctgacttttcccctcaggagggggaaaaaaaaaaagacagaggccagaagaccatttactgacttttatgaaatgatgaaaaaataatctgcccactaagaactctaagtccagtgaaaatatctttaaaaagcgaagccacaataaagccattcttagattaaaaaaaaacaaaaacaaaaaacaaaaacaaaaaaacacctcaaaggatctgctgtcaacacactgagagatgttaaaggaggttatttgggctcaaatgaaatgatagaagttggaaatttggatttacattaatgaattaaaaacagaggaaatggtatacatgtgaaaaatataaaaagttatttttcctaaattcttttcttgtttttttgagatgaagtcttgctctgtagcccagactggagtgcagtggcatggtcttggctcactgctacctctacctcccgggttcaagcgattttcctgcctcagcctcccgagtgtctgggattacaggcatgcaccaccacacctggctaatttttgtatttttactacagatggggtttccccatgttggctaggctggccttgaactcccggcctcaagtgatcagcctggcttggcatcccaaagtgctgggattaaaggtgtgagtcaccacacccagcccatatttcttaaattctttaataattgattcattatttaattttaaatattagcaacctatgtggggtgtataacatatgcagcaataatagctacatatataactatagcagaaaagacaaaaagaggtataaattgaattattttaaagtttttcacattgaacaaaatggaaataatatcaattcaaagcggactaataaaaatgcatactgtaaactcaggaacaaccacttgaaaatttaaaaagggtataacaagaaaaaccaaaagcaaatatagaatgaaatatcactcccccaacacaaatagctcaaaatagaaaatggataattagacaacttataaatgcaaatagactaaacagtacattaaaaagcagtgatttcagacttaaatgtccctgtctgacagctctgaagagagcagtggttctcccagcacgtagctggagatctgagaacgggcagactgcctcctcaagtgggtccctgacccctgacccctgagcagcctaactgggaggcacccccaagtaggggcagaccgacacctcacacggcccggtactcctctgagacaaaacttccagaggaacgatcagacagcagcattcgcggttcacgaaaatccactgttctgcagacaccgctgctgatacccaggcaaacagggtctggagtggacctctagcaaactccaacagacctgcagctgagggtcctgtctgttagaaggaaaactaacaaacagaaaggacatccacaccaaaaacccatctgtacatcaccatcatcaaagaccaaaagtagataaaaccacaaagatggggaaaaaacagagcagaaaaactggaaactctaaaaagcagagcacctctcctcctccaaaggaacacagttcctcaccagcaacggaacaaagctggatggagaatgactttgacgagctgagagcagaaggcttcagacgatcaaattactctgagctacgggaggacattcaaaccaaagacaaagaagctgaaaactttgaaaaaaatttagaagaatgtataactagaataaccaatacagagaagtgattaaaggagctgatggagctgaaaaccaaggctcaagaactacgtgaagaatgcagaagcctcaggagctgatgcgatcaactggaagaaagggtatcagcaatggaagatgaaatgaatgaaatgaagcgagaaggaagtttagagaaaaaagaataaaaaggaatgagcaaagcctccaagaaatatgggactatgtgaaaagaccaaatctatgtctgattggtgtacctgaaagtgatggggagaatggaaccaagttggaaaacactctgcaggatattatccaggagaacttccccaacctagcaaggcaggccaacgttcaggttcaggaaatacagagaacgccacaaagatactcctcgagaagagcaactccaagacacataattgtcagattcaccaaagttgaaatgaaggaaaaaatgttaagggcagccagagagaaaggtcgggttacccacaaagggaagcccatcagactaacagcaaatctctcggcagaaaccctacaggccagaagagagtgggggccaatattcaacattcttaaaagaaaagaattttcaacccagaatttcatatccagccaaactaagcttcaaaagtgaaggagaaataaaatactttacagacaagcaaatgctgagagattctgttaccaccaggcctgccttacaagagctcctgaaggaagcactaaacatggaaaggaacaaccggtacagccgctgcaaaatcatgccaaaatgtaaagaccatcgagactaagaagaaactgcatcaactaacgagcaaaataaccagccaacatcataatgacaggatcaaattcacacataacaatattaactttaaatgtaaatggactaaatgctccaattaaaagacacagactggcaaattggataaagagtcaagacccatcagtgtgctgtattcaggaaacccatctcacgtgcagagacacacataggctcaaaataaaaggatggaggaagatctaccaagcaaatggaaaacaaaaaaaggcaggggttgcaatcctagtctcggataaaacagactttaaaccaacaaagatcaaaagagacaaagaaggccattacataatggtaaagggatcaattcaacaagaagagctaactatcctaaatatatatgcacccaatacaggagcacccagattcacaaagcaagtcctgagtgacctacaaagagacttagactcccacacaataataatgggagactttaacaccccactgtcaacattagacagatcaacgagacagaaagttaacaaggatacccaggaattgaactcagctctgcaccaagcggacctaatagacatctacagaactctccaccccaaatcaacagaatatacatttttttcagcacgacaccacacctattccaaaattgaccacatacttggaagtaaagctctcctcagcaaatgtaaaagaacagaaattataacaaactgtctctcagaccacagtgcaatcaaactagaactcagggttaagaaactcactcaaaactgctcaactacatggaaactgaacaacctgctcctgaatgactactgggtacataacgaaatgaaggcagaaataaagatgttctctgaaaccaatgagaacaaagacacaacataccagaatctctgggacacattcaaagcagtgtgtagagggaaatttatagcactaaatgcccacaagagaaagcaggaaagatccaaaattgacaccctaacatcataattaaaagaactagaaaagcaagagcaaacacattcaaaagctagcagaaggcaagaaataactaaaatcagagcagaactgaaggaaatagagacacaaaaaacatttcaaaaaattaatgaatccaggagctggttttttgaaaggatcaacaaaattgatagactgctagcaagactactaaagaaaaaaagagaaaaatcaaatagacgcaataaaaaatgataaagggcatattgccaccaatcccacagaaatacaaactaccatgagagaatactacaaacacctctacgcaaataaactagaaaatctagaagaaatggataaattcctcgacacatacactctcccaagactaaaccaggaagaagttgaatctctgaatagaccaataacaggagctgaaattgtggcaataatcaacagcttaccaaccaaaaagagtccaggaccagatggattcacagccaaattctaccagagtacaaggaggaactggtaccattccttctgaaactattccaatcaatagaaaaagagggaatcctccctaactcattttatgaggccagcatcatcctgataccaaagccgggcagagacacaaccaaaaaagagaattttagaccaacatccttgatgaacattgatgcaaaaatcctcaataaaatactggcaaaccaaatccagcagcacatcaaaaagcttatccaccatgagcaagtgagcttcatccctgggatgcaaggctggttcaatatatgcaaatccataaatgtaatccagcatataaacagaaccaaagacaaaaaccacatgattatctcaatagctgcagaaaaggcctttgacaaaattcaacaacccttcatgctaaaaactctcaataaattaggtattgataggacgtatctcaaaataataagagctatctatgacaaacccacagccaatatcatactgaatgggcaaaaactggaagcattccctttgaaaactggcacaagacagggatgccctctctcaccactcctattcaacatagtgttggaagttctggccagggcaatcaggcaggagaaggaaataaagggtattcaattaggaaaagaggaaatcaaattgtccctgtttgcagatgacatgattgtatatctagaaaaccccattgtctcagcccaaaatctccttaagctgataagcaacttcagcaaagtctcaggatacaaaatcaatgcacaaaaatcacaagcattcttatacaccaataacagacaaacagaaagccaaatcatgagtgaactcccattcacagttgcttcaaagagaataaaatacctaggaatccaacttacaagggacgtgaaggacctcttcaaggagaacgacaaaccactgctcaatgaaataaaagaggatacacacaaatggaagaacattccatgctcatgggtaggaagaatcaatattgtgaaaatcgccatactgcccaaggtaatttatagattcaatgccatccccatcaagctaccaatgactttcttcacagaattggaaaaaaatactttaaagttcatatggaaccaaaaaagagcccgcattgccaagtcaatcctaagccaaaagaacaaagctggaggcatcacgctacctgacttcaaagtatactacaaggctacagtaaccaaaacagcatggtactggtaccaaaacagagaaacagatcagtggaacagaagagagccctcagaaataacgctgcatatctacaaccatctgatctttgacaaacctgacaaaaacaagaaatggggaaaggattccctatttaataaatggtgctgggaaaactggctagccatatgtagaaagctgaaactggatcccttccttacaccttatataaaaattaattcaagatggattaaagacttaaatgttagacctaaaaccataaaaaccctagaagaaaacctaggcattaccattcaggacataggcatgggcaaggacttcatgtctaaaacaccaaaagcaatggcaacaaaagacaaaattgacaaatgggatctaattaaactaaagagcttctgcacagcaaaagaaactaccatcagagtgaacaggcaacctacaaaatgggagaaaatttttcgcaacctactcatctgacaaagggctaatatccagaatctacaatgaactcaaacaaatttacaagacaaaaacaaacaaccccatcaaaaagtgggcaaaggatatgaacggacacttctcaaaagaagacatttatgcagccaaaagacacatgaaaaaatgctcatcatgactggccatcagagaaatgcaaatcaaaaccacaatgagataccatctcacaccagttagaatggcaatcatcaaaaagtcaggaaacaacaggtgctggagaggatatggagaaataggaacacttttacactgttggtgggactgtaaactagttcaaccattgtggaagtcagtgtggcgattcctcagggatctagaactagaaataccatgtgacccagccatcccattactgggtatatacccaaaggactataaatcatgctgctgtaaagacacatgcacatgtatgtttattgcggcactattcactatagcaaagacttggaacaaacccaaatgtccaacaatgatagactggattaagaaaatgtggcacatatacaccatggaatactatgcagccataaaaaatgatgagttcatgtcctttgtagggacatggatgaaattggaatcatcattctcagtaaactatcgcaaggacaaaaaaccaaacaccgcatgttctcactcatagatgggaattgaacaatgagaacacatggacacaggaagggaaacatcacactctggggactgttgtggggtggggggaggggggagggatagcattaggagatatacctaatgctaaatgacgaattaatgggtgcagcacaccagcatggcacatgtatacatatgtaactaacctgcacattgtgcacatgtaccctaaaacttgaagtatgataataataataaaaaaattaaatctataaaaatacataaagaaaactttaattattatttgttactatgagacttgatttctttaaaagatcaaaaatttgtcctcctgaaactaaatctgttttcaaaagaaaatctgaataagttttttgaaaatctaatgtaaagaaatatgtgtaatatataacagaaaattttaatatccttaacaaaaatatagaataaaagctgatatataaaaaagtaaacaattcaacaaagtataagcaaaatttatgaataaatacacagaagtaagaatagtaagtaataaacaaacataaaaaaatcttcaatacagtgagtggtcagagactggcgtatttactgagaaaaggttttcacctttatgttagaaggagtgtgaatttctatagccttttctgagaatgtaatatatgtataaattgacggcaatatatgttccaggcatacattgttttattgcattttgcctgattgtgcttcataaataccatgtttttggtttttttttttttttacaaattgaagttttgtggcaaccttgggtacagcaatatcggcagcatttttccaacagcaagtgcttactttgattctctgtgttacattttggtaattttcaaaatatttcaaatattctcattattttattgtatcagtcacagtgatctatgatcagtgatctttgatgttaccattgtaactatttgtgggtgccatgaattacacccatatatgatggtgaacttaattgataaatgttgtgtgtattcagactgctccaccaactggctgttcccccatctccctccctgtccttgaacatccttgttccctaaaagcagtaatattaaaattaggccaattaataactctacaatgacctctaactgttcaagtgaaaaaaagtcatatgtctctcactttaaatcaaaagctagaagtgactaaacttaggaaggcacatctaaagctgagataggctgaaagcaaggactcttgggccaaacagccaagttgtgaatggaaagaaaaaattcttcaaggaaattaaaagggctacaagtgttcttgatgatatgaagaaagttttagtaatctggatagaagatcaaaccagccacaacattcccttaagccaaaagctaatccagagcaaggccttaactgtctccaattctgtgacacctgggagatgtgaaaatgctgcagaaggaaagtatgaaagtagcagagattggttcgagaggtttaaagcaaggtaaaaagtgcaagctgaagcagcaagtgctgatgtaaaagcagcaggttattcagaagatctaactaagataacggatgaaggtggctcaactaaataacagattttcagtatagacaaaacatctattagagacatctaggactttgatatctagagaggagaagtcaatgtctagctccaaagcttcaaaggatgagctgactcctgtcaggggctaatgtagctggtgacatcagggtaaagccaatgattatttaccatttcaaaaattctagggtccttaagaattatgctaagtcaattctgtctgtgctctataaatggaacaacaaagcctcaatgacagcacatttgtttagagcatgatatactgaacattctaagcctactatcaaaacttactgctcagaaagaaaggttcctttcaaaatgttactgctcattgacaatgaaccaagtcactcaagagctctgatggacatgcacatgattaatgcattttcaagcctgttcacacaacatctattctgtagctaatggatcaaaatgtaactttgtccttcaagtcctattatctaagaaatacatcttgtaagaatatagctgttatagacagtgattcctccaatgaatgtgggaaaggtgaattgaaaaccttttggaaaagattcaccattctagatgccattgagaacattcatgattcacaggaggtagtcaaagcttcaagacttcagtggaggaagaaactgcagatgtggtagaaactagtggagcctgaaaatgatgactgatgcaatcatgatcaaacttgaacggatgaggtgcttcttatgaatgagccaagaaagtttcttgagatgacatctacttctggtgaagatgctgtgaacatggttgaaatgtcagcaaaggatttagaatattccataaacttgtttgacaaagcaggggcagggtctgagaggactgactctaatgttgaaggaagttctactgcaggtgaaatgctatcaaacagcgtcataagctgcagagaaattttctgtgaaaggaagagtccattgatgtgacagacttcactctcgtcatattttaagaaactgccacatccaggctgggcacagcggctctggcctgtaatcccagttactcaggaggctgaggtgggaggactgcttgaggccaggagtttgagaccagcctgggcaacacagcaattccctatctctaaaataagaaatgaaaaaaattagctgggcatggtggtgtgtgcctgtagtcctagctactcaggaggttgaggtaggaggatccctggcgcccaggagtttgaggctgcagtgagctatgatgatgccactgcatgttgacaggctgaacaagaccccatctttaaaaaagaaggagaagaaaacaaattgccacatgcatccctaccgttctatgatttgcaaccaccaccctggtcagaagccaccaatactgaggcaagacccttcaccagtaaaaagattatgatttgctgaagtcttagatgatcattagcatttttaagcaacaaagcatttttaaattaaggtgtgtattttttaggcatgatgttattgcatacttagtagaacacatggtgtaaatacaacttttatatgcactgggaaaccaaaaagtttgtgtgacttgctttattatgaaatttcttttacaatacatctgagttatgcttgaacatactgtatgcacacacgcacacacacacccctacctttgaaaaatcatagaaaaatgcctaagatgacattacaggaaatagacagttgctactggaatgcagaaaaatagaatattactcttttttatacctctatattatttgaattattaaaacaaacatgcattgcctttcaatgcatgtttcaatgcatatttgttttaattgcttttcaagttatatgtcaaaaattatttaaacatgcaccactaccacgtatgtacatgggtaccaaaagtgttgttatttttaggtgaatgtttaaatttcctatattataataatcattgtaatcattctgctgaaaagattatattcaagaggctggatactagttacatgattcttatttacaaccccagaagaaaaaaaagaaagtgtatgggtttcaggaaaccaagggatatttcatgaaggctctatttccctgatcttctgattgccataaaaaaaaactgaacaaacacctgtttctacatgtcttggaacaaggactacacacaacctgttggagacataaagactgtagaccacacttctcatgtgggctgaaggaaaagaaagacatgctagaacaccctaattgatgtttaggggcttttccctgataccatccctctttgtggtccaggaagaggccctggcaatgtcctcagactgccatgtgtgaaaataagatatctttgtattgtttttcttaaataaggttccctaaattgtatcagtttcaagctctacaaaatctggatccatccagtttgaaggtaagttgaatcacaaataactgctgcttatccaaaagcatcaatatcattatacaaatggtacttattcttgaagaggtaaactttattagatatctatagtcatttgtaaaaccaacattttgtatttggtgtacctgagagaatagtgaattatttctaagaactttaaaacagtctgtcccaaagaacaaaatgtaggatcagtacttaatgaatcacagaggagatatacagaacacctgaacaaaaagtataaatccaaattcagcaagagtggcaaagaagcagtaagtaagtgctcaccagcctagggataaagatgtcctcacttaagcagaagttggtcagacatgcaaacaggaacaggaaagccacagaaataaaagctagtgttaccactacaaattgtcaaggggagatggcaggttagccaatgaactttgatctaatatacagatgggtgaacaggttcataaagaacatacctgacctatttctgaatccactaggcaagacacccatcctcaaaaacaaaagggcatcagactaatttagcctgattccattaggatatctaatttatctaatcctccttgttgtaattccatgttcaccaaataaacttttcattgctacttggctttctaccccatgggatgccaatattctgacccttgtgactgcctaatacaattacagatcaataaaaggggagtccagtttctacaccaatcacattagcttgcttaataggactggattctggaaatagaatccattttcatttgctcttgagtttctgaggccaatggccagaccctgaatgctgatcaatgcaagaagggacctcttggagaaacatcattccagcctttcctttgaaagttgccaatccctgtgtgattagtgtaacttccaatctgtattttgattatcctcactagacattgccagcaatcttgtcaaacaacaaagcatctaaagtaaatataaacaagatgtacataaagtgaaaaacatgtaaattttttacattccttctttcaaatataagcttacgccacattacatttcttaagtatcaatttattccagataacactttctgggcttctaagcttttaaaaattatttttacctatgtgattgattattaaggtttagtgatccggtctggtacatctcttccaactgcttcctgtttccaaagtataaagcaaggtctgtggcaatgatggctttgcggatgatctcaagcacctgctcatattcactggagctcagagtggagaagatattgtgcccttccaactagggaaaaaatacaaataaaaaccaccaataacaagcacaagctctaatcttatgacatttttagttatttgaaactatatagtcagtcaatgacatctggcacactaatgaaaggttttggggtaacttttgttttttttgaatagttagaaatgactaacgaaaactgcgttttggtttctctttaagctacagaaacaatgaagctaccacttaaataaactattgcaactataataacatcatttactaccataaaaccccagtgatttaaatatatctagttcttggatatttctaatagtttaaaaaaacttgaaaatgtaaaatatttaagttaaagacttttcctcttaagctaattaaaaacttcagtaatttttgtattatactagaaccttaatgggctaaaaaaggcatctatatccttgtccacttcaggttgtaacataccaaaacatgcttaatagacagtaatatatttctctgtatcctagaagaaaatgtcctacaacctcaataaaatgtttattcaaacacattaaaaactctaagggcaagagtacctttccctacaacacaaatcactgaagctacgacaattctaggaccatcttctattcccaagggaggtgggaatggcagatcatcaccctacacaacaccagaacactggtaatctggattctattggctcagaatatccttcgtgtattaatcttttaaaaactttataataatttattcctgtggaaattttaaggtttttatttgtaattgagggaaaaaaaccctttgttgaaactaaaaagtttgagataattaagatgcagtcaatttgcagattcatcaattattttgatattatttcattattggtcaatatagtactactctaagttgattttcaattaatttcacttttcttaatatacatttattgagttaaaatacagtaaaaacacaatgattgaagcatatttctttaaaaaattagacatctcactaagacactgtctcttcatattcttaaatgaaattgtacatgcaccatttgttttcaattatcagaacagttccatattatttgctcttaaagtcttagaagtatttgaattattgtatgataaatgcagcaaatggactcaggtctagttatttattttcctgacaataatagtagtaagaccttacatttgtagaaagttctacagcttacaaagcactttgaaacacacgacttcactttcaaattataaaacttatattagttcagagttcccacatggattgtacatgagatgctatgagatgagccgtttgagcataggctggttagtgactgatggggacaacgggaggggactcaggctttgggctggtggctgaactcaataatcatccaagctcgactctcttcaattttgttgtagaaagttctaagaaggaaatattgattcatgctatggtatctgctttcctttgaagtgaccgtaactcacgtgaagcaggtagctcctgcatcaacactgaatgcctgtcacctctatttcccacttcatgaacatgtttcagcatgtctggctggtgctcacgcacacatctgctttcagcaggtcatgtgaagggaatcacagctgatacaattttgtgctttgtatttgtatgctttactctctttatcaccaataattatcaccataacctgttaaattataatatataaaatattctagtctgctgttgacatttaaaaagaaatatctctaaaatagggtctccttagcctaggctctgtaaattctgtagggggacaaaagagttataaactcactgcaattctacacactggatatgtcatctgtaagctcatgtttttatcagagtcccaaaagtgtcgactgtcccaaagcaagttaagatttattttaaagaatgtatatattctactgactactttggagtcattacttttcagtattaaaggaaactaggtgaaaaagctccatagagggcttttataataaaaaggtctaactcatttactgtccccttcaataatttacaagagtaaagggaatgaatgaacaaacaaaaaataaatatctcccttttctttctttgagacagagtctcgctctgtcaccaggctggagtggatctctgctcaccacaatctctgcttcctggattcaagcgattctcctgcctcagcctctagagtagctgggattacagggacgcaccaccacacctggctaatttttttttttttttttttttttgtatttttagtagagacggagtttcaccatgttggccaggatgctcttcatctcccgacctcgtgatctgcctgcatcggcctcccaaagtgctgggattacagacgtgagccaccgcgcccggccacgtctccctttactttaagagaatctagcattttgctgctatccaaactaaagaaaataaggaagggagatacaagcaatgaagcatagcagacaaacagtatcttctttaaacctccaacctcacatttgttaacacataataaatccttataatgcattataatacttttatacaccaattgataattttactatagttacatagtttgaagtctatgttaattcaagctagttgattccattttgcataaatcaagcatgaaatagtagactttttacacccacgaatgtttctaaaacttaacgtgggtgaacagcatgtaattcttaactctatggaagcacacagggaggctctggttgtatgtaaatgctgtggctgagatctgatattagagaatggaaacaatgttgaaattggtgctgacgctgaaagatgacccagggactgccttgaatagatgattctcaacactccttccagcccttaatcataaggatcctaaaggctgttagtattctgtccactgctgggggattagggaaccaccgcttttggaaaaaaatgtcaacgatgcaactaagcgcatcaaacattcatgatggcaatgcctttacaatacatagaatactgattttgaaagttaattacctagtacatgaaaccacatattagggagcattatagtactgtaattaagagcaccgattttggagccaaataattctatcttttaatgtcattctgccacttactagttatgtgacaaatagattacttaacctccttgatgcatattattctcatctgtaaaatgaaaataaattaatacctatctcatggggatataataaaaataaactgtattaaaatatgtacaaaatatttaagtttctggttcattgtaagtacccaatacatgataaaacgattactattataatagtgatgattgatgatgatgatgatgatgataaaatctaccagtacaacttccacagtcagagttaaaaaaggaaagacagatgaaaaaacaaatatatgcctaaaagagaatttgatagccaaataccttttctattcagaacacagctgtagaaaaggacggatttaaactagccactttgtcatatattttagattaccagtacaggtagtgttgaatataagtacaataattttgctataattgtaatatacaacagcaaattgtatctagtgcagacgaattggaagaactctctagctaagtaacagaaatagtgcttctataaagagtagtaagaagtcacgggatcccaaaatgttggtataaatagataactttctgaaatatgatcacatttcaaaagcaacagataatttaagattagtggaacattaagaaaatgttctcaataatgagaataatcattcctaattggtctgttttctaaaattttgactatttttaaagtcaaaatgggctattaaaaaaggcaaagaaaaagtatagtttcaatgttcaaaataatcattcatatcttatgagtaaacagaataaattgatttaatattccagcaataatgattcaattaccattactaattgtaagctagtaagttttaggcaagaaaacaaagctcacctacgttcttggatgtgactgtccacacaaaacagtctgctcacatgaaggcattctgcttgccttcttcccctgctcagtgtctcagttctctgccccaccggacacagctactcactttcctcacgtaaagcttcagtttcagtctctgagtgctggttctgcccactctgcatcttcccctccccatgctctaccttcacacttccacttgtgcccatatcaacagccccagaggtgggcctgtgagtccagaggtgaagaaggggcagtgactctcctcatcagcttctaattcagaagaagtgggaagctaaactcacaaacagaaaacttcaatacagtgttaaaaacaaaaaaacaaacaaaacactaagatgtatgtatgcttgaggtgctcaggcgctatgtaaaagggggcagtgctgtaccccagtcatgtggggatacactcaaagaattttacaggatgaggtcatgcctgagtggggggccacaagaaagggtgtggggtaattacatgtagagagaacccggccaatggcacagggttaagatacggtctgaaactacagaagcagagcagatctgtagtcctggaacagacaggggccactcatgaaagacttgtatatccactaagaaaacaggaaattattccagaggccccagagagtcactaatgacttttaaacaggagaaaaacatattcagacatatacttggaggacggatttgggacacaaacacttggagaaacagtgatggatgaggaggaaaaggcggaaaaacagacaaaatacgatgaaggctgaaaccgagatgtcaagtagggatggtgcttgccacttgggagctgtagtggtcagaggggccagattaccatttactagagactcaagggactttcctgtctgctaaatgtccaccatgagctctacacagcgacgggccccaaacaccatgaaaacaatcctgatggccagcattaaggcacaatgggaagctcagggaaaaatgagaacgcagactgaccttctctgcagatgctcttgtatttacccttacttcatgacttaatctcttcccattgcccactcaacacgggattatctactgcatccctatcactgtgaccaaggtcaaggcaagctgtgagcaaatacccacttcctgcttttccctaccatgagtaacgtgtgtgtgtatgtgtgagtgagtgtgtgtgtgtgtgtgtgtgtgtgtgtgtgtgtgtgtatgggggggggcgactaaaggttagcttttcaagtctattgtattattctccttgcttgctgttgtcactgtgttagccagcagtactcttctgaatgccctgcttatccagtagataccactggcagccatagtgaaagctggcactcaggttggcaaaactataataagcagccacatatgcaacacacacctgtgaagatgcctgatgaggaactatttccaaccatcatacacaaaattgcttacgtcctatctgtctgtgtggccagaggatgggcagcgccatgctcgtaatcatctgtgtggcaatgcagatcaagaaagcaatgggaaaagtcttttgtggataaacagaagtatcacaggtattcatattatgaaactatatattgttcttattttaatgactggaagttggaatttttaactgttacccaaggatagcatcttaattagtcaagcttgtaggtgtcttttgatgaaacataaaatcagcaggacttggtggtaacaggatggagggatgggaagataaagctaaagaagggaaaaatgatgactctaaggtcatcagcctgcattcctgggtcaatgagattgccaccacagagatataaaatacaaaaggcacctaaataagtataataccaagcacaattcgggcatactgaatacagggttcaactgcttgggcagaagtcctattgagcactaggcagaattacatgggtacgagagtcctcagggcaccactgtcagagccacaggtgtgccaggtggtgggccaatgagaagaacaacataagggcagaagtcaggggactcaggccttcctcactctgacggtgagttccagaggacagggatttgtggttgctctgtttatcactatatccccagtgcctaaaacagttgttggcaaatagaaggtgctcagtaagtatgtttgttattaaattggatttcagggaccagttagatgaatccaaaaaaacactcagagaagtatcatgaggattactgcaaaatcagccaagtgtacagaaattttccgaagaggaagacactcttccctgaatgttcctgcccatgtagattgggttgtctgtttatggccccaatattatttctctctgggcgtagctcaaattgaagggatttggtcaatcgaacatataaatttgttttcaaactggcagtgcttttcatctgaattcgcagcaatccctaatccttattcccagcttctgtttttgcaatgtacctagcaccttatcttctctacgcagaacaaatttgtcattattattaattcaccaatgactgaaattccagctctaatatctgaacctattctcccatgcctttttgaatgccaacagcttacctgtctgaacttaacttactgccatgagctcctgttactagttctgatctgtttttaggaacaccgccttaagtaatctgcaagccccacatcgcggagggtttgccaaaatggaggcaaaccaccctaaacctccatttttgatggcagcaactgggccaagtcttcctagggtttaggtggacctggagcttcaccatccccacctgccttgatgtgactgctatattacaaggtttatttattattctgctcaggggcaataaactttgcaatctggcctccttcaaaactaatcctattatatttaatacagcctttctaaagaaactctatattggctattaaaattcagctgtgattaaactgctagcaatgttgtactgtcaaatgcatgaattcatttagggcatgggatgctaattcagtgactcctaattatttttaagtgaagtcatcctgatgttgtttctggcgtttattcttcttaaacaaacaaatagtctccaatgatgaatgaggtcaaagtagacattagctgtcataaagttttagaatgttcatccatttacaaaaaagcatgttttacatatatgtgtaaatatatgtacacatacatatacacacaagccttttatcctgcttaaatttctatgtatgcagccaggcgcggtggctcacgcctgtaatcccagcactttgggaggctgaggcgggcggatcacaaggtcaggagattgagaccattctggctaacacaatgaaaccccagctctactaaaaaaaaaaaaaatacaaaaaaaaaaattagccgggcatggtggtgggctcctgtagttccagctacttgggaggctgaggcaggagaatggcgtgaatccaggaggcggggcgtgcagtgagcccagatcgcgccactgcactccagcctgggcgacacagcgagactctgtctcaaaaaaaaaatttctatgtatgcttgttttatgccggtatgtatgtatctatgtaaacatatgtcatttaaaaaggaaagagctggtgtcaagcaaatgataggaatgatgactacatgttgctttcacgaccaaactgaaccatgagcaagctcaacatcagctacctactggggatggcttgaaaatgactcaaatagctccatatctgaaacacttttcacttctacccagaagataattcgaagagcacccacaatagagtaagttcatcatttaccttcgtaggcctgaggacatgagacctggacaggtcagttttgctgggttttaaaaaggactgagcaggcagcactaccaatcacgtggacagttaaatgaggaggcactaagagaagcctttgggaaactgaggggagaaaaaaaaatcctggcatttagaggaggcctggcctattcaacagagaaaaactgcaccaagtggcaaaagcttttctgcttcgcaacttgcctatggccagttactggcagagtcactgctggcattttgctgtgacatcctaaaaactcaaaaccttttcccttagacacatcattggaagacctaacgaggatttctcttcctacttagaggtgctgacagtgagaggaaaatatagggcccactatacttaagccaaacccagattatatttttaaacattgtttgtgataggaatcaagtcactatgatgtaatagctaccttgataagatgagtttgagaaaaatcatttaagaaagaaggagcgtatatatcccatgttgaagtgatgtctgtgattgtctacatcaattaccaagaacatcttaaagacaataaaataaataaacaaaacatacagtgtaaaaaaagaaaggctacaatgcatttaaaaccttatatttagctaacttttaagatttgctgttcaatatcttcttgttcaagaatatgataatctatataattaattgatttaaactatgtaaaataagtattgctttagggttacaggtacttactgatataatgtttaaaaaacaaatgtgattgcaaaatacatatattcaaattatttgtaaaggattctttatgcaaaaaacactattatttaatgatgactataaatataaggttctacaataaaaagtagctgttgcttttaaggaagccataatgatcttccttttccacctatgaagtatccctatctcccagacagcccttcagactaagcgagagacggcgtgcagtgactcacctggaggatggacacagtctgggagaagtggtgctgctccatggtggaagtggagtagagagcggccagagggtggtcgaacttctgcaggtagctgttactgaagcccctgtggtccaggtcatgacacagacacgcaatcagcagtcctttgcgctttaaaaaataatatgatgcagagatgctcaaaacacagaaacacacatgagcagacttaccgcttacattcatgtcacattactttctggcattaatatagcacaaatacagcattctggcataaagaatcctatacaaatagagcaaacccttaggaatcttggaaattccagataatctaactcatttgtaggccctttctttgtttctctgcttaggaatctgatagtcaaattatttttgagtttctctctcaactctaggaaaaggtgcaggaggtatcaacttaaaggtataaagcaaatgttccaaaaaagtacagataaagcaaatctgcacaaggaaagaaaggtcagtttcagcaaaatctattcaatgttaaattctaacaatgctattgctattataaacaataaatataacaggtaaatcatatcgcatgtaaaaatggcaaatatatagaaaaaaaggcagagcaggctaaaggaaattagagaaagtcaggctgagtatgaaataaactaggcaggcacacctcatgaaaaggccaggtgtgagcaaagacccgaaacagggtaaggagagcggcaagcgcagtgtgggagaagagcacgccgggcaggggagcagtaacaacataaacttgaaggcgagtgtgccctgagactcggaggatcaggacggtggccagtggggtcgagggcaggggaagcagtcatcataaaaggcttatattctcagtgatctggggaactattattacacggtttttagcagagcagtgttaccatcttgcttatatatttacaagattattctggcaactgtgtggaaaacagactccaggaggatgagagatcagtgaggaggtttctaaagtaattgaggcaaaatgtaatagagctttagaccaggataataacagtgaaagcttctatggggtgattaaagtctggatgcattttgcaggcagaaccaacaggattttttgactgtcagagtgtgaaaagaaaggacatgaggaggggtcaagtatgacctcaaatgttttggccttagaagctataatgattaccatcaactgatatggaaggactgcaggtggaatgggtttgaggagggaggtcaggagctcacatttagactgaggcgaaggagtctacttgatagtcaagtggagatttgacaagtggagattttgttttgacaggtagcagctactgaagcctcacggcctggagataggcctttgctagagaaatgaaactgtcagtgcccatgtggcgtttaaggccacatgactggctgagctcaccaaggttgtagtttgaggttggaggagggtcaaggtctaagctctcaagtactcccaattctaaaataaatcatccagcaattaaatacttgataaattaaatacttgataaaaattgaagggaagaaagaactctataggttaaatcctattacaacacatttcatatgacagtttctattctttcatgaagggattttgagtggaattcaggttatgccaaacattgcttgaaaagactgaagtgtttaaagaatattgactcaatgtgttagtaacaatcacaatcacaatttttattttgaaagacaaattatacctgaaaagggggaacagactgcatggtctaagtctgaggaaagagaaggattaagaaaaaaacaacaaaacaaaaacaaacaaacaaaaaaccccaagggaggaacagctggtgcattcgcaggaaaaccaagagtgccgaatgtcccgggattcgattgaagacactgagcactaacccttggatctcgcaaggtgtgggtcactggtgacctggagcagggcattttctggggtgttaaggtcagaagcttgatcagagttgttttcagaaagaatgcgaggagaggattttgaaagagtcaatagggtaatgcttacatggggtttactgcaaagaagagcaaagtaacagggagggagctgagaagagcggcagatcggagcatattctaagatggaagtaaaaaactgcatgcgtacatgcagatggcaatgatccagaaaagaggggtgaaagcatgataatggaggagagagaagagtgggaagcactggtaggcagtgttctccaagaggtggaggcgacagatacaataaagcagaagggtcagctctggagaggagtgtgaaggtttaaggaagtgtgcaaggcagagcctgctgagggcagatgcagacagatgggggtgctgcgatgggagtcagcagaagttctcacaggtacatttttagcgatatgcctgcttctttgtcctgataatgctgaactggtttttcccgccacataattggaagggaaatctcgccagtaacccctaaccccatgaagtatcatgttaacaatcatactcgcctggcattcttaagataactgaattaattatgttgttagtatcattttgttttggggtggtttccatgttatatgctgctgtgtcatcatgatgtacctgataagaaatctcaagagttttacaatcttgcacaatacgtaaaagttatcatctttccagtttctaaactcatttttaaaattcatgtgactttcagtagttttattaaaggtgtgccagaatcatacatctgaaaataatgtataaagaatcacccttgttaagcatttccctttaacaagatcaaatggtaacttctaacagttcttttagagattaaatttcttctttataaaatatgttttaaatatttacatgtcattttggggattatttttcagccaaaacgatctgatgttttgggaaaatgtaatgatataattccaaaaatgaattaggaacttaaatgagagtcaatatgtatcaacaaagtttttctcacttattgttaaattttcaatttttttgaatataaattacaatgcaacttgaaagtataatttctacagttcttaaactcacaaggtatggcaaaatggcaaaacaagacaatgaaattgctttcttaaaaggaacagaatggagaaaatgctgaaagtctcaacagtatggggttcaatagaaaaggactttgttaagacaaacaaatgaaaaaaggagagatttcatgtggatctttcgcggggaggtgataaataataaattactgatcaggctaaactccacttgaactaaagattgttttaaaaaaagcaacaaaaactagaggataattttttattctttcttaaaatgctactatttttttcctagaatgcatcttttgagttttccactcagattgtgaatttggtccaataggatggaaaaggataggatggaccttcacaagtactagattctagtttaaatgtgaatttgagaaaagcacaatttatttatcacaaagatgacagctcctttctctggacagtcataggtcccctaaaagatgataccagtttttacagaggagagaaaggaggactccctctaaggtgtcagtagatactaccaggatcaatgtggtcagagggagggatatccttcaaagtcgggattgtccagatgtagaatcagcatcctttgtggccaggagtcactaagcatttagcctggctttcaagtaagggactttgactgtggttgatgaatggaagtggccatctccaattctaactctgagattacgaaagctttggatatgtcactaactctgggtatttaaagtcaggcaaattaattaaacatttcagatcctttagtttccttatgctagaggaggtcaaaaacacttatgtcttcacagtattgaatgctctaggttctcaaataggcaggatacgtctacattatccagggcatataagcaatgaataaaattcactgtttatatcccttcagaacatttaagctttaacaggtaagacagactacaaaattagtatttccttgggggatattttgatgaagttaaaatttcttttatctacatttcttatacaaaataatatgctaaatgtttgggtacaagagtctaaaaatgggctactattgatttattaagccaaaatttgtcttggaataacatgtcacaaatccatgtcatcaatgtgctcctgacacacagtattaaatccactgaggttacgagaaacagaggtaaagagtgcacacccacctcaaggtctgtgaaaagcgtgtgattgttctgaagtatggcatacatgcagtgtgctacagtgaccgcatgcttccagttgtgataaggaacccgccgatagttcttcttcacagacataataaaacgacacaacttttcaagctcaaagctgcatggaaaagaaattgttatgactgaaaccagtagagaatcactatgttgtaggagaactccctagtttaggtacatatatgtctgtacccttatacatttgcaactctaaagatttccaccctgactgaatccatgagcactggaaactcattcaccagttcccttccagttctctagccaaaaagaagtaagaggataaagactcttttatggtatctgttgtgatacagtaactgtcccaccagcgaaaaaatatcagtattagtacacagtcacccgtcaccagccctcatgatcttctttagttttacgttcatttcctaaaccccacagtgctcaaaagacaacaacacagcaccatcttgctaaagggtattttgagctaatattttccaaaaagaatattcagacttgcaaactgcaaatatgtatatcatgagacttttctagagttactatactttcaaagtaattccaaagtattaaggtttattacacactcaaattattaagtcacaaatgaacatatccaaatactgacatagtatataaaataatatgatgtatattttattacatatagttatactatatttttatattttttatattatgtacttatttaagaccctacaaactctcaaaatagacttgagacagcttaaaacaaaagcatatataaaacaaggctttctaaaataccagggaggtcaagaattcataaaaacttaaaaaaaaaagtaacctgtgtttttctccactgaaaattttcaaatgtctttgaagtataaggtatggcattttaagaattccaactggtcaaactctcaactgcattctgagaattaactggagttaggtatcctatgctcatccttttgaaacactaatttacaaaaagtcacagatagaaaatacacaggcttcaagaagaatgacaatttagttctagagaaactaagaggctctataagacatttaattcctaaatgagtaaaaaagagcaaaagaaaactattccttgcatttaaatattgtgtgtttacactgaaaaggatcagttataaagtcaggaaaggcctctaggacaggccaaagtgggtggggaaaagatctgcaatgaaatggtgccataatcaaattactgacaaagtatcacactttgaataagaagacatgtttcttttcgatctattctaatagatatatgatgttaggttgaaagttgatgctaaatttacacgtggtgttctaaacatttattattattattattattattatactttaagttctggggtccacgtgcagaacgtgcaggtttgttacataggtatacacgtgccatgatggcttgctgcacccatcaacccttcatctacatttgctatttctcctaatgctatccctcccttagcctcccatcccccaacaggccccagtgtgtgatgttcccctccctgtgtccatatgttctcactgttcaacttccacttataagagagaacatgttgtgtttggttttctcttcttgtgttaatatgctgagaatgatggtttccagcttcatccatgtccctgcaaaggacatgaactcatccttttttatggctgcatagtattccatggtgtgtatgtgccacattttctttatccagtctatcattgatgggcatttgggttggttccaagtctttgctattatgaacagtgccacaataaacatatgtgtgcacatgtctttatagtagagtgatttataatcctttgggtatatacctagtaatgggattgctaggtcaaatggtatttctagttctagatccttgaggaatcaccataccgttttctacaatggttgaactaatttacattcccaccaacagtgtaaaagcattcctatttctccacatcctctccagcatctgttgtttcctgactctttaatgatcgccattctaactggcgtgagatggtgtctcattgtggttttgatttgcatttctctaatgaccagtgatgatgagatttttttcatatgtttactagctgtataaaattcttgtcagtagtaacccctgtctctttcagttacccagctgaaagaaactctagcctctgtttttatgaaagcttttcagattttttaaccaggctacaaccatgttgctagagcccctacagagaatctgaaaaggctgcatatttgtataataatctcagcccttttttattggaatatttaggaaaaaaagtaatttatacatgcagtatttaaaaataattacaaacaaagatcgtggtgaggcatatatgtagaaggaggaagaggttatgtcacccaatatttcaaaaagtaaattttaaagtcattcataccaggatgtcccacaggaccgatgaaccatgtagacaaaaattccaggccacatgttttcaaaaggaccaatgtcaaagtggaatctgaaattttaaaagggcagtttatcactaaacgtgattagaataaacacagtaagtaaagaaaagcatttaacttgtttgtaccaaggagctaaaaagacactgggagctcagccatcccttttcctgccttcttagccacatagctgttactgaaagatttccaggaagaaactaaacatattgccttagaaatctagtccaatatttgagttattgattttctattaatctgtttgaaaatgatgcttcatttgttgtcagagaaataaaaagtacaaaaaggtatattacaaatattagataaatatacaatcatagaaaaggggggaaaagccttttcagaagtatttttggagttgaaactgttctatctcctattttaactgagataacaatttcactaatataaacaccagagttattacctatttttcatttgctaatttagttaccaacattagacttgaataaacagtatggtataatatatactataatttcaattgtaaggtaaatattagctctaagtcacttctgaaggtttcctatgtagatagtgttggcttacacttacaataaacatacaaattatcataggccctaccctctagtaacttaaatatattaacatagggttaaaaaatacagtatgagagtcaaactatgacaaaattcttgaatttaatttggaagtttaaatttatatggaaatgagaactgtttgatatcttctgttaaatgccattttgagtgttaaatattaaatggtataaagtatgcaacagactaatgagaaatgctaacatttaggttaactcatttcaaaactgagttcagattttcttttttaaggtaatgagatctggcctttatttccaaatcctatcataatatctggaatcacttcagaagcagacaatggcaacacatgaaactccacatgtaatatgtgtataataattgtgactctaattctataatctgtctcactttaagttcaattcaattaaaaatggttcctgaagaaactgacagagcaacatacttacaattcaatttctttgcagagacgcacgggaagggtgaattgcatgagaccttgccactcttctgaagtacaaatgctatggtaggacagcttttccatcgttacccggtaaatgcactctgagtggcgaattctatgatacatctagaaggcaaatccaaaaaaaaaacccccaaaattaaaagaatatttaaactgttttgtcacggaagttcagaatttggtattaaagaatcagaactagaattaaaaccaaagtggatttattattatccgtatttccatatgcactgggatgtgcagacatgactttgcagattcaaaagaaatgctttttttaaaaaatggtatctctgctttacaaatttttatcagacattatctctgggtgatgagattacttggcatttgtcttccttaaaatgctctgtatttccgcatttttaaataaaaattaaacacattttattatcagaaaatgaatatttgtacttttaaagatcatcgtaagatctaaggtatttctcaatctgttacaacaaaacctttaattattgcatttcacctgcacatcaaattcatcttccttgggaaggttttatcatcattaccttctctggtttttagtcttgactgtatattgttactgttcttaacaggactgaatttggggtgttattggtgttccagcaatgaactcaaatgagtaacacaggtttgcattcgtcagtcatagactgtgtctacagagtaagtatataaattggtaattacattaatcgaaaatggataggtacattttgccatcctgttaagttgaaatcttgtgtatctgtatctgtgtgcaaatgttttacaaataattataaattaatatgtgagataaaacaaaaacatgcagtggagccaaaggaatggatcaatatttatacttgtgaattattaaataggtgagattaattaggaactgtctaaagtaaattaatactgaaaacgtggtgacaagctagagtagcttttgtaacattttgcatttttaaaataacattttctaaaggatagttcaccatctataggtaagactatccagtctacataaaaatataaatgaaggctgggcaaggtcactcacccttgtaatcccagcacttttggacacccaggtaggtggatcatctgaggtcaggagttcaagaccagcctggccaacatggcaaaaccctgtctctactaaaaaatagaaaaatcagctgggtgcacgcctgtatctcagctacttgggaggctgagacaggagaatcgcttgaacctgggaggtagtgattgcagtgagccaagatggcgccattgcactctagcctgggcgacaacggtgaaactccatctcaaaaaaaaaaaaaaaaaaaaagaatgaagctaaatgggtcaagagtaaagatactttctttatttcacaatttaaaaatatttagcttccttcttggtgatctcaaagtcctcttggtctagaggttactaaaatgtttgattgtgaaaaccttatcagtaaacaaattgtggcaatgcaaacccaatgaatgaatacacagtaattatgtgcacacaaactgtgttcatgtattatttacatacatagaaatcagaaacattaaaattaagtgggtatatttttaaatattttacttactaaataagtctttgttcttactaaaaaattacatatttttaaatgaaagtactatatttaaatgttattaatcatcaaatgctttatttaatacttttggagataatgatctaagggatggttcactttaatttatttcagtatttagattttcagttatactgtttgagaaacatattccttaagaagtatgtcgatccaaatggaataaagtttgtattggctgtggctaatgcctgtaatcccagcactttgggaggcagaggcaggcagcaagactaggctggccaacatggcgaaaccctgtctctactaaaaacacagaaaaattagccaggcacggtggcacacacctgtaatcctagctactggggaggctgaggcatgagaatcatttgaaccagggaggcaagaggtggaggtttcagtgagcaaagattgcactactacacttcagcctgggcgatagagcaagactctctctctctctctctctcaaaaaaaaaaaaaaggttgtattggctgttcttaaacattacacttatatttttgtttcctaactactaatatgtttggttgaaattcaaatgcatttcctttgttctttatgtcaatcagttgaccctgcaaactaatcagccacatttttatatattaccaatatgggttcaaaatcaatgaaaactctttgtggagaagatttctatcagttaaaacctgcttcatataacaaaatcattaaaattcaattttaaaggtagagagaaaaaaagggggaataaagaacagattaaacacatagaaaacaaatggcaagatggtagatttacacctaaacgtaaaatgtgaatggtctaaacatcatgactagaagtcaaagactgtcagattgaataaaaaagtatcagccaactatatactgcttacaagaattctactcgaactataaagacatagagtaaaattaaaatgatggaaaagatatactgtttaataccagtcaaaagaaagttacgactttattaataataacaggctaggttgatttcagaacaaagattattactagaaataaagaaaatcatttcaaataacaaaagggtcaggtcatcacaaggatataacaaccctaagtattacactacctaataagatagttttggtatacatgaagcaaacaacgacagaactgcaaataaaatagacaaatagaaaaatccacaattatagttagagatttcacaccaccctttcaactgaactactcatacatcaacccaatcaaaatcccagtaggcttttctataggaaattaaaagctgattctataatttatatggaaattcaaaggacctagaatagccaaaataactctgaaaacaaagaataaaggtaaagaaattatactgcccaaatccaatacttattataaaggtttttttattatactttaagttttagggtacatgtgcacaacgtgcaggtttgttacatatgtatacatgtgccatgttggtgtgctgcacccatcaacccgtcatttaacattaggtatatctcctaatgctatccctcccccctccccacaacaggccccagtgtgtgatgttccccttcctgtgtccatgtgttctcattgttcaattcccacctatgagtgagaacatgtggtgtttggttttctgtccttgcgatagtttgcggagaatgatggtttccagcttcatccatgtccctacaaaggacatgaactcatcattttttatggctgcatagtattccatggtgtatatgtgccacattttcttaatctagtctatcactgttggacatgtggcttggttccaagtctctgctattgttaatagtgccgcaataaacatacatgtgcatgtgtctttatagcagcatgatttataatcctttgggtatatacccagtaatgggattgttaaagcagtgtggtagtggcatcaaggggcacaaacggatcagtggaactaaatacagaaataggaccacacagacggtcagctgattttcagcaaggctgcaaaggcgaggccataaggaaaggatagtcgattcagcaagtggtgctgcaacaaccaaatatccaagagcaatatataaacaaataaataaaaactttgacccttaccttgtaccatatacaaatatttacttaaaatgaatatagacttaactatagaacctaaaactataaaacttctagaaaaaaaaaacagaggagaaatgtcttaacgaccttaggttaggcaagtatttcttcaatacaatgttaaacatcataataaaaggataaattgatcaactggacttcttcagagtttaaaacttttgctcttagaaagaaaccattaagagaatgaaaagacaagccaaagactgcgagcaaatatttacaaataatctatctgataaatgaaaatgacctgtatccagaatatataaagagctactaaaaatcaataagaaaacaaaccaccacaaacaaaagatggacaaaagatgtgaaaagacacttcaccaaagatggtgtacagatgacaaatgtagaagaactggaacacatgctgtgatttatggaatgtaaaagagtacagtcactttggtaaacagtttggcagtctcttaaacagttacagacccctcccatgttacccaccactgcacacataaatctttacccaagcgagatgaaagtctatggccacttaaaggcttgtacacagaccaactgtttgtttgtagctttagtgtaatagccaaaaactggaaatcactcaaaaatctatcaacaagtaaataaattagttatggtatatccatacaataaactactactaagtaataaagaggaattaactgtttacgtacacaacaccagcaatgaatcacaaaattatgttaagtgaaaaaagccaaataatacagattatataattccctttatacaaaagaattttagaaactgcaatttatagtgacagaaagcaaatcaatggtcacctgaagatgagaagggtcaaaagaaagggattactaaggctatatttattatactgattatgttgatggtttcatgggtatgtgtgtatactaagttgtacactttaaacagttgtacgttattgtgtatcaataaacctcagtgaaactattttaaaagtttctgctctgtctttttaagggtatagatgtcataatttgtatacatgacatataaatttcagcaaaaaagtcacgtgacaatgaaaatactggcaaagatctgttttcaaagtgctctcttcacagcatgaatttctttggaaaccaattattttttcattcagtgttaatgtcactggcaacttgagggttcagattaaatgttatttctctgaatatatcttctaaatactttcatttgtcattagaagaagttagcaaatttggaatctttgtctttttgtgaaagaagcatgtatacctaatttattaactgaacaactgtaccaagcattttgctgcaaacggcaaatctgtgggtagcacaaacgaaaacgcatgaacattctgaaatcatcttcataaccgtgattttttttctaactgataaaataatcttccttagtaaagttgagaaagagcacagataggtttagaagcataggctggacactgctgtcaccttttcctagctgcgcaaggcccactctgtgagaggagactgcttcctggacaagacatgaccttctagtgcatgaactttctgaaagctccatccatgtattaacaatcaataaaaaattatttaatatcatttacccaaaaacatatcaagacccaagttttcacattgtcctcatataccttaatggaatgtcacttgctttccactttagagatgatagcgtagattctgctaggaaagtgaacaatccacaggatttactcagtatttactgtaaattggtattacctgtaatacagtgcaattctatggtaaagatgttagtaagagtaactatactaggcagtaaactaactgctactatagtcactaattctattgagcacttgcgccaggaagtatgctaagtgttttgtatgcattacttcatgtctcacaaaacttctacaagatagttattccttttattgtcattttatatgtttatgacctaaaattagaataaattttatttctattatttttacaatttttgatattaatatattgaaaatacgtaaaaatttaaattaaaatttttagtcatttatttttatatttgtaatcagtgtaggtaaataacactaattacaaaataaaattaattaaaatcacagcacaaaataattagttttagaaaatttatattacttcccattttctaaatgacctttaatatgaatagtagaaaataatataatctaggattattagtagatgattttatcatactcatgcaaactactgatgaaggtagaaaactatgttgtctttttaggtgcattttgtataaattatttgcctataacactgcgtaaataatcttggagtcactgtccaagtagaagagaattctagcagaaaaaactgctgtttgtctaaaactgaaatatattttgatggcctatcagtcttaggcacgaggatattgaaaaggtatatgtgctcaaaaaacaaaacgataaagacaacctggaaacaggactgtaagagcatgtctaccacacattaaaaatacatccattcacattttataaaatggcattcctactcaactggcatacaaaaatatttaattagtgattatttagaatgttgttattggggcctatttacacaataaccctcattacacttagaaatgactgtgtctatgagacaccctaatatttgtaattaatgttcatagtaaacctagagtcactttagggtcgggcaactcttagaaatctaaactctggaatcatctacttggaacaaatctcttgtccatcatttactaattgtatacatttaggcaaatcacttaattctctgttccccaggatctcatctgtagcctaaggacactgtagtacttagccaagaatgtaacgttcaatggaataacacggggaaaggctaaggaaaagcactggccagtgactgtgaagctctcagcgctatcagcaaccgttatcttagatgggtatcagcactgtgttgccacatcatttggctcttttgtttgattttggtgataatcaacaagagagtctacttttctgttgtggcagtggtgcaccgaactggcttgcaagagccaattatgcacatttcttcccaactctgcattcattatggcgcatgggtagcttgaaattgtccatattgagggaatgtacgccagagaaacagggaaacacacaaatcaggacccttctgtttttagagaggttgctgttaaacatttactgcacaccaactggtattctttaagatacaagtagtttgactttgggaacacttgagatataataattgttctactattataaattgtgcactcttttcccctatttaatttacatttaaaatcgaattgacaaaatacttattaaactacatattttctatatgtttgtcaatagcattaaataatatcattagtcaaattaaattgattctctaagcaagtcctaaaatcaaatacatactccacatacatacggggaacactgaataagagacctgtaaccacccttctactctacactgtcatgagatctactttttagctcccataagtgagtcagacgtgtgatatttgcctttttgtgcctggataattttatttaacctaacgaccttcagtttcatccatgctgctgcaagttacgcgatttcattcctttttacggctgaataatgttccattgtgtataatgttggttaaggggtacaaaaatacagttggataaaaggaatatgttctattgtttgatagtacactaggaaaattacacttaataatttattgtgtatttcaaaatagctagaagattcataatggtctcaaaacaaagaaaatataaatatctgaggtgacagatacctcagtcacaccgatatgattaccacagtcacaggtatccaactattctacatactcccaaaatatgtacaactattataaatcaataaaaaggaaatgctgtgctgtttatttcatagcatagagcagtgctgcagccgactaaagaaataacagacccatcgcagggtgtggcttgaggctcccggatgtgaagggaaggtccatgcaggatgagacttccctgtggctgcatgaggagaggagctgaactgagaactccataagcaaaaaagaagccttgtctctacttggggctatgggtagaaaataaatagtctccatccattgagaatatggaaatcaagcctgaaccatatgtagttgtagtttccaaatttatcctaacatattgcaggaatttcaagctaaaaacttaacagaaacaaaaacctggacccagatcactgaaagcctggggcacatggaaaacattacatatatctgagcatgagggtctctcacaagggagataatttgagagaaatttgagtaggtaaacaagtaaacgatgacctgaaaaaaaatctaagaatggaaagatgaatagatattagtaccctctacaaattgagctaatgaaaaacacttactgagagatttaaaatacactgttgcaaaaatacagcatttggtatgtgacttaccatgcttgcacaactattctagtttatggaaaccacagtaccaaaatgcaaaaacaaaacaaaacaaaacaaaaaccacaaggatttctttctgtttctttctcagtagagttgtatctttgacctaatcgtgggtggaagtatttaaaacactttcttaaagacaggcccaagcacctactgtctatggcaccatagagagttctttcatgctgaggactgcaaaggtgacaatagtttcctctaacgtgtttcagtggatttgaaagcactgggaacaaattaaaaaaaaaatgtgtgtgtattatgttcctgtgaaataagagacagctgaattcaggagaaagtaggggcattggaaaaatgactctctagctgtgtgccccaaatgcacctcagcgtatagaagacaactggtgtcctaaggtaggaatactgacttctctcttcctctgtaagctcagaagttccatcttagggcagacataaaaggtacctctataggctcttccttgctattttccagtaaataaatgaagcaaatcaaattttaatgaaaagcaacttggcctgtggaaacaacaaaccagctatatatttaacaatgaattgaaattttataaaattggctgcaatgataattcataaaatataatgactaatgtgaaaacaaaggatgcaacactgactgtctactatggactatgcactgttctaagagtttattcatatggactacgcactgttctaagactttattcacatatctcattttgtcctgacaataatcctggggaataagtattgtttccgtttatctgttgagggaactaaggctcaagaacataagctgacttccccaaggtcagaatgttggaaagtaatagatcaggttgtaaaatgcatgtctgcttgattttaagttttgaatcctactacacacacattgagaactcaaaaagtagggaaagaatgatttggaagggtggagggcctagtgtcatagctgaaggagagctgcatctactgcagagcaggcgcttttggaaatgatacctttaaggtcaaataaaactggaaaattgtcctgtagtctgtgccaaggaatatttcaaatatataaacacaggacatgaaaccacctaggatgtagggtccattaattcttaatctgtacctagcatctaggagtgattaatgcttatgtgtggaacgaacaaatgtccatgtcagttataaattttataaccttataaccaaaagaagaaaaaaaaagactgaactcggctgaaattagttatctataaacttgtagacttggagaagtattaaacttttattttcatgtaaccccaaaaataattcagtttaagaattgttattcattagtatctaagagtattcaaattcaagatgagggaaaaggatgtgtgtgtgtgtgtgtgtgtgtgtgtgtgtgtttctgtgtgtgatcatgtcaccactaacaggagatagttgaattttaggagataactttgtgactcaatgcactggtataagatgtatttttgatatttcttagaaaacttttcttgggaatatacaatactcttaaggcaatagttcatcatctataattacaaatttaatttacataattctccttggaagtatgtcccaagtgttaaactttctgttaatcgattccaaactctttcatgaaccctatccttgctctaccatctatattactttatcgatgaagttttgggtttttttcctaaactttcccccttcatttctgacaaaattaacctcaccgtctttgatggttaattctaagtgtcaacttgactgggttagaggatgctcggatagcaggtagagcatgatttctgggtgtttcagtgagggtatttctgggagactggtactggaatcagtgcactgagtagggaagacctgcccttatccaatgcagtagggcaccatgcaactggctgaggacccagacagaacagaaaggcaaagggaaggcaaagtgtctctctgttctaaagctgggacacctaccctgtccttgaacatcagatctccaggatctctggcctttggagtttaacttgcaccagctgcaccccagcttctcaagcctttggcctctgactcagggttacaccatcagcttccctggttgtgaggctttcagacttggactgagctatgctactggctttcctggttctccagcttgcagatggcctattgggggactttttagcttccataatcatatgaaccaatttccctcctaagtcctcgctcgtgtatctattcatctatatatgtatcctgttggttctgtttctctggagaaccctaatgcaccctaatccatattttatatataaaatgtaaaaacacttcgtagtaattgtcttccctgtaggcaaccttaggaccttagggaagaacgatgtcagagagaagccagcacacttagcgagcacggggaccagtctgcatgcattcaaaccctggctctatcacatacttgctatgtgcccttggggaaattatttaaattctatacatccattttttttcttataaaacgtggagataataataaccacactcatggtattgttgggagaacatacaaaaagagatttcgtatgtaaagtgtctagaacaattcctgtcacacaataaagccttatatcaaataagagttgttcttatcatagtcatctttatatccaccatctggtataaaaaagataggcaatacttggtggttgaattctggaacgaataaaggttcaaccacttattcaatttgtccctaaccaactaatttcattttaatagcaaattttgttcatgcccctttcatgttaaatgtctttctatccaaaatgtacagagctaatctgttttaaaagatttatttttctaagcaaaagatgtaactgatactactgtcctattagcttttctaaggcatattaaatggtttctttaaaatcacagtataaatgagtaaattaattgacttggatttaaaagatgttttctgttgatagtacttcccagtatgttagctcaataaatgaaagagagatgctgccaatcagagacgttcccctttaattaaataaaaggaatgtattcaagtatttctaaagatgaaataaaggaaaataaaaacataataagcattaacatggcctatgtgccctgcttcttagataggctcttaatcaaacaagaccacaataaaatatgccattacattatcatgttcagtattagaaacaagaattttcatgtacaaaacatgcttctattacggacacaataatttgttcaacagcagaaatactctgaattccccaagatcaacacaattaaaatgacaataacggtcaacaattaaaaagcacttcatgctgcacaaagatttttcatatttatgatcttgatcattactaatgtatgttctctagaaagtagaacattcaggaaaaggtagggaacccgcagatgtgattgtttgggacaacgcataatacaaggtgtttttcctaattttcatatgatgcttgggaaaaaaatgctcaaaacagcaaagcaaaattgctcaagaacaaccgcaagcatctcggtgccacagtgatgaccagaatttgggtcttggtcattggcagtagttcgtggcatcaaccttttcaagtgggtaaggttctagggatcccactataaagaaacgcgatgctatcttattgaaaccagcatacatttggagctattttcttttatttttttatttacatggatgctttcttcaacaaggcaaaaaatatcattgtaaagaagacatgtgaactggtctttctgaattggaacaaagttttgaaataaacccagccaccagtcttcatcagactggaaggccagggagaagagggaagaaggaatcattatgaagctgtggactcaaatctcttattccttttgagttggaaaaacttcaaaaataatataatttttatgagctttagtaaggagaaaaatatactgcagttaaaaaatggggcagggcgcggtggctcacacctataatcccagcactttgggaggccgaggcgggcggatcacgaggtcaggagatcgagaccaccctggctaacacggcgaaaccccatctctactaaaaatacaaaaaattagctgggtgtagtggcgggtgcctgtagtcccagctactcgggaggctgaggcaggagaatggcgtgaacctgggaggaggagcttgcaacaagccgagatggcaccactgcactccagcctgggcgacagggtgagactccatctcaaaaaaaaaaaaaaaaaagaaaaaaggtaataaattccacagagagcttgcagctgcactgaatatattttcaatgtataccttaaaggtaatcagctttggctgggcgaggtggctcacgcctgtaatcccagcactttgggaggccgaggcaggcggatcacctgacctcaggagttcgagaatagcctggccaacgtggtgaaaccccatctctactaaaaatacaaaaattagccagacatggtaacgcatgcctgtaatcccagctactggggagcctgaggctggagaatcgtttaaacgcgggaggcggaggttgcagtgagccaagatcacgtaattgcgctacagcctgggtgacaaagagtgaaactccatctcagaaagaaaaggtgtctacagccataccaccctgaacgcgcccgatctcgtctgatctcggaagctaagcagggtcgggcctggttagtacttggatgggagaaagaaaaggtaaccagctttggtccagtgcgggtgactactcgacagaactgctgctccatatactacttgtcactgttggagaaaaccactgttgtgatggggtttgaagtgtttagaaaaattataatcatttccaatatcaactaatactagttattttaccaaaattttaccctaaataatttaactaaataatcaatgtaaaaatggaatgcctattaaaacttttcagaagttttttttttttttttctgtgtggtttaatcatgattaaatccaggtattatgataccacaattagtgacttagaaaagcatttgaacctgctagtctagttcttaatttatgtattcttgaaagtatacaacaatatttcaagggatacatggacaaatgaataaattttaagatgatcaatttccatattcttaactttcacacatattcttactcaaaatgactttttcccacatcccattttgaaacagccctgttatcaaattgctgtaatacaaagcggcaatataaaatgctggtattaatgagggctaataaaggtttctgaaactttcctaaaatattaaaggtgaacttcagtaaattctcaactgatagctcattaaaataatttttggtgtcagaattatcagtactttttggcatcttagctcaggtagaattaagagaaattgtgataataaaactttattaatggaagcaattcttacagcttccttaaaaaataagagggacaagttggaataagattgatgctgaatagggagagccaaatttctcactgtaacaaaaaaagttccgaagatgaaaatgagatggctagagcattctgtggtattagactggaggttaggtatcgtagagacagaaagagacagacagaatgaacggacgtagagatttatgtataaactctcttctaaagaagtcagtgagaaagtgggggtaagttcctgtggagaaacctgcagacaggacctttcaagtgcagacggttaataggctcagtgacgaagcacatgcctgctaacaggatgcactgaggacacatccgcacgtgaactcattgtcacaaataagaccttcatataattgtgaggaaacaccagacaaatccaaattaagaaatatccttggccgggcgcggtggctcacgcctgtaatcccagcactttgggaggccgaggcgggcggatcacgaggtcaggagatcgagaccatcctggctaacacggtgaaaccccgtctctactaaaaatacaaaaaaatagccgggcgtggtggcggtgcctgtagtcccagctactcgggaggctgaggcaggagaatggcgtgaacccgggaggcggagcttgcagtgagccgagacagcgccactgccctccagcctgggcaacagagcgagactccgcctcaaaaaaaaaaaaaaaaaaaaaaagaaatatccttaaaaaacaacaggtgtatacgctttaaaaatacccaggtcatgagagacaacactaaggaatagttccagatgaaaggagactcaagaggtctgcagatgagataacaacacagtacttgtgatgggttagattgtggcccccttaaaattcatgtattaaagcctaagccccagtaccttagaatgcagctgtatttagagatagggcctttaaagaggtaactatggtaagaggagatttaaagcgtgggtcctaatctcatatgactagtgtcttcataagaagagtctaggacacaggcatgtacacagagacagcagaaaccatgtgaggacacagggagaaggcggccatctgcaaaccaaggaaaacaggcttcaggagaaacacaccttgatcttggacttccagcctccaaaactgtgagaaaaaaatttcctgttgtttaagccacacagtctgtgatgtttattacagtggccctagcaagctaatacagtaccaatgttaatttcttgatttttaaattatgcagtgaaaaaataagataatgtccttgtttttagagaaaatacaaactgaatcatttaggagttatgagacattacatctgaaacatactctcatatagattggagaaagatagtatctatttaacagagaaagagagagacagagaaagtatatcaaagcaaaaatggcaaatatattaacatttggggaatatggataaaggtatacagggaactttatttttgcaacttttgcttttgtctgaaattatttcaaaatgaaaagtataaaaattatgctaaatctagtttcatttaacagtaagaaaaattcacgaacagttatattaactattgctgttttaagccataggtatctaagaaaaaagttttcaattttttttttattttttgacatctatcaaaatgttataatagttgacttgatcacatatgtgataatactaataccaccacaatccaaaatgaattttaacacttattatacatgttttagacatacccatgtattatcttataaatagaaattatcttagggtaattaataaaataaagcataaaatatattcaacttttgttggataacaaatacatattcagagagtaaacataatgccaaattttcccatcctaagatcttgctattgtgttttttaatatattataatatgtatcaagcttctatgatacttaaattccattggctacatttaaaaatgataaaacagtcaatattcagaataaactagaaattacaatctttgcgacttttaaactaaatgagacaagcataagctgtcaacattatttatgagagacacatagatactaaaaatgtttgaagcaaaagtgtttgacagcattcctagtttatttctgaggagctatgtaacagaaactgtcccccaaaagggcaccaggaatgcgtgaggagagaggacgggtactctcactaaatagcacaaactgaattaaaaacggttaccctcggtcaccagaagttaagttttaccaatgcttgtccctaggtatgtctccgcttgtcctatgagttacacggttactcctatggaatccagtcctactcccaaaaaagcagtttctctaattgattaagggggcaactgaatgtatgttgatttagctctatgaaaagatcaccatactaaaattttccctaacctcagaattctagtaatattattaaaggattactagagtttacagaatactaaatgttccattcatctaaaatataacaatgtaaaagacagacaataaattccactatttttaaagtgagacttgagaatgcacattgaacttcattttacccttcagtgaacacggtacaactttcacgaggactgagttaacaccgagaatgcatgtgacatggacaacctggtgcctcactttttgtcacaaacagaactttcctggtgggtgtccaaacatgagctatgactatacttttgtgtaaggatctcaaatgaatgcatttgacaaacagtcaaggtttaggtagcattttctttcttcatttcagtagataccattaaatataagactgatgcctggacatgttacctttacagtaacttcatttttcttcttaacaaattcccaccttgaaataaacgcaaactattaggagactgttatttttccttccagggcattttatgacattttctaaaacatgtacaatcaggaatcacttacttttcctggtttgtaaaggaaatataaatgaaaaaaaaaaagcccttaagctgctttatgaaaaagattccaaattaatattgagtagtaaaaaatggtatttaataaatagtacttacattagcacagtgtaaggctaaagcacaaaagacggcaaacattttgaagttgttttcatctgttttagagaaggcactgccactgattttgttgaccatctgcaccacacctatcacgctgcctcggctgacgatgggcatgcacaggatgttccgcgtggtgtagcctgtgtacaagtctacttctctgtggggtgacagaaccaaaaataacaacaacaacaaaagggcagaagaaataaaggacacagtcagtcataaatctcccctcaatctttgcaatttacatatgcttctattgcatatgactaatggcacttttagcttctacattcagggacagtaacattccacagagttttattaaaacctttccaaaaatattctaatctgttggttcttttgtctccaagtgagttttctaggatagtctctaagaggctttcagcttatcatttgaagtatccagcattactaagtaaacagaccaaaaaaaaacgtggattcagaggagaaatacaattaaatttggtaaaataacataatcctttgaagttgatcgtgtttatgagagatataacttgctaaaccaacttatagtgtttccactttaaaaacttagagcagtggtcagcaaaccgcacccaggggccaaatcagccctctcctgtttataagtaaagttgtattggaacacagccacaccattcattcacatattgtctgattctgccatcaccccacaaggctgagctgtggacttgtgacaaggacattagtgcttataaatgcaaatatactgaccatatgatccttaatagaaaaggcttgctgactcctattgtgaggacatgtttttggaaaacaggactaaggtgcatagaaacagtgacatagctaacggtaggtagttacatgggagtcttcagagcctggcttctctcatttagcataaaggtttttgagattcatccatgttgttgcatgtcttagtggttaagtcctttttattgctgagttatacctctattgaatggacatatcgtattttgttcattcattcccagttaatggacaatattatttttaatagccagtttgggcaattataaataattctgctttgaaggtttgcatacaagtcctactgtagcaccatatgttttcattttgcttgtagtactatctagaagcggagctgattagtggactgcacagtaagtgtatgtttaacttttcaagaaactgcaaacctgttttcccaagcggttgtaccatttcatattcccaccaacaatgtatgagggtactcgtttctccacatcctggccaatgtttgctaatgccaatgttttaaagtcccagccattcaagctgctgtacagtgaggtctcatgtcaactacatctatattcccctcacttcgagcatttttcatgtgtttggtgatcagttgtatatctccttttgtggactgtctgttaaaatcacctgccctttgtattaaattgggttatcttctcattgttatgctggaagagtttttatatattagatataagtattttgtcagatacatgttttacaaatattttctcctaatctggtgcttgcattttcattttcttaatagtctgactcatacatttttacataaagattggacataaggatgagcaaatatatttaatttttaagtactaaatgatgagtttggacttttggaaaaaaactttcagtgtacccttaatttattgacaatatacattactagaatattcctatgtttttataggagttgtgtatatttgacatcaattgatcaaataactgaataaacttcctattgcttatgttatttgtctcttaaagtaaaccacgagttggaattaactaaacactgctgtcaaactactgtaaatattattctctaacagtcacagcatcaatcctgagactttccatttctagcgatttattaaaatcaaattacataattgggtttgcaactctccaaagaaagtcaaaacaaaacaaaaaatctttataagccttcctaatatccatctttaataatatccaataaaagatgtaacttatttagttactttgggtcaggtaaattttccagacctttcatgaatattatctgtgatcttaaaacaacagcaacaaaattggcattatcatactcatcttaaagatgaggaaactgaggctcagagagattaagtaacttatgctaggtcagttgagagctaagaaatgacagaaccgtgcttcaaagctagacctactcatctcaaaagcatgcaaatttcttactatgtgttgcagcctttgagcatatgatttgacggagaacatgtttgttacaaaatcatgacactataatggaaaaaaaatcccacagtagctctataaattaaaactaccgcctatcagttgtttttataacattctaaactcctgtatctagatatcatgatacattagtggattagaatccatcattttataaatatctgaatatactgactattgatagcagagttggttcagagaagaaaactaaggaagaaagaactgaattgggacgtggagaactcaggctccacggaagaggtttcagctgagtgggacatcacagaagaaatcaatggagtgtcgacatcagctatttcttacctgttaaagcgtgggtctgcataggcatctggaatgttcaggacttcccctgttcttgctacttggccagcaattcctttctcaattgaaaatctgcatatgtaaaagagaaggacatgctaattaaaatatggactctgtagaataattcaaaaatattccattgttaataatattgaattaaaagcactgttttacttaaatgcgtgtattacttttacgtttacatattctaaatcaccttatgaagtacgtaaaaataaagcagaaaaccattacacagtaatcacctgagaaccttaaaatattaactcacaaactgagatcaaacaatcaactagtatcctcctgctctgaacaataataatcccttctatttgcgaagcaccttataatttacaagacgcttcaacataaatttttttagtggattctcaatgaggtgtgaacgaaggcctatatgggttcagtaatttgccaacattcataaaatatcagtggcacaaggaacactagaatgctggtctctaccatcgtgctttctaccacacatataaccaaactcacaggttacacgtgagcttgagatattatacagaactgaattttatggtgtttgcaattcaagcactatacagaaataacgcaatgtacaacttctagtatttttacctaatttgttaaattttaaaataatcaaaatacaaggattgtctgttttttatatctaatatcagtatttttcctttgcaaaaatattttcatacttatatttttctcattactataccatcatcacacaggcactcatttcaaaacttccttaattaacaaagatgtctacaagtcacaatatctacattttacatagttcaaaaataatttccatattattacattgtcaacattataggaaatcaccattattgaaataaagctagaggactatcagaaaaactcaaaagatagttcacacaaaagagaatctacttaaaacaccaaagagtgaaccaaacactgcataaaactcatggttgtctttttcctggttttcttgtgctttgaacaacataaacacaatgaattagattgccatgagcaaagggtatcagaatccatttgatgatttatgcttctttgcgttggtctgagagcagtctgaactataacttttgttcatgctctctgtggtttgctatctgtggtcaatggaagccataattaagaagccgcccttacataaatggctgccattaaccagtcatctgagagttacagtaaatcacactctgtttttcttacgcttataaacacaggctttaaagttgttattttcaaaattaaatcaatgccaacagtgttaggaaacactcaaatcttcagcaagagaaatgacttatctaaatgactatatccagatgctatactgaggtctaacagcaacaacaaaaaaaaccaacaacaaacagacaaaaaaattttaaaacccaagtaccaatatagtgcctataaatcagagttaatggacatggaatacacaggaagcgctgaggggcagacagtggtggggccccacggtgaggcacaccttgagtttccctgacatcagtctccttttatgatagaacgcccaaataaacagcaatccttaattaagaagacacagtgttttgccagaatggtgttattaccagagaactttacggtgttatacagaagatgagttaaacgagacacatacagcaaaagaaatgcaaatgtctaaaattattttctcagcttctgaatgttaagctcgattcttaaacgttttgtcagagtgctccttgtgtaggtttccaggtgcgatatgagcaagcccccatgcctccatcaacaaaataaactccattctgttcatttaagtgacaacggctgccacttaaaaaaacaaagacttcagtttcaagatgcaacacaggtgtgctatgtgattgattaaaacagctggtcagtcacagagtgtatttaagtcatcaaatataccagatcaatttctactactgtctggactgcgagacaggccaccggttgggaagaagtaggggccgaattgcataagcacaccttttctcttggacatgggaaaacctgcagattccaggtggagtgtacctttacctacctgggagcactagaaagtttttccaacatgatttccaaaaggaccgcctccggaagacggcatttccaggagtgacgctaaggcttcctaggcgcggtttctcgggcactgcctgcaatgtcattcccagaagtactaccttcaggaggcgggtcctggtgggaatgatatcacagtatgacaagtattgtcagcatacctgtgaataggcacagaaaaatgggtaacggaacgcctgcacatctaccgtaagaggataggacattctacttctagctgtaccttatctctttggtcttcttgaagacaggttttccttccttttcctctccaatatcaaaaaggtctgaatataactccttgttcttatggtccacctggaaaagcgcacaacgatcggcattcaccaggttttttgcatatatctaaagacaaatgacaaaataagaggaagacaatgagacattcaaagaacttgcaggtaaactttatcataaaataagtattaatttcagctgtcctatactctaattggttggtattagcattataagtaaataaatatacaagtatataaatatttcatatatatgatataaaagtcactgttacatgctaatactaacagatcccaacagaatacacagcggatatgcatccatactgctgtgctggagggaagcatatcagtcgtgtattctgacaccaactgacacttctgttttagttggtaagcagctgctggcctaacttcccagtgcccttctgccatccaaggccctcttccagaacctctcaggccttccctggtgcctagatctgagcctctgtcagcactacgaccaccactcattctgattagttgaagtctgtgatgcagcaggtgtaaaagctatgaaatataacctctaaggagatacatggctttcatatttgcattagctgagttttatttgatgtactgtctaataaaaatttgtacagattattaagtgtttactatgtgccaggaacatttatacaatttatatgaattgatttgcctgctcctcacaataacaatattaacgcaggaaaatcttttcccattgtacgtattaggaaaattgaggcactgagaagtaacttgccccattattacatgaatagtaaatggtagcagtatttgaactgatactagctgttcccatggcccatgcttttataacaaatatgcttttccatttctaaatggaaaccatgtattcatttcattactcatttgttcttccatttccttcaacaaatatgtcttcaatgcctaacatatcctactgtcctgagtgggttggggctacagctgcaccattaatacagtatttacctctattgagaattctggtaacttcaactatccagatcatagccatgaaattattcctcggagaaaaagaattcatccttacagtaaaacagccatcacaaagtctctgcaagaggaaccttgcagccagggcaaaatatagcatctcatataaaatgtatagatttaatagaaataagtctaagttaggtaactgtcttcatcctattacacgtttgtgctcactactactatagaactattacactattacatgtttgtactcactgctactatacaccaaacaaatactggctgtgcccactacgcagggactgagtatactgcctagtatcaggacctctaggttacttctcacctcccttagcctgtgagctacagaaacagcagaaaccacttctcttttcccacagtattccaaatgctcagaacaaggctgagttagggccagcgaaattttgtggtccaaaccctgctccctgcttgttaatgtaaataacatttttattgggacatagccgcgttcattcatttctttatttttatggctgctacaacagcagagttgagtagctgcaagagagtatggcccacaaagcataacaatttactatctggccctttacaaaaaaaagtttgccaacaaacccctggcttagaacatataggatctccataacccaaaactctcaataaatatttgaggaaaaatgaatgacataaaggcacagcgagagtgatggggctgagtcgttggcaaatacagaagaatcactcatctaattcacaaacccatgagattttaaattattaagtaacaagaatgatcctgcattattaaacattaaattatattcagtgaaatctgtatctgcagtgtttgaggtaatgtcagttgcttaatattttggcataaatatgttaatatttgtttaaaatctggatcaaatggacaatgtttcagaaaataaaataagcttagaaagtgctgaaaaatataaatccaaccagaatcataaagataattcaaaaactatcaaaaaatattagcaaaaaaggcaccagcctaaaatggcttcaaatattaattctttaaaaatcttcaacaaattcccgtacaatttatactgatctacattcagaaaagaacaattttttccagttgtttttacaatgtatgctgcgtcactgatactgaaaactgacaaagaaactataaaaaagaaaatcacagatttacttttgaaacagaagaaaagttataaataaaaattcaacccaatcaaatttagcaataattaaacaaatatgacaatattaaaaacagagtttattctgaactgtccagtagcataaagtctattatcataattcataatagcaataagacaaaggagaaaaatctgcgagattatcgtcatggttgtcaaaaagcatatgatgagcctgggtgtggtggctcatgcctgtaatcccagcactttgggagactgagatgggcagatctcttgagcccaggagtttgagaccagcctaggcaacatggcgagaccccttctctacaaaacaatataaaaattagtcaggcatggcagcatgcatctgaagtcccaaacactcaggaggctgaggtgggaggatttcataagcccaggaggcaaaggctgcagtgagccatgactgagccactgtattccagcctgggcgacagagcaagaccccgtctcaaaaacaaaaacatgtgatgccattcagcaatcattaatgataaaaactttagtaaaatggaataaaagaatatatagaaaacgtaataatgttttcctcaaaacaacagtccatattataccaaacggtaaaataacaaaatcgctgccttaagatattaaagttaagaacaagacaaaggtatgttatcacaatcattagcatgctagtaggcaagaagaacatgtgaggtatacatatttgaagagataaaatttttcttgtttgaggataatgttatttcatatgtcaaaaaaatcaactgacaaacaattataggcagtaagagggcttctgtggctgggtgcaggggctcacgctgtacttccagcaccttgggaggccaagccccttggactgcttgagctcaggagtttgagaccagcttgggcaacatggcaaaaccctgtctctactaaaaatacaaaaattagctgcgcatggtggcatgcgtctgttgtcccagctacttttggaaggctgaggtaggaggatggcttgagccagggaggcagaggttgcagtgagcagagattgtgccactgcactccagccagggtgacagtgccagaccctgtctaaagaaagaaaaagaggcttctgttttaagatgagcatttctaaacatatgttcaccttttcactctccccaaatattaatgtttaactttgaaatgaccctcagatgctgaaaaggagttaaaaatatctaaaattttggtaatatttataaagtccaaacatcaggtcaatctaaaagccacccctactcccttatacacacacatacgcatacacacacacgcatacacacatacgcatacacacatacgcatatacacacacaggcatacacacacacatatgcatacacacatacgcatatacacacacaggcatacacacacgcatacacacatacgcatacacacatatgcatacacacatacgcatacacacatacgcatatacacacacaggcatacacacatacgcatacacacctatgcatacgtttacctataagtgaaacaacactctttatagcaacagtagattttaaattcagttaaaatgtatcttcaaatttctaaggaaaacttactttaagcctaaatgtatttaccaagtcaaactagcataaaggaaaataaagatatttaagaagggtacagtactcagaaatgtactatctttgaactattttagaaaaggagatgggctcaagcaaaaatgaagaaatagataaattcaaggacacatgggaagactcggggttcaagaaaaagtgaggagcaaagaaatcattaaaactatactaaaactgtaacacttgttagtaaatgatatctaagaaattacaggcatcatcatgaaaaattaatttaagaaacatgaaatatataaaaatatttatatatctaaaactatgtaagggtagtaggtaagaagagtaaaaaaaattaggaaacaaatgtgcttcatttattatcttgttggtgaagtgagtgatatgatataaacactgattatttattgattttgatataaaacttcattttaaacataagacgacagctgtcagggctattgctgccatcatgtaaagagaaattgcttgagactaaggactacacaaaagtaagttgaactgagaaacagagaaagacatattcatgaaaagattatttgagcccccatgtccgctaattatataagcctgaacattcaatggcttttcagcagtctgagccagtaaatcctctcttttattatctcacactaatttgagttaagtagttgatgttttcagatcagaaaggaaatataaagtacctacaaatttataaaaattgatttgaaaatctaattcattgattcccaaccagcagctgagccacctggccgcagggcgtctggaaatgagtgcaggtatgtttgttggttacgagttctcacaagctaaagacgctgcaggtctgcggtgcccaggataacactgtgccagagggaactgctctgcctaaatgtcagcatcaacctattgagaagcactgacctagatgaactgatcacctagtaatttaagaattacccagattaggccgggcgcggtggctgacgcctgtaatcccaacactttgggaggctgaggtgggtggatcacgaggtcaagagattgagaccatcctggccaacatggtgaaaccccgtttctactaaaatacaaaaattaagcaggtgtggtggcgcgtgcctgtagtcccagctactcgggaggctgaggcaggagaatggcagaggtagcagtgagccgagatcatgccactgtactccagcctcctgacagagcgagactatgtctcaggaaaaaaaaaaaaaattacccagatttgcttgtctgaaaataataaatcttccgtattataaaaaagatcctcaaaaaagtctaacctcattccccacttgtttcctctaatccagggttatcttttcaaaacacatatctgatcttgcacctctagcttacaagccttaattaaaaactccctcccaggcctgggtgacttggcccttccaggacctttctacacaggagcacactgttcccccatcccccaaagtagaaccctctttcctctttgcctgtgtaacttccacacatccaccagaccaaagtcacagcatcaggaaagcttgccacagcctccccagctacgttagatcccatcacaagctttcagggcactgttatgctccttaataggcctgactctgactagtttcatagttatgttgatatttggctcatgtctgtctccccacagattagaacctcaatgaggacagaggctgtgaagggttttgctcaccatttgataactccagttactatgtattataggaatataacagattcccaagaaacattataaaagaaaagggtgaatgaaaacttgaaggatccaatgtcatagaagaaattgaaaagagaatcagagatctaccccaataagactctaatggggtcttagctgatttatatcaaacatcaggtgaacaaataatatgtacattatttaaaccactttagtccatagaaaagaatggaacatttctgagctcattttataagtgtagcataacccaataccagtactatccaaagatagaaaaaaagaaccattgagcaatccgatgtatgaatatagatgcaaacttggaaataaatattaacaaccaatccaggaataaagaaaatattacaattaaatagcctttataccaggaatgtaagagtggttcaacattgagtaataatacaattgtctactccaatcattttgaaatagcttataaaaatttgataatacccaacaccaaatcagatgcaaactcacagaaaattaggaatagaaggaaatgttttaaaattgataaattatatctgttgtggacccacaacaaatatacatagcaatgaaatgtgagaagtacacacatcaaggaaaataaatatattctcctgttgatatctgttgtttccattcaacagtgttcattaggttccagctaatacattaacaaacacaaagaaataagtactgtaaaaactggaaaagaagaaccactagaatctctactattgtgcattataaatcactatcttgaaaactaaagactataaactggaaaaataagttaactatgggggaccataatcaatacattcagtcaacaattttttaaaaaaaactgaaaataagaaaatgtctttggctaggaagacgccatatgctgaagatatcaattcaagttttctataaatttaggacaattccaatataaattacacaccataatgaactgagattcatcacaggagtgcaaggttactttaacatccaagaatcaattgatgtaatatacactatcaatagaattcaaaataaaaaccatatgatcatctacactgatgcacaaaaattgacaaactgtaacatacctgcatgataaaaacacgcaataaagtaggaaaaaagggaatttcctcaacctgataaaggccctctatgaaaaacccacaaaaaaatcatatttaacggcaaaaaactaaatgcttcttccttgagatcaggaatgagacaagaaagtccacactttgccacttcttttcagtattgtgctgtaggttctagccagggtaatcatgccagaaaaagaaagaaaacacatctggattagaaagtagggagtaaaactgtctctaattatagaaggcatgatcgtgtgtgtgtgtgtgtgtgtgtgtgtgtgtatgtatgtaatccactaagaaactaagaaactattggaactaatatatgagttcatcaagcttgcaggatacataatcaaggtataaaaaccaatgttgtttctacacatttgcagtataaaatcaaaaaataaagaaaacaattccatttataatagcattaaaaaaataggaataaattggccaaaataaaagcaatacttgttctcaaaaaacacaaaacaccattgaaaaaaattaagatctagataaatggaaaaatacctcacgttcgtgtattagaagtcttaattgtgttacagttgttaagatggcaatacttcaaattgctctacagattcaacataattcctatcagcattccacctgatttctttgtagaaattgacctgctacttctaaaatttaaatgtatttgttaggtacccagaagagctaaaagaatcttgaaaagttagggaactcacacttcttaatttcaaaacttactacaaaaccacagtaatcaaggaagtgtactggcattaccacagacatatagagcaacagaacagcatccagcgtccagaaagaaaatggcattttatgttcaactgatgtgctggggaaaacttgatagctacatggaaaagaatgaaactggacctttaccaaacatcatatacaaaagttaactcaaaacagatcaaagacctaaatataagagttaaaaaccctacaactcttagaagaaaatatctgagtaaattctcatgatctctaatttggcttagatataaaaccaaaagcataaacagcaaaagaaaacaatagctaaattggatttcatcaaaattaaaatcttttgtgcctcaaatgacactatcaagaaagtgaaaaggcaacctaccaaaaagggagaaaatattagcaaagcaattatgagacaagggagttacagctagaatatatgaagaactcttaacaagtcaataataaaaatacgaagaattcaattaaaaagtggtctatggctctgaatagacatctcccctaagacaatatacatgcagccaataagcacatgaaaagatactcaacatcattagtcactagagaaatactaatcaaaaccacactgagatagcactttacacccactataatgaaaaagtcagataatagtaagtgttggtgaggatgtggagaaatcagaacccttgtgcacagctgctgggaatgaaaagtggtgcaactgccatggaaagtttggcagttcctcaaaaagtgaaacatagaactactacatgacccagcaattccactcctagatatataccccaaacaatggaaaacaggcattcaaacaaaaacgtgtagaggcatgtccacagcagcactatttacaagagctaagatatggaaacaatgcaaatgtctatcaactgatgaatggattttttaaaatctggtacgtatatccacaaaatggaatattatttggtcataaaaatgaatgaggtactgacccatgcataatatgtatgattttgaaaacagtatgctaggtgaaagaagccaggcacaaaacgctacatattatgtgattcttttcagataaaatgcccagaattggtaaacccatggagaaagaacgtagacaatgattgcttagggctggtgaggcaagtggaaataggggcgtaaggaagtgataagctaaggagatgatagctaaaagggtatcaagttgctttatgaggtaatgaaaatgttctaaaattgattgatgatagttgcacatatccgtgaatatagtaaaaaccactgaatcgcacactttaaatggatgaactgtatagtatgtaaattacacttcaataaagctgtttttaaaagaacatattaataatacaaagaacgagcagtaagtgctccttgtacccctagcataagctcagtgtcagtctacattataactttatatttttcttaaagctactcactgatttacaaattccttcagttgtttcataacaagagaagttattttaatgtacaattattttatttttgtctagataaaaccatagaaataacttatcacataaagaatgtgctgaagttaataacctatgttattctctaattacctttagtaaacttcctgtctctacaagatgttgcacaaagcacacttcatatttgtcttttactatgttaaataaaaaaaaaacttatcagtatgcatcataaaatctctagatgagaaaactctttattgcagaagagtactgtagaaagaacatttattaaagcacataacagggcacaaatggtaacaagaaggcctgggcatgcatggcatccacccatacattctgacaactagaagccacttctgaaagaagtctcactagagacctaaaagtactcagtagcatagggaaatatgcctataactctacgtcatacagctttaggctcaaaagtgcctgacagccatctaggagagaggaataattaagactagaactaagtagaatgaacttgaagatcaggaaaaaatcaatcgagaattccccacatgtcccatatgtaagaggtgttttgaagaacataaaaagaaaccaaatgtcttttctaagtatagctctccattaataaagaaaagctctgagatttttaaaaatgttattcaaacttactcccccaaaattaacgcaagtgacaaacagatcaaggtgaattcctaagccaccacattttcataatattgaaagtgcctgtggatgaataagtttaaatgttatgccatatattagcaccatgggcctaagggttaaacagaatcatactcagaacaaaaacaacctaccattatgtgttcaagtagagaatctattgcaactatgttatcaaaatatgttctgaaaaaaagaaacataaatcctgtaagtaatttcattagttcacagtacatattacactttgaattcatttcctggttttgtctacatttaaataaaaaaccataaagataaatgtcatttgatttttctgctttggcaaaaaaaaaaatcagtactgtaatattattttaaagagataaatgaaactttatgattgacctcagcatgagggctctataattccagagaatgcaatcagtatttattttattgataagtatcagtgtagagagaaagtctgttgcatttaacaaagtatgcagaaataaaattgcatccaccatatttaatattttcattaataactctgatctaaaatacaaatatttaaatgtgctaaatctcatcaatagttaaatataaattatcactgaaaactggagaaagttagcatttaaagtgtactgagaaagtaatgtaattaatttgagaagaaatgtcagaatacaagtaatgctatggatctaatgactttatatgagtatatattcattgttatgaacagcgagtaaatgtttcagaggcaaatagtgcatatactaaaatgtcaatctgaaaaaagataaatcgatatgcatgtaacgtatggaaaatgtaaagaaggactcttaagatagactgcactggctaggtagtgtttaacctagttggctcaggtatccaaggggagctttttcagtcccatacttctttaattttattatttcaaaaactaaatgtaacataaactagtaacttcaaactaattaatgagcatcaagaataattactgatgggtaaactgttaggtgcatatacagtgacatgtgaaacataacatgtcatcgttgttgctggaggccacagaggaaaaactacattattcctttagtgaacttgtaggaggacatgaccctaaagttaccacatcccggcgcatattttagatttcagtgattaattacatgggtcagatatatagatgcagactcctgtagtaaataaaaccaataaaaatatgtgatttaataaatatctattatataattgcttccactgccagccaaagggattttttctaggccaaaccagcgaaataaaacattttctcagaaatgataactgagatactatacatgggaaaatttaaataataataataatgatgcttaatttactgacattgttagaaaaaccaaataggactttttggaagaaaataaaccagaatattttccctcctactgtagccagtattctcctgcataaatagagatatttagtgtctttaacatattctcagtctatttagaaaacatacatcaaatggaaaattaacatcatcacatatatatctgcaatccttcactttagagtgaacgtgaatgagaatataactctacaatccataatatgattaaccgttcccagactacttgtaaagacggatcttcagttatcagctgcaatagacaatggtctatttctgccacaggctgcccttaatttaaaccattgattaataagagctactatccctagaaatgaacacttactttgatacgtcgagtaggaagtcattcaattctgtctgtttggcaaggcctctgcatacctaccatataaaataataggtacaattacaagagatttctgcttatttcaaaataaaacttccagaatactaattaccttatttattgaaagaaggcctaacacaatcacttgggttataatgtaataataatatcaataaccattaatatttactgaatacttaaatgtgctaaacattgttttaagcactttctatttattgtctcaagcaccacaaaacattataggtttggaatttacatttcataatggacttataaagatgttaagaaccttactgaggcttcagaattaataagtgatagaagcagcattcaggtctggatagtcgacccaagtctctctttagaactactttacactgtatttctaaaaactgtagttgagcacatattccacctacacctgataattcgagtcctttctactccttctattatcctacagctcgatttttcttcctagcatacagttcttccctcatcaacctcaatttgctgaaacagaagtagaaaaataaaaccaccaccaaaaaaaataaaaagagagaaggagaagatacaaagaacgctatattgctaccatgttcttgaactttaaagtctaaccaccagtaaaactataagtagttggtgatttttaaattagatatcttcaaaagaaccagatatcttaaagttagaatgtttcatagatcacttagaggaaaatttaatttaggaaatggaatcataaaaatatcaatgcaactccagtaggagattgttcctaggttttcagtggaaaacaaatactacagcaggacatatgccatttattgcattaattatatatgtatttattttatatatagatatatatgtatgtgaatggacacacatatattgcaaaatatttaaggcagggagtaagtaaatataactgattaagttaaaatttctagaaataacagaaaattgtaatatcccaaaataaggcattgggtgacttaacctctattccggtcttcaatgcctcactccaaaaacctcttctcccttaggaagcccctgcaaaaacaccccaaagactcacctgcacctgatgtattgctactgaagcccaggcaagatttgctgttgcaacctaaaaaaaacaagaaatacatacctataagtaataatacataacgtatatatatatactatatataatatactatatatcatatgtataatacataacatatatatactatatatagtatactatatataatatatatcatacataacatatatatatatatacacacacacactacttgtagtcatctcaacaaaggactcggggatacatgtatatgaagaattttctgacatcactgagcttttgaacattttccaaacacaaagcaccaaatatttacaaggtttttcttttatattttccccatctatttaactgactttaatgttctcttgttcatcttaattttggataaaatggaaaacaaactgattgttaagagagctgtagcccaatgattttcacaaaattactacttttcggtttaacaaaaatactattgaaaagcaatctaatgaccactttaaataatgaaatatttctaaaatgtaaaaatcatacacatatatttatacacaagctaacaagttcctcaaaattactagcttttctacttcttttattattcactcattcaacaaatattcatgagtgtctattatgtaccaggcactattctaggtgctggagatactgtagtaaataacagaaatggagtggccttcagtgtacttcagggagaaggacaagaaatgaaataagtgtagcatataatatattagatagtgacaggtgctatagagaaaaagcagaagaagagagaaagaaacattggataggagccattcaaatgtacatgaagtgttcagggagggccttatagagaaggcaacatttaaggaaattctgaaggatgtggctgtgagggggataagtggagagaagaaaaaatgcaaaggcctcagttaagtagcctgtcagccttgcctgaggatccagcgtggctggagcgagtgagggacaggtggggtcgcaggagatgggttcattcaggcaagtgaacaggagtgaggccactgaaggaaactggtttatactggatgtgataaatgtatcattttaatatttgcttttagtagtaatgagcctattgagtgaatagtgaatggaattcaaatgtatttgacactagagtcttttatgcaggacacaagctaagaaaaagacattttaaagaagacataaagacaaccagagtgtgaaaagtctccaaagtccttctactactttctatgactcagagtacagcataccttttattgttacactggattttacttaacaaaaggaccatatctcttatgtaacctgtttcctctctaaacagaaacaggttttaaaatcattatcattagtatcaaaacactgttaagcaaattgtgattttaaatattaattcatgtattttcagtttagtattacttagcaatactaacaagcaccttcaatgagctaggtacaactaaaaattctaacatgcagcatttaaaggccttacctcctggtgactaagacagaaggcttctttgccccagtgccgatacagctcgagaataccaatcaagtcaccaattgcagtgacaattggtaagcaaagaacagactggatacgagtccctgattccagtccagtacctcttggaaatcgttcatcctgaaaaacaaaaagacaaaaagacataaattcagtgaaatgatcattaagtgatgattcttatttctatcagaaattgccatgatacttgtaatcaataataagcagtacttttcaaaggaaaactaaatgatgatagccaccataaatcttaggtaagaaaatgcttactttttcatggaacttatacccaaatactgctttaatatttctttatccttatgcagcataaatttaatgaacgaatgacatatgttaatttcatatgacaataaaaaaagtaatcataaatgctggcacttattcatcgtcttctatgtgccggaacagtcttagggtgtttacaggtacaatgccgcagggaaaattactcaaaatgtaaacactatgtgaagaaaattatttataaactttttttctatttttaagcctagagtaacacaaaagtgtacgttaataacagtcattctaactgaatctcaaaggcccatattaagtatttgaatcaactaataatgatcaattacttatcataagaaatgaaattggttctttgattttaaaattttctagcttggcaaatttactcaaaagaagtacagggggccgggcgcagtggctcaagcctgtaatcccagcactttgggaggccgaggtgggcggatcacgaggtcaggagatcgagaccatcctggctaacacagtgaaacaccatctctactaaaaatacaaaacaaattagccgggcgcggtggcaggcgcctgtagtcccagctattcgggagcctgaggcaggagaatggcgtgaacccgggaggcggagcttgcagtgagccgagatcaagccactgcactccagcctgggcgacacagcgagactccgtctcaaaaaaaaaaaaaaaaaaaaaagaagtagtacagggaaattgaatgaattaatatcaaaagcatcaattctatttcttcaatttctactgtctgtaagaagctatcaggatgaattagaacttcatgaaatagtgtaactctgtacttgtaatgtacagatcttttgaaagcttacatacacaacagaacattttcaaatgagaacttatacagcatgggccctccttctctccttccctcccttcctcccttccttcccttctgtccttctatctcttccttccttcctctagctaccaaatttattcaaggttatacaaataatggtggaaaaaccaaaattaaaacccaggtttcatggctcctattagcacttagagcaatttttttacacctgtgtacttgttacctttgaagtctatattccatgtcataaaatttcattaaaatgtccacatgtactgtggaggactagactgagggctccactttgtctagtttctctgtatctatgtgcatggttagtgatctatactgagtctgggcctgtctacgtgatttgctctggctaatgggagggtagtaaatttgatgtaagcagtggcttgaaaactcacttgtatgtttcccactacttctctcagactcctgttacctcacaaaaacacaccaggatagccttactggaagcgggtgagagacacagggaaagcgatggcataagaggccagccagcacctaactcatggccagctgacctcagacgcataggcaaatccaactgacagcagtccagaccagcagaataacccagtccttagattcataagaaatcacacgtggctactgtatgataccagtaaaacttgaggtagtttgtcatacagcaatagctaactcattcatatgcatcccagcaaaatatgaatcataaaacagtaattatttagtttacattcatatgaatatacacagtatatttgtgtttaactgtactggcatgtgttgaaataagaactgtgcacatttagctgttagtgggtaaagggaattttctgagtacaaaaaattaacttacacattaatatattgatctgtaactagctttaatgctttttaaaatgaaactatttaaattataacatcaaaatgatatgccatctttcttaattaaatactttaggtcaaaagtgtcacaaagaatcaaaaagccacttactccaaggatgtcttctactagcagtgttttcctggacttggccacataagcagagacggtggtgccctgagtgatgggcccagcagggatgaggcggggttttccttcctttatcccaggtggcgtgaatatacacaggctctagggagaagaaaagatgttttacagactttcctgtacatgtgcatagtacaaaaagacacacgtgaatcctaacagtcataataaatctgtgagccaattaaaagaagagtcataaaatgaggaaaggtgctttgccatgatcaaaccagattacctaaagtgaaactatctcacatttccacttcacaaaaaatacacactcaaatttaaaacttaaatgaatgtacaggcacagaaacactcttcaaatagcctcctattttgatacacagaaaataatgaaatgagacaaaatgcatcctgtcattgggatcaagattctatcagaccacaaacacacacagggtccaacctccctacagacttgacacatgttacctgaagacagaatcagtagctgcaagtcaagtgatttggttacatttttcattttcattagaaatcttcccttctgagaaccttctaagactcactcacattacttcgactggctagtttataaaattgcagattcagaatactctagatgaaaaatttgctgttctctgagcaaaaatcttgaaaaatctgagggatctttccctttcaaatgactgggtgggaaggtaatgtcctgaaactattttaaaataaattgttttttaaaaatagcatcagttattttgacgaaatccaaacatattttaaaattactttctactaaataagaattgctactttaatcatgtagaaattgggggcaatattttgacataattgtatcatgattatctacaaaatttgaaaatataaatttcccacagacttcactttatttttatcttatgttggattactctaacaaagaatgaagactacttgaagcaataagtattagacagccctcttaacctaagcacctttctacaatacttgttattactaaggtagttctaaggatgagacaggtattatttattaacttatcaggtatgtggtttttaagccttgtaaaattacagaactctttctttaaacatcttaaaagagaatgaaccccattaacttgactaataaaccccataaacttggttaaatgaacaaggaggaagggagagaaaagcaaagctttgctttaaccttgggtacttgaaattaataacaattataaatgattagaagctaagttcaaaatacttgtatttccaagtatatccacatagggctgtgcttaaattgtatttgctattaagtacgatgcatgtgaaaaatttaagtaattattttaaaaagaactaagctatttaatatgtttaaatagaaagtatacacttatggattaaaaaattacatatatgatgaaagacagtttcaacttagttattccttaaaaggctggaaaaaccattttctagttactataattacattaggcaccaacatacacatggcatagagtaagactatcattagattcagtatctatcattgtccaaatacaattcagtttgtcaccctttcttaagacagaaagagtagaaaggtaattcaagaacaaaaagaatagataaatgcaagaaaaaaaatttaaaatgtggtatatttagaatgaagaaaaattggaattgacaacgattttctcaaactataaggaagcaactgtcccttttctgtaccaaagacggaactgcaggaagtgaacataaattgaactgagtggtttagataactcttaaagaagaacatgtcataataaaaacagaaggtgaactctggagcaagcttccaacagtaactctgtattttttgcggggggtgtggagggagtcatagtttttggctgcatttgtttgtttgaaaatgtaaaacgcacatcttttttttttatgacttagccataggcccttcaaggctgaatttaatcacatgtttaagttatacatagcttcataatccaataataacagactatcttatacattcctacattattagatgatcatatagtcagtattataaaatatgtattgcttctgtgtaggtttcatacaatacacaagtaacagataagcaaatactgtacccaagagtgtatggaaagctcttctatttattacgcttgctgaaaataaaaggtttagaagtctttcaactacttgctagaatatgaaaaacttctctatgtagttaaaaaaaattatcaaaaattgagtaatactttatagtggaaactttatacttattttcctaattagctcatgatttttgttcacattaacccaacagaaatgtttccaatgagagctgaggataaatgctaaccaaacattgaatacattgtgatatgaaggcccaaaactccagcagaagggaaaatgaagcctaacctcacaacacacacttgtttgttgtttctgacatgttttcatggctacactttccctcctttatattagtggttcccttctgtgttgtttttgttttgtttgcctccaaacaatttacctgcaaaagctcctttttaatatccatttctaattgaggatcagtcactggttagaatcacatgttttgcagaagcatatttttaaatgattttggcagttgaatgcattgataggtagctacctgttataaatataaaaagtctaaaatagaggttgaagtttacacatactcagcgctagggaaacgttaatttacattccatttattccacagatactgtcaagtaggatgtcatgggctgaatcattatcacttttccactcattgaactgccaccttcatcatacacttcatcctcaaagacgctttttttaatttttaatttttaatttttttttgagacggagtttcactcttgttgcccaggctggagtgcaatggtgcaatcttggctcactgcaacctccgcctcccaggttcaagcgattctcctgcctcagcctcccgagtagctgggattacaggcatgtgccaccacgcccagctaattttgtatttttagtagagatgggatttctccatgttggtcaggctggtctcggactcccgacctcaggtgatccacccgcctcagcctcccaaagtgctgggattacaggcgtgagccactgtgcctggcctatccttaaatatacttgggtctgtttccgaattcccaattctgtatctttaggtttacttgtataccacactgttttaattattataaaaggtttacagtacattttatgacttggcaaggcaaatcctgacttagttcttagtatttcaaaataatcatgatttattttataagctatacactttggcctgggcgcagtaactcatgcttataatcccagggcttttggaggctgtggcaggaggacagcttgaaaccaggagttcaagatcagcctgggcaacatagcgagatctgacctctacaaaaaataaaaacattagctgggtgaggtggtgcatgcctgtagcactagctactcaggaggccgaggtgggaggatcacttgaagccaggagtttgaggttacagtgagctgatattgtgccaccgtactccagcttgggtgacagagtgagaccctgcttaaaaaaaaaaaaaaaaaagatatatactttgcatttctcattggtgaagtatctacatgaaggcattaatcattaataaatgattaacgtaaataagttctaaagacatttacacaggaaatagggacttcatttttcaaaatcaatataactgttgacttaaagatttaactgggatattcagattaataagataaaaaaccttatgctattttcatagaaggatgaatggaaacaccagacattattttaagaagtattaaggctcttatacatatgtttacaatatcaaatttatctataatatccagtgttgaactgagtctctaagattaattcctgctctactactgtataaatatataaaaactttaattaggacaagcatcttttagaggctagagataaaaaccacaactaaaaaacaaggaaaaactttaaagtttcaaacattagccacctctatcatttccaaagaagaaagtaactgccttcaggatatctactcgaccaaaggccgctgcagttctttagcacttgagagttccagaggtgatggtgaccactagtccctccacctctcaactagcatcgatgagattgcccaaagagcagaaaatcaatcctatcagaggccaggaagtcctaggggaggaatcagcttttaaatttttctaagaaactcattatgaagtagctaatatttttgtggtaacagcaaatttttatatctatttctaaagtgagataatttaaactagaaaagattgggcgcacaagtcataatcaataggttggttcagtaaaggacttaaaaagcattcaaattacaaaaatgtaaattttgggaaataaatagatttggtggaaaatgaacaagagaatagactagtacaatttataaaaacaccatcttttaatgaaatagaaaaatccaattcattgatatcagccaaatagatgtttacctcacttggttaacatttgctttcatctttctttccatgcacaattcaaacatcactttattcatgagacttcatttcaatgttaagacttcaacttacaaccagttaaattttggaaacacttcttaagaagaaaaaaaaagtatttaggtttaccaataagctattatccttttagacactagatggcactggatagtaaacaaatttacatctatgtagacggccgtaagtaaatagctcccacatttacctggaacttgatatatggatgactaactttgtttccataattcttaaaaataaatctgctgaagttcactgtgcacttgaagaaggcaaacaattactataaactaccagctctggatatgaagaatgcagtatttctggtgaatgtttaatgtatacatactgaaggtaaaacttaagattcttctgctcttccatttttcccaattgtatcccaagtaacaaaactaaaatgtgttcttcccagtatgtgggtaataaaaatcaagtaacaaaggggcagggggaagctatgttcttaaaagacgtgttgtattacggtggaaagagcatagctgctctttgtagaaagcacagtaactttggaatgggagcctagcctttagttgttgactagctgtgtgaactcggacagtcattacccataagagaccttggctacctcatcactaaaatgaaaagattagattaaataatttggaagtgtctcttttagctttaacactctatgaatctaggactctagagtcatctagttgctcatgtttataaataaaaataacaaaacaactgtttaactaacttatcaaacctgtaaattatggaaaggttgtttttaaaataacctatatatatatatacaataaatttacttttgaattaaaaattttaaagtataaagtacataaggttttcagctttcacaaacaactctgatagataacagtggaaaaactataaagatactatcatcaggtatgttatacatgtaactaagcatagccatacaaacaataaaagttgaattaagcaaaaattcagtcatgaaaaaattattttttcccaaaaacatctcaagagcactttgtctatagcagacattgctatgggccaggatacaacataagttgttttctttgctaaccccagatttctcagaaattgcttcttctgcccaagagacatcctttactttcccctctcatctactgagaggtcttaaatccccactgaaatattgtcttctcatcatccaatctgtttttatgtgctgcagccccatcgaattcatggtcacagagcctttgagctcctctctgttagcacataaaaatcatgtgctgtaactagctgctgatttttctatctcccctactgcttatacattctttgatgtgagaaataattttgtttttgtatgctcagcaatttagcacagttttttggtacttagcagatgttttaaacggtttgttaaacaaacagcatttatggtgtaacatttaactaatggagggtaaatggtaaattaaggtttagaaagtttaagaatcttgtcaagtcacacaattattaattacacaattactaagtggtaaaacagaactcacacaatctaactccagatccaaaattatttcaatgctaaactacttactaggaagttttccttttttcccaagttctgaaaaagtataacgagcacaggaattctccttcttaaagggctgcctcagtagcaaatgaacaatgcgggtacaggagcccaggctgtcgggctcatcactgtctccccgggtttaacatggtgcctggtgatgactggggctcaagaacagtcagatgaatcaatgccctactggtttgcagaaaggtaatatttcaacagtgtcttcaatttcctccttggctactggactaataagttttctattatcatttgtatttaataggataatttatattttccttgaaaactgttcatttttatctaggttttcacatttgttagtaaacataatccctcataatttctaattttcattatatctattatttgtttttagattattaaacatatatatttcttttttgtcagtttagtaaatggtttgtgtattagtctgttctcacactgctagaaagaactacctcagactgggtcatttatgaataaaagaggtttaattttttttattattatactttaagttgtagggtacatgtgcacaacgtgcaggttagttacatatgtatacatgtgccatgttggtgtgctgcacccatcaactcgtcatttagcattaggtatatctcctaatgctatccctccccgctccccccaccccacaacaggccccagtgtgtgatgttccccaccctgtgtccatgtgtcctcattgttcagttcccacctatgagtgagaacatgcggtgtttggtttaattgactcacagttccacaggcttaacaggaagcatgactgtgaggcctcaggaaacttataatcacagcggaagggaaacgggaagcaaggaacttcttcccatggtggcagaagagggagtgcaaggcgggaagtgccacacactttttacctaccatcagacctcacgagaacacatttactatcatgagaaaagcaatggggaaatccgcccccatgatccaatcacctcccaccaggtccttcccttgatatgtgatgattacaatttgacatgagattttggtggggcaacagagtcaaaccatatcattctacctctggcctctcccaaatatcatgtccttctcatatttcaagaccaatcaggtcttccccacagtccttcaaagtcttaattcactgcagcattaacttgaaagtccaagtctaggccaggcatggtggctcacgcttgtaatggggaggctaaggcgggtggatcgactgaggtcaggggtttgagaccagcctggccaacatgccaataccccatctctactaaaaatacagaaaaaaatagtcgaacatggtgatatgtacctgtagtcccagctactcaggaggttgagacaggagaactgcttgaacccaggaggtggaggttgcagtgagccgagaccataccactgtgctccagcctgggtgacagagcaaggctctgtctcaaaaaaaaaaaaaaaaaaaaaaatgtccaagtctaaagtctcatctgagacaatgcaaggcccttccacctgtgagcctctaaaatcacaaacaagttagttacttgtttggggtacaggcattgggtaaatgctcccattccaaaaggaagaaactggcccaaacaaatggggtacaggccctgtacaagtccagaacccagtaggacagtcattaaatattaaggccccaaaataatctcctttgactccatgtctcacatccagtgcatgctgatgcaaggggtgggctcccaagtccacagccacagctctgcccctgtggttctgcagggtatggcccctgtggctgctttcatgggctggtgttcaatgcctgctactaatccaggcgcatggtggaagctgttggtggatctaccattctaaggtccgcaggacagtggccctcttctcacagctccactagacagtaccccagtggggactctgtgtgggggaccaaatcccacatttctcctctgcactgcactagcagaggttctccgtgagggctctgcccctgcagcagacttctgcctggatatccaggcatttctatcatcctctgaaatctgggtggaggctcccacactcttgccttctgtgtaccacggctagagctgaagtgactgggacacaggacaccatgtttggagcagcaaggccttgggcttggtccatgaaaccatttttcctaggcctctggacctgtgatgggaggggctgctgtgaagatctctgaaatgtcctggagacattttccctattgtcttggtgattaatattcggctcctcgtatgcaaatttctgcagccagtggcttgaatttctccacagaaaatcggtttgtcctttctacaacacggtcaggctacaaatattctaaacttttacgttctgcttcccttttaaacacaaaaccttctcttcatgaacacatatgactgtgcaaggctaggagcagccaggcctcatctccatctgagaccacatcagcctggacttcactatccgtatcactgtcagcattttcgtcacaaccattcaacaagtctcttggaagtttcaaactttccttcatcttcctgtcttttgagccctccagtttcctttgtttttagtcattataggaatcccatgaagaattcttagacagaaattaaatacattaaagttagggtctagcccagaaaagaaaaggaatcacaagttggtaaatcctaacctaatatactgagtttagtatgtgtattatttggataaataataatgtattgataacctcttctaagctgttttcttgatctctcaataattaaaaatactactatttttctgtccattttctccattttgcttcagaaacttcaatgtaccagaataaaagacagtttggttttttaacctgatctaagttttttttcttttaacagttggatcttctttacaagtaattttgttataatcacataatgatttccataataatattttatgttttaattttagtgctttttagtatttagttttgtttttatcttctgctaaatgttctatgtgaaaaaaacacatagaacttttttcctccttgcttatatgaatgcacgtttttaaattctattagaacttctgacatatttaaatgttatttgttatatttctcattacatcaatttcagaaatttaattatttctactgcgaagaaattcatactttaataagtataaaaactgtataattctttctttttttaacccttagtatttgttgatagggacagaaaattttctcagtctatttgtgttttattataattttgtcactatagtatataatttttgttgtgaaattgagttatttaagactttcttgctatgattccaaatcgagacaattttttaaagattgacaattatgtagactatgctgtctttcatgtgcaaaaggcgaaatacaaaaatatatacatgtatctgcttacctgtgcaaaagatgtttcatttaatttaatatggttatattttagaagtgtatcttctattgccagcgatacagcagattagatcatttggctgacacttttgaaaaaacaatttgaaatttatttaaaggctgcataaaatatattttacccatcttttatattgctttgctgggctgagaagaatggaaggaatccacagaaatctaaaaggaagtaaataaaggaactgtgggaggtaaccagatcccaaagctgtctttctcttgagggaattactaatgactgaatagactgatcttctcccaggaaagccacacggagattgagagacaggagagaaaagttggggcctttctgtgaggaagtctaaatagagacccctttagagggccaggacaggcaacaggccaaacattcatcttgggttgaaggacaaatacacttaccccagcaaagaggctgcaaggaaaccagattattttgaaattagtactggagggaaaataacaatctcctctgagaagtcataattgtgcatcatgtggattggactcttgaagccatactactttatagcctgaaaattcatctcaaccagataatttagtttaaaatggttttggattggtagtaccttaagtgactagcagaaacaaatgcatgtctatctccaagaaagaaactagaaaggcacttctaacaagcctcgagagtatccatttaagaggcccatggaagaatagaattcacagttagagagagagagagagagagagagagaaaggaaaaataaaaagaaaaccataaaacacataagcaaaaaagtcaccatctgtcagagttggacgaaacaaagcccaagaaactgtaaattcaaaggaacatagaagaagtatagttaatgtatttcaagaaataaaagacaagtttgaaaatatgtacaggaaataaaaaaccataatgaaaaccaaaataaatttaaaaacagtatctttattttagtcaatattcagagagataatttatcaacctgaactctttatctaccaaagatatattccaaggagcgggtgaaatgaagacaaattcacacaaacacaaactgagagtgctttccatcagcagactctcgctaagggaaattctagagaatgcatttcagatggaagaaaaatgatcccagatggacgacttgagatacaagaagaaatgaagaacaaggaaagtagtaatcatgtagatacatctaaaaaaacacttgagtgaacttaagatttctcagccaaagtcttcttcctacccacagaaatccctgggtcaaggaaataacaaggccttagctatctaggtggaatgcataaagggcaaaatagagtgagcaaaacacagtaattatccccaagaattatcctcccaggcagataaggtatctgtcttcataaagctgacattctagcaagaaagccagataaacaaataaccactcaaatcacagataaacatgtaatcacagactcagctatgttccatgaaggagacttatataatgttgagaaagcaaaatacagtgtacagtgggatctgacttgggaagctcagagacagctacaattttgctatgtaccctgctgttcatagggatattaagttgaagaagacagactcagtccctgagatgcgggaaagaaagaaggaacagggaatcagtgcccctagagagaagcatgcccagtaaatggactgaccttaggagtttagaataaggagccagaataaaactaagaggatattgtaccagtcctttaagttactaaagtaaaagataagtaaagattaaataattcaaattgatacataaaattacaatttagatattgtagatagaaaagcgttttgctgaatcctaagaggaactacttcattgaggccagtgtataaagaagtctgcaaataaagcaaaaaaaaaaaataaaattttttaagccaagtgattaagaatgtgggttttgtaacctaaatccaagcccgcaaagtcagcattttgggctcccgtccactgtagccatagggttcctgctgcctgcacctctcagtctctgcccgcagctgtctctattctctttccacagggcaggagagaccagcctgtagaggcagcctcaacttcaggattgttaccacttttgttcaggtgaacggctagaattgctgagtccaagatacaggttttagcaaagaatctgctggggccctcatgggccacatgtccaccccgatctgaactagagacccgaggataaggggttggaggtgagcacagctgcgtggccaactggggggctgctggaggcggctcagaaggagtaatgtgacgtggaccacaacagactgcattccacacgtatcagccaattaaaaaataatggcaaactgtagaatatttttctaaaagaaattacttttaataaaaactttgacactttaaaaataatttttaatgcaccgaaaagaagtaatatccatttgttattttcgtagcttagccattttagaatactaccagtgtctgaaatatagtttatttagaagtggtagtaatatctgaataatgcaaattaataaacattcttatctgacggtttatatgaaaggcactaggagaggggcttgggaaatacaagaatgaacaagaaaatgtctttgccctaaataagcctttcatttttgaggtaacaagcgtaatttgttacaatacaagggaaaacagtggccatggaaatgaataagaagctgtaagttaattaaatcagccaataaatatttttgtgcaactattttcgcactttgcaaaactgttatatttaagagtcctattaaaaatctcagaatgcttttgtctctattcctagtaacattgtatataatgtacataatacatattttgattactcaagaatacaggtagcatattgcaaaaatacattccaaatctaagatagcaatgcctaacacataagaaatgtgaagcaaaaatgtgtgaaataaacttatgagggaatttatacattaaacttatgaatattagcattattggctcagattatgctaaaatatgtatactttttaatactgtatcaaaaatcaaatgccagtaattgaacatcttgaaatacttttgaaagtgcctttctatgttgcattttccggcgggctgtgctccaggtaagttagaccagaaacgcaggatccggcctggtggcagaagactggaacagccacagctgagaatccccattccttgactggcctgagcctactacagtaaggcagcttagggatctagacacaaagccctaggacttttagagtcatctgcaaaaaactttaaaaatcacccagaaaatgttcaactttctgttctcatttaattctactgtagatcatgtgtagagagggtacaggcattcctctacaacatcccagctcacagtgccaaataccttttgtacacaacactaaatctagaaatgccatttataacatagggtaccacaaaccaaagccaaaggaaacacacacacacacacacacacacacacacgattttatgcctaaatgttgccatgtcagtaaaattcttgactggtaataaccaaatatagaaacaaaacacaaaatgatttaaatgaaaagtacttaatcatgaaatgtcggttgtttataacttttttaaaggagcttatgatattttcttatctagagcaccaaaatctaaatttagatacttacattattgcactctccaaggaaatacagtgcaaatccatcggcttttgtggctgccaaagtaataagaaaaggaagaaactgagctcagtgggagaatctaacatgtatgcatcctccagggtgagaggcagatgtgagtctttcaaattgatttgttaacagaatcaatggtcatgcagtaaatggaacaaaatcacttatggctttacttaatagcataattaaaatatcctctacatttttcatcagtgagtataaaatttaagacgatatgctcaaatgcatatagcagtcaacgtaccacatagtaacatatttgttgaactttattcagaattattgaatattttttaaatttgagaattgtgtttaattttttaagtttttaaaataccacaagtgatatttataatattaaataaccaaagtaagtatcaacccaaaaagctgatgtattcatctataattgtcactgaagcaaacataatttaacttacctaaaattgcctcagggtcatctgaaggcaactataatagttaatagcataagtcttggagggactgcctcaattaaacccctacttaactcctttttacctgtgtgactttgggtaagatgtttaacctctctgttctatagcttcctcatcagtaaaatggtggcaataataaaaacaacctcctgagaccgtaataaaaataagtcagttaatgcatataatatgcatagacaggtgcctagcatatggttaaatacaaaataaatgttattatggttggtatcatttatatttttattttcaaattaaaaaacaaaagatacaattgtcatagtgggtatccttctgaaaaatcatgtcctaaaaacaagtgtatccttctaaaatagtacttttctaactttccccattctattcacaacataaaccatttcttaaatggtatataaaattgtcatttacccaaatacatttaaaatgcttagtctctctttaaaattaatatattttataaagatgtgatttaattcaataaaactatgctttccaaaggaaactaggtgttaattagaaggcatagtatattacctgtatatatcaggcagatacttatttgggattagacaatttagaaagttttaggtttgactcacctctggtagtttcataataaaatattttcacttgaaatttagtccagaaatagaagtaaatataaatgactttcatctgcctcttagtaagtagtttttgctgctttttgtaaaagaatctttgcccattttttctaacaggaacacaaaatgcttcttacctattttaatgatgctgctcagttcatagaggagtagctggttgtctcctcctgtgtccaaccgttgttctatatagctgtttagttcatatacaactccctgcatattcgtatcttggtactttggattaaaaataacaaaaataaaaacagagtttaaataaaatataacaaaaattccttagtctgtaagacatactattaatatatgtgacttaatatactaagttattcattatgcttttatagcacatgatttaaatattataatctattttataaaacaagtagattgaaaattaaaattgctatgactatttatttatttatttattttgagacagggtctgtctctgttacccaggctggaatgcagtggcactatctcagctcactgcaacctccacctcctgggcccatcctcccacctcagcctcccaagcagctgagactacaggcacacaccaccacaccatgcctggctaatttttgtattttttgtagtgacaggctttcaccatgttgcccaggctggtctcgaaaactcctgagctcaagtgatccctctgcctcagactctcaaagtgctgggattgaaggcatgagccactgcacccggccgacttcttatttagaattatccatagactgcgtctatgcagcctatatatattaaaatagtaggtgttacaaattttaactttgtttctaaagttttatatatattaggtaacttgattagtaaaaataatatcatacaagagcttgctgagtgcacctctgtaagatgctaggaaagtctgctgcagtcgctgcactgggtgaaacaagtgccctctgtgccactctaactttccattcctttccatctatatggctccaccttggtctgctctcatccctgccaccatagcaagagttaggcgcttgcactgcagccactgtccccacagcagcagccccacagcatgtccacagcacaaggcttcatcatggcaccagtggaaacagcaggtggacagggagatgtcaacccccaccctgctccagttcaagctataatgtgtcttctctaaaggaataaaaaacagtcctccaactaatctccctgctcccaaacttgtcttactaaacctagtctcaaaacaacaggcactgtaaactcgaaatataaaattctgtctctccatggcttcaaacactcctggggcttcctactgcacttggaataataaacaaaaacgcctcgcacagtaacacaccatgtgctgcaaagcatggttactatccagctcaaaactgcgtctcacaccccactctgtctaccctcactgtcacaaccctggccatctttctgcttcttgatcattcagataacctccacttctaaaggtctattacttgctgttttcttgagcactatactcaataaatatctgttgaatgaacaagtaagtaaccaaccaatgattggacaaataccactgaccatcctgacaatgcactagaggaggctctcttctagtcatcagagaccctagaacagtggaacaaaccattaaagatattatcttcaatgagctcacattctagttggaagagaatcaatacgtaaataaggcaggtttttatatgagagcacctacttgggttcagtatgctagtgctaggttggctgaaatctgttcccaaaagtggccaatgctcaatgaagttgaaacctcagaacttccctggtatatattcaaaggcttagcaagattggaatgctagatttggctgatgatgggagactagtttcgcaatcccctggctatgtcctagggatgccccccttcaccaaggccatgagaaacacatttacagggggagccctggcatatgtgaatatatacctggctctggtgcaggccaggaattaatgaggaaactgctgccatatggctgggttccttgaattcacccagaagatgggatattgatgtggtagaggacaagtgggagcacttaacatccagagacaaggtgggtattgtcagcacaaccaacagaagcaaagctgcagaggaatttggtcacagaaatattcagcatggctgcttgatcacaactgctatggtttgaacatttcctccaaagttcatgttttgaaaacttaaccctgaatgcaagtgttgagaggtgggacctttaaaaggcagagcccttgtgaatggaataatgatgttattgggggagtgaattagttatcacgggagtggggtcctgataaaagatatctttggtccccttcccttctctctcttgtacattctctcttgctcttctcctttctgccatgggatgacacagcagtaaggccctcaccaaatgaaggcccctcatcccaggacctcccagcctccaaaattgtaagaaataaatttctgttctttataaattacctagtctcagatactctattacagcagcacaaaatggactaaaacagaaaactggtaccaggaagtggggctgtggcaataacaaatatctaaaaatgtggaagcagctttggaactgggaaatgagtagaggacaaaagaacttgaaggaaatggctgtaaagaacctagactgcaataaaggaagcatcaagggaaattctggtgagggtttagaaaaaaaaaaaacagctgtaggaagggctttacctttcttaggaattacttaagtggtcacaatcagaatactgatagaaacatggacaataaaggctattctgatgaggtatcagatggaaatgaacaagatactcgcaactggagtaaaagccatccttatgaagtcacaaagaacttgactgatctgtagccatgtcccagggctatatagaaagcagaacttaagggcaatgaactcaagtatctggtggcagaaatttctaagcaaaataatgaaggatcttcatgactactcttaactgcacatagtaagatgtgagtagagagaaattaaaggtggaatttgtaattaaaagggaagcagaatggaaagatttggaaaatttgcagcctagatacgttaagtgtgaaaagacatgtttagcagaacaaaccaagggtttatgggcaactgaccattttctaaaaacctaagtagagacagaaagtagcagggtgctattcatcaagacaatgggagaaagaccataaagctgcttcagagatcttggaggccatccctcccaccacaggctcagagcagggccttgagggcaaggtttccagaaggtgtccatggaacctcagcttttgctgcccaggcaacttaaggactctactccctgcattccttcacaatgtgagccccagccacggttcaagtgagttcaagtgcagctcctgccacaccttcagagggcacaaacagtaagtcatagtggtatccacataatactaactgcaaacttgcaggcttcatgagctgtggtgccacagcagcctctacctagatttcaaaggatgtagtagtcagcctggggcccacggacaaacttgttacagcagtggagcccgcacagacagcccccagtaggccaatacctagagaagccctgggagcaaggccatctcagagactccaaaatgtagagttaccaactccacaactctggagaagctcaggcatgagacaccaacctgtgagagctgaagtgtgggctggccccagcaaaaatcataagggcaaggatactcaaggcctagggagcctaaccccaactccagtgtgcccagaatgggacaaattgagtcaaagaagattattctccagctttaaaacttaatgttgtttcctctgttgagttttggacttttgggaccagttaccccctttcttgtctatttctcctttttggaatgggaatatcaatcctatgcctcttctaccactgaattttggaagtagatgacttgttttgatttcacaggctcaaagctgaagaaggtttgtttcaggacgaattgtcccttgagtctcactcatacctgatttagatgagaccctggactgatgctgtacaacttaagaactttgaggccactgaaatgtgtacactacatgttaaaaggacatgaattttggtggccaggggtggagtgctatggtttaaatgtacctcccaaagtttgcgttaaaaatttgatccccaacgcaacagtacggagaggtgggaccttaagagatgattaggtcatgatggccccgtcttcataaataggttaataccattactgggggagtgaattagttatctcagcagtgggtttctgaataaaaggatgagtttggccaccttcctctctctctaaagcgtgatctcttgcccttccaccttctgccatgggatgatgcagcaggaaggtccttgccagatgcaggcaccttgaccttgggcttctctgtctccagaactgtaagaaataaatttattttatttataaatttcctagtctgtagtattccggtatagcaacacaaaacaaagataacagtgtccctggaactgaacggcgcagactattgacatattttttttcatttgtctaaacagaaaagttgtggcttaaatgaacaaaaatctgacttgatgaccacaagagaaagtcagaatatttcactgaattcccagacatgagccaattcacaggcccagaactccttaaataaggaaagagaaagcaggtccccttggagaagaatcctactatgccaccaaaaatgtatagcacagatcttcctcctgcctttcccaaagaggtcggcagccatttgcctgggtgactgaatatcacgggggcaggcagaattactagatttgggggactactggacgtcagctccaccctgacattaattctttattattattattatcttgagacagggtctagctctgttgcccaggctggaatgcagcactaactattaagagacccaaactccactgaggagtaccaatcaaaaggggttcatggagatcaggtgatcaatgaagttttagctcaaggtttgtctcaaaaatgagccacactggggtctccaacacaccctctggtgactgcagtttgggaatacacttctggaacagacatactcagcagcagacagaactccgcactgaaggatccccacgtaggaagggacagaagaagtgagacttggagaaatctgagggaagagcttcccaagtaaagagaacaggataaatcaattaattactatgaccaaaagcggcaaaatagaaacctgccaagcaattcttaggctgcatttcaaacttcaaaaactactaactgctactattaggcttttacctgtggtagccactccctgctctcttcccaagcactgagagcctcggctgtagaagaggttctcttaggttgtgtgtattcccttctcaggtctgctgccttcctgggcggtgcctaacatttctaagggctgattccccctcccattagccttgtgggccctacttgctttgttgcacacttgaccatagtaagtcattggtctccaactcagttttgtgactttttattgctaaaatgtaatcttaacagccaaaacttctcagttattttctagctccagatttttgtccaagtcttgttcttacccaagtacctgttgataggtatttacataattacagaatttacataaaaatcatgaacacttgaaattctaatgactctaaaatatgacagcattgtttgaggtcaccaaaacttaggttattttctttatcatctgtaaccagatcctattcgagctatttcaagttctgaataacttcagataaaatatgctactctatcataccctctctcttccttacttattccacttattccaaccactagttctgtattttctttaccccacagtctttaaaaggagcttctatgagaatgaagctagcctaaaagaaagctgagccaaacaatagtgagagacctaagtctatcaactttgaacacctagatccagccaagcaaaagcttcatgtgtaaaaatcactagatatttcttttaaataaaccaatacattctctgaattcttcattttccacgtggaagaaagaagcattagccagcttaaggggagttttcagtcattcaggctccacacaaatgatacacggctgactccttcctcttagcatataattctgagaacaggctctttaataatgacctgtgtgcagtgctgagatcaataaccagctgttctccatctcttttggacaggaaatgggttgttacaaataagtgagaacaagaagacatgctgggatgtggacagtttatcatgaggtttcatttcacgtctctgggctttagttttctcatttgtataataagaaggctgaattatactgtctgtaaaatgctttccctttccaagactaaatttctgagataagctatgacctaggttttaaaattttttcttgtttatattaagcttcaaattctaatatttcatctaatagaatgttagcacatcctgtttccttttgttgctcattataactgcaaaagtattatgacagcaaaatgtttttactataatttctatattgacatattaactcaaatattaaaggtctatctacatagttaacaaatcactcaaaccataatatactgtaaaatgtaaaattacatgcaaatgtactacaagaataagcaaaattgttatttggttgttagccttctggtcattctgttgtttatcaggactgttatgaaaggcaaagctgaggagacaaattacgtgaatgtcaaatcacatacttgtaagacacttctatggaaaccccatgataaaggaatcaatttctatttaactgaataaacatgaattctatggcttgactaataacaattacaataagtatactaataaagatgttaagaacttgtatttttacagcatttttaacttcataaagtcccttcatgactttcctaagagaaactacaacaagtttatactgggcatcactgcagcattcgtaattcgagacgagttaaaattccaaagtagagttaagctgggagctacacatttttcccaaatcaaattggataccaccatcttcatattctgttccacgctgatttcatgtagtacttgcgttttatttgagcaaccaccaaaaacacagcttcacaaagataagacctgaacgatagaactgtagtgatctaatattaaaactgaactatgtcaagctaacattgtcaagctatatgtatatatatgtatatatataacatacgtcaagctacatcaggttctgtccaacatatgccactgtgtttcccatgacattttaatatatcctgagttactcttgtacatttgctgtggtgcctcagggcatttggaacacagtttgggaaccaggggaaagccactctcttgcctagggggaaataatattttacaaaataaaatggtaatgaacaaatcagtgttaattgttggttcagaaagaaaagtaaaagctagtttcaccgggaggacaaatgttcccatgactgctaaaatgaattagttatgtaaacatgcattagacagctacttagccaaaaaagtttagaggcaattcagtaatcacatggaaactgtgacctctgttagtcccgagagtctgtgattgtatgaggtggcaccaacatatccagaaggccaacaataaacaagaagccataatgagacaaatgttaaattggataaatatttaacagcataaaaaggagctcctcagtttctaatataaacttcaatattggaaaaatatcttctcatcattttttatattattcctttgttcctttttatattgtttataatgttttattttgacataatttcgatcttacagaaaaatttcgatattacaagaatagtacaagaaacaccttgtataccttttacccagagctatagactgtatctctgtctccccctaaaattcctacgctgaaatcttaacccccactgtgatgcaatcaggaggtgggagcttcaggggagtgattaggtcaggagaatagagccctcatgaatgggattagggacaggacacttccaccctgtgaggacacggcaagaagacagctgccttttatcaggaagagggtcctcagcagaccccgaatgtgccatcaccttgatcttgaacttcacagcttccagagttgtaatttctgatgtttattacgccaccagtctatgggactttgtgacagcagctaaaccaggacactaaggtttaccagtaattccatttttcttatttgccttagcattctatcagtaaattgtatctatcaatctttctctccacacatggacaggcgcacgcacacacacacacactcacacacacacacacgttttataaatatgttttaatattttaagagcaagttggtgtgcccctttattcctagacacttcagtgtgcatttcccaagtaaaagaacattcccttacaagttaaatacagttaccatgatcagaaaatttaacgtttctacagcaatattagctaaataaaaacccacattcacagttcacctgttgtcccaaaaatgtcctataaaggattatgaccccccacccgtctaagttcaaatcccagatcacatatgctatttaggcatcacatttcttcagcatctttcaacgtacaacagttccctcagcccgtcttgtgtttcctgaacttgatacttttgaagaatataggccaattttgatttgtctgatgttttctaaatatcagattgaggttcagaattattttcagcgaaacaatgaagtgatgaagctagaaagccataatccgaagaagagtgagcatgcctggctgcctccctgacttcctccatgtgaacatgagatcaaagacttatcttgatccgctattactgtcatttaatttgatgctcaagttggcccagatttggcaagcagaaaccccttcaagatagctcctatatgcttttcacacgtcctaatgattccttcaacacttccttacctttttgtcacatactttgccagcccttgaatcagccatttctaattcaaagaaatcccagttccccttagtagaaaatggcatttaaaatccaagagttgaagctatatcacactgctgtcaatgcttctaatgcattagatagatagatagatagatagatagatagatagacagacagacagacagacagacagacagacagacagatagatagataatgatagatatatatatatatataatatagataatgattgcagatttggctgctcaggatatagtactgcagttattagcttttgacaatgctaatcctcattgccaggctgctctgtgacctatcagagggaaagcacacttagttgattatatcaaggcctgtgatggtatcggaggtaatctgcataaagctactctgctagcacaggcaatggcaggactgagagtggataaaggaaatactacgtttcctggagcttgctttaactgtgggaagcatgctcatactaaaaaagaatgtagaaaaaaatcagcgagtcaggccgccagataggggaaaaaagaaaactgctgagcctgaaatatgtccaaaatgtaaaaaaggaaaacaatgggctactcagtgtcactctaagtttgataaaaatgggaacccgattttgggaaatgccatgagggacccgtcccgggccccattctaaaccggggcatttccagctcaggccattccctcacccctgtacaatgtctgtctcctgccacagccggtagtgccgcagtagatttatgctgcagaaaagctgcgagccttctgcctggggaacccccacaaaaggtcccaacaggagcctgtggacccttgccagcgggtacaataggattacttttaggaaagtctagtttaagtttaaaacaggtacaaatacatacaggagtcattgattcagattacaatggggaaattcaagttgttttatctacttttgttccctggaaagcagagccagggaagcacaaagcacagctcctgattgtgccatatgtgggaatgggaaaaagtgaaattaaatgaacaggaggatttggaagcacaaacaaacaaggcaaagcagcttattgggtaaatcaaattgctgataaacgtcctacttgtgaaataactattcagggaaagaaatttaaaggtttggtagatacaggagcagacatttccatcatttctctacagcactggccgtccgattggccaattcaacccgctcaatttaacatagttggagttggtaaagcccctgaaatatataaaagtagctatattttgcatagtgaagggcccgatggacaacctgggactattcaaccaattataacttctgcacctataaatttatggggaagagatttattacaacaatggggagcacaagttctaattccagaacaattatatagccctcagaatcaacatacaatgcatgaaacgaggtatgtccctggtatgggactaaaaaaaaatttgcaaggtttgaaaaaaccgcttcaagtggaaaaacaaagttcctgccaaaaattaggaaataatttttgatggcggccgttgttaagcctccagaacctatacctttaaaatggttaacagataagccaatttggatagaacaatggccactaagtaaagaggaactggaggctttagataaattagttactgaacaattagaaaatgggcacagagctccaacatttccccttggaattctctagttttcataattaagaaaaaatcaggtaaatggagaatgttaactgacttaagagctatcaattcagttatacaacctatgggagcattacagccaggactgccttctcctgctacaattccaaaaaattggcctttaataattagtcatagatttaaaagactgtttgtttgctatccctttagctgagcaagactgtaaatggcttgcatttacaattcctgcagtaaacaacctgcagcctgctaagcgttttcattgttttacagatggatctagtaatggaaaagcttcttattctggctcgaaaagtaaagttttccagacgccctatacttcagctcaaaaagcagagcttgtagctgtaattgaggtattgactgcttttgatatgtcaattaatgtgatttctgattcttcatacatggttcattccgcacagttaattgaaaatgctcagttacgatttcatacagatgaacaactgatgactttatttacccaattgcaaacagcagttagaagtagaatgcaccctttttacatcactcacattagggctcatgtacctcttccaggacctttgactgaagggaatcaaatggccgatcacctagttgctaatgcaatatctaatgctagacactttcacaatttaacccatgttaatgcctctggcctcaaacgcagatacagcactacctggaaagaagctaaaaatattatccaacgatgcccaacttgccaaatggtatattcctcatcttttacaggaggagttaatcctcaaggactggaacctaactcttctttagcaaatggatgtcacacatgttccctcgtttgggagactagcttatgtacatgtatgtgtggatatcttttctcactttgggctacaggccaatcaggagagtcttctgcctgtgttaaatgtcaccttttgcagtgttttgcagtgatgggtattccagcttctattaaaacagataatgccccaggctatactagccaagctctagttacatttttctctatgtggaatattaaacacattactggtatcccatacaattctcaaggacaagtcataatggaaagaatgaatctttttctaaaacagcagttgcaaaagggggaaatagagaatatggaaccccacagatgcaattgaatctagcattattaactttaaattttttgagcctgtccaaaggccagatgttatcagcacctgaacagtatctacagaaaccagatgcaaagacagaagcagaacaaccgatttggtggagagatccaataacaaaacgttgggaaataggtaaaataacttggggtaaaggttatgcttgtgcttctccaggaccaaatcaacagccgatttggatgccatcaagacacctaaaaccttatcatgagccagatgccgaggaagagattctgggaggatcccgaggaccccctagttgcagccatgtcgagactgacgctgaggaggtccccaactgtcacgagcaacacccgtcaaacacagccacccacatggggacagatcaagaagctgtcacagatggcagaagaaaacctgaggaaagcagtacaaccagtcacaatgagtaatttaatggtagctatgatagcagtgatcaccactgccatgagtattccttcagcaagggctgacacagagaacaattatacttattgggcatatttatcaatcttggctggcaataatgcctagatgcaatcactctataacacagttacacatgctttctgatctcagtatttaccataataaatctgctactataattgaggcataccaccctcaaaaacctttttgtaaacaggattggacccagttagaaaaaatgaacatacttgtttagtaagattgcattgcagaacaggcagaggtgctgcacaacgattcctatggaatcattactaattggtcccctaaggggatgtttagcttgaattgcacctctcagtctgcgagccacagccacactacgttcagctgatctgaacaaaacagtcagacggtagaaatggcaaaaaatacagcaaaagttcctattatctggaaccatggtggtatagtggcacctcaacctcaaatgatatggctcattgtaggagctaaacataaggatttgtggaaactattaatagctcttagtaagatcaaaatttgggaaagaataaaaaagcttctagaaggacaatctacaaactggtttttggatacagcaaaattaaaagaacaaatatttaaagcatcccaggcacgcctgagcttaatgcaaggaactggagtgcttaaaggagctgcagacaaattagcagctagtaacccattaatatggataaaaacacttggaagctttgtaatttcaatgatgattgtgctttcataaatctgtgttgtttgtatagtctgcagatgtggatcctgactcctgcgagaagtagctgaccgtcacaaagctgcctttgcttttatcgatttgcaaatcaaagaagggggacatgttgggaataagccccccccaaaaatctggccataaactggccccaaaactggccataaacaaaatctctgcagcagcactgtgacatgttcatggccataaagcccacactgggaggttgtgggtttaccggaatgagggcaaggaatacctggcccgcccagggcggaaaaccacttaaaggcattcttaagccacaaacaatagcatgagtgatctgtgccttaaggacatgctcctgctgcagaaaattagcccaacctattcctttaattaggtccatcccttcgtttcccataagggatacttttagttaatttaatatctatagaaacaatgctaatgactggcttgctgttaataaatatgtgggtaaatctctgttcggggatctcagctctgaaggctgtgagacccctgatttcccacttcacacctccatatttctttgtgtgtgtctttaattcctctagcgctgctgggttagggtctccccaaccgagctggtctcggcatatacatacacacacatacacacacaaacacacacataggtatgtgtaagctgataattgtcattctgcatgtatttgtctacttacatatacatatattaggagagatgaaaaaccatgactcattctgatacctccggttccaaccaaacactacagtatacattccactatttcctatttccatatttgtaattacctcacccaacatgtgaaatctggctgtcaatatccttaacatacttatatattttctcaagtctagaatacacagaggtagttttagaattgctaagccataccacttcaaatagtaaatgtattaactagatgttaatattttttagttttttaggtaaaatttacagacactgaaatatacaaatcttaatggtactagtgcataaatccttgtaacatacatcctaccaagaaagaacatttcaactcttcataaactccctcccatagtcctttctaatcaatccctgtcctcaaaacagccactctttttgacttttcccaccatagattagttttgccagcttttggaattatttgtaaatggaatcatacaatatgtactcttttgaacctactacattggctcaacaggatgtcagggcaaaccagccatggtactatgtgtttcagtagtgtgttcctttccattactggtaacattccattgtattaatgtactacaacttgtttatctgccatactattgctggacatttgggatgtttgtttccagttttgagctattatgaataaagcctgctatgaacattcttatggaagtctttttgtgaacacaggttttcaattacctttagcaaattcagagtaaaattcctggattgcaagataaatgtatgtttaactttacaagaagttaccccccttttttcagtgctttatattcttaagaattgagttatcaaaatgatttaggcattttaaagaaaaagttgttaaaaataaaggtgatctatatcacacaaatggcacaggctaaaaatctaaccattctgtaatgagcaactataatgacccatgaaggaaatctgcgagctacacaggtataggtggaaaagcttgggggtaacacagaggaggccactgattctttgcaaatgcttactttaaaaaattttaaaatcctaaacagcatataaagggccagtagatattcaccctgagtctatcctagcactatggggaaaagagaaaaagcagccaccttcacttgttctacagtgtaactgagcacagaagaaatgctacacagagctgtttcaaaggattacaagagagtaaacaaggcactgtattagttccttctcacgctgctatgaagacatacccaagactagctaatttataaagaaaagaggtttagttgacttatagttccacatgactagagaggcctcaggaaacttacaatcatagtggaaggtaccacgtcacagagcggcaggagagagaatgagtcctgagcaaagggggaagccccttataaagccatcaaatcttgtgaaaactcactcactatcatgagaatagggggaaatcgcccccatgattcaattatctccatctggtcaagtgcttgacacatggggattattacaattcaaggtgagatttgggtggggacacaaagccaaaccatatcaggtatgatttaggagtagcatagttccgaagtttagagaatgcatcttaaagaatgctagcacagatgacagaaactgcaggaggaagtactaaaagagagggtagcagaggaacaagcagggcatgaggacagaacgatcatggctgattatcaggactgtccctggacaatgaattcatgtcgaagtagaaagcacacaggcagggattctgcaaatcaacaaggcactaatttgaaaacacatcattagctcagttcaataaaacagaaataataaaaactaatattccaaaagaacattataattttcaaagggctttttataaattaatgaatctcatttaggacaaaaaggttcacaagatgaaaagggcttttcacactaacaagtttagcgaaaagggatccttgagataaaatagtattaaatcactgactgatacagcaaacattttttaagtttaagattgctagtagaaaaggattaagcattcaagggcagctgaataatgagaaaattaagggaaagaaaagatgtagtttaagtactttacccaacagatgtatttctgaatgtcagcacaggcatacgtcattttgattgtgctttgctttactgctctttgtagatattgcatgttttacaaatggaaggtgcgtggcaaccctgcatcaaaaaattccatcagcgccacttttccaacagcctgtgttcacttcatgtctctatgtcacattttgtaattctcactgtatttcaaaactttttcattattattgtacctgttaaggtgatctacagtcagtgatatttaatcatctgtaactattctcccatctcccctcctctccttgaacctccctaatcctgagacaaaacaatgttgaaattagacaaaccaattaataactctacaatgatctccaagtgttcaagtgaaagaaagagtcacatgtgtttcactttaaatcaaaaactagaaataagtaaacctagtgaggaagacacgtcaaaagccaagacaggctgagaactgggtctcttgctccagttagtgaagttgtgaacgcaaagaaaaagttcttgaaggaaattaaaagtgctaatctaaagaacatatgaataataagaagaaacagccttattgctaatatggagaaagatttggttgtctggatagaagatcaaaccaactacaatattcccttacagcaaagtgtaatccagagccctagctcccttcaattagaagactgagagatgtgggaaagctgcagaagaaaagtttgaagctagtagaggttacttcatgaggtttaaagaaagaagccatcttcataacagagaagtgcaatgtgaagcagcaagtactgatggagaagctgcagcaagttatccaaaatatctagctaagataatggatgaaagtggctatcctagagagtggattttcaaagcagacgaaacattcttacaacactgaggtgtcatctaggacccttataactggaggagaaatcaatgtctggcttcaaagtttcaaagaacaggtgactcccttattagtgacaaatgctgctgatgactttaagttgaatctaaggctcagtgaccactgcaaaaattctagggcccataagaattatgctaaattgactctgcctgtgttctagaaatgcaagaacaaaggcacaaggacatcacatctgtttttggcatagtttgctgaacattttaagcccactgttgaaagctactgctccaaaaaaaattcctttcaaaatattaatccttggccaggtgtggtggctcatgcctgcaatcccactttctatgcctagtgaagatgctatgaacatttgttgacatgatgacaaaggatttagaatattctataaacttagttgataaggcagagacagggtttgaaaggatgaaccccaatgttctactgtgggcaaaaatactttcaaacagcgttgcatgctgcagagaaatcttctatgaaaggaagagtcggctgatgtggcaaactttatttttgccttatttttaaaaattgccacagccaccccaaccttcagcaaccacaatgctgatacatcagaagccatctacatctaggcaagaatctcccccagcaaaaagattacaacttgccgacagctcagataatctttagcattttttagcaataaagccatacataattttatttattttgttttttgagacagagtctcactctgttgcctaagctggagtgcagtggcacagtctcggctcactgcaacctctgcctcccaggttcaagcgattctcctgcctcagcctcctgagtagcagggattgcaggtgcctaccaccatgctaggctaatttttttttattttttttttttttagtagagatggggtttcaccatgttggtcaggctggtcttgaactcctgacctcgtgatccgcccgcctcagcctccaaaagcgctgggattacaggcgtgagccactgcacctgggcattatttttaattagtgaatgcacattgcatttttagacatgatgctattacacaatttacaggctacagtatagtataaacataactttatatgcgctgagaaaccaaaaaattcttgtgactcactttatggtgatatttgctttattggaacagtctgaaactgaacccacaataccttctaggtatgattatatgtaaggtttttaacaaatatttatttagcagtgtgtcaagcattatcagatgaggctactattctcatggagtttaaatcctattgggggaggggaacagataaacaagaaattatcaacttgtgaaaacacttatgaccaaaaaagtatctgatgcctttgttgccatctttaacaaaccacaatctaggtgtgattggattttatgcatagctactccattactggattgttattatattcttttttacacaatgaagaaatgctccccaaacaacctttaaacggcccttgaatttatggactgggaccacccatctttatgggcctaaaacagctcctctgttgcagcagtttgcaaaatctacagtctagcatagacttgtggctgccaagaatggtgtggcaaaacaggtggtaatttaaggtcttgcgaaagaggaatgtgtttagttcccacttttaacatttttatcataatcacttgatatcattttttagataaaatgactccttgcctactagcatagtgagtaataagatatgcatcttctatgtatcatctgcatcactttattattatggaatcgggaacagactttaaaagacaaacggttcgcgtctgtaatctgttgttaagattatgggttttgccttaagtacaaacagatcactgtctttagcaagcatttcctagtatttaaggggtcagtaggaactatttccatatagcagggtgttgtattcaattaggtagagaagtgttttacactaatatgctcaggaagccaacatgcttaggagtgacgctccacacgggtttctgaggttgctatggctgtagttcataaggagcagcaaagttcctgaaaagaaatttagcttaaaacaaccaatccgtaatttatgcgaagaatttttctctccggttttcacaaaacataaatttgaatgcctgaagaagatatttcaacttgtgtaataagatgaatacggacttttcttgcagtcttcctgtggggttcttcttcatgaagaatgagtggttttccatctgggtgagaagttatcatcaagaatgagtggttttccatctgggtgagaaattcttattgggctctttgattttcaaaatccaagatgtcagaatttcactttaccttactggaacactgtatctgtcaactggttcctctggcttctaaatcctgtgttgatgatcaacaagataggatacctgcctgcactccaggtatttgtttataagtatcattttggaccattcaaagcccaccacttagccaaagcctggctttaagaaaattctacttagggtgctgtaaagagacaggctttctgtccactcctccttgtgctttccgttccacccttgggtcccatcactttagccctgtggttttcagctgcagtgagtgagggcattggtgtttagtccatgtttgctgctacaaaggaatacctgaggctacgtaatttataaatacaaaaggcttatttggctcacggatctgctggtgagggcttcaggctgcttccactcctggaggaagcaaaggggaaccagtgtgtgcagatatcacatgaccagagaggaagcaagggaggcagtggagtttcaacaggagacttgttagggccaaacaaaccatacacaaaccatagcgacaggtaacgagaactgactccacgtaattctaacttatgtctgatctaatccagccttctgtacggtcaactgcactttttgaacactgaaccacattataatattatgcctttgaaacttattgaaaattgctgtaaatcagatatataaacttatttgcattttcataaaatccagtattaaaaactttgtcctgaaaaagactgattggtgcctttcccttagaggataagtaagtcaactttggtttatacttcacctgattaaaaattaaaagccagattttctactcattcatagaaaagtattacctcttacaaattgttttctttctagttcttcctctgttgtatttggttacgcttgtttttctggtaatcaattagaaaacctcttttcaaatgatatagaaagaagagaaatggaaagtgagtaaatggtaattagttgtgaaggaacaggtaaagctgcaatagggaggacctgggaggctgacagggcctctctaagcccttaaagactctgtttagaccatcctcccctctctgtcccattgcatcaaactttctctctctactgaatcacttccacaaatatataaacatgctgtcatttatcccatattttaagagaaaaaaactaaaacaaaaccggagctttttgttgcctctttatagctttcctatatatttaccacccatttctctcctctcttttcaggtaaaactccataaaacaattgtatctattgctgcctacaatttctcttctctcacaaattccaattgctccaagaaaacagctttcagtgaggtcaccaatgaccccacactgccaaacccaaaggtcagctctcagtcttcctttcccttagaactccagcaccatttgacatagttgattgctctattttattttaaataattttttatttaaaagaaacatatgcccctgattctctttccacctcttgtgttcagtcttcctttctacttcttcctcccttagaagtctcaggcttctaaatgttatgttccagggttgagccacactcacctgtcaagtgatctcatctgggttcatgactctagctactatctgtatgtggatggttcttaaatcatcatattactaatgatctcaaatttatatctctaacccagaacgtttacctaaactccagtctcatatatacaacttactacttaacatctcccatttggaaatctattaggcatctccaacttagcacatccaaaactgattgtctgttaggaaccaccccctgaacacacaccctgacctgtccatcctgcaggccctcccatggagggcctcccagccttccattggctcaggcaaaaccctgatgcctcctttcctttcttccctctgttttaatatcacatatctggattaatcaataattcttgttagccctcctttcaaaataaatgcagaattctatcaaacccaagcattttcccctacctccattaccaccagcctggtccaatttcttattagacttactacactagccttctacttgccaatcacccctggcaatgaaaaattattttaaagcgctgctgaaatcatttacttaggatttctgaacttttgtttgcgctaataaaactagttaacagtctcttaatttaatgcttttttctcttttgtttaatacactaatttttgtgtcaaaaataatactcccttttgagatgagttattttcctagctttaaataacttgagatgagttattttcctagcacacttcatataatgtagaaattttctcctctttaatgtttggtggaattactcagcaaaagcttttgggcctcaggtcattttaggtggtcttttcctaattttttcagttttttcactatagcagtatattcaggtttcttaactcttcttcaattttgataatttgtaatttcctcaacattggccatttcatataaatttgcaattacattagtatatagtatttgctattctctctttaattattaataatctccctggtgtccatattaatattccctttctcattcctaatgcctatattttcttttttctgaaatagattgccaaagacaatctattttatggaattgatctatttaaagagctatcttttgtattattaatcaagtctatattttaaattttgctccattaatttcttctcatatttcattaattcatcccctgtgctttttaaatttgttttgggttttctaataaataattgtaaggacataaattttaatcttattctggctatatctctcaggtttggtagactttatccccattttacatttgggtttaaaaagccgtttttcaaaaggtctttcagattagaatgtcaaattaggaattcaaatctaagtgtcatttacattataccagagaagttcttctgaatgtataacacatagaagaaatagagatgcattctggtaaaaggaaatacaattagttaacatacagaagtatgtgtatttgctttaaataaaaacattaaaagagtgtcataccatttacacgtgaaaagttatataattgttattttaatgggactacaatgaaaccttcaactgtaacagtaatttagttaaaccaacttaacagtgtgtgttaagtgtcataaataagtcatgtcctttgacctagtaaccctggatcctagcattgttccttaggaaatatttcacaagaataaaactgctatatacataaatataaccagtctatgaaaattttaaaacaatctaaatatctaccaatagaatgaaaaagtaaaaaattatcacacagaaactcaatggggcatttttagtcactaaagataattttagactgcataaaatcatgaaatgcttatagcatagtaaaaaacagaaatcaaaataatatgtgcattgtaattattaccaagtaaatatatgcatgtgaagaagacactagaaataaacattcccaactgatataactgactggattagactggtttcaatacttctcagagacatagtcctgatctcttgaaaatgcaagtagaaatgattttaactgaattaatgtagctctagacaaagctgataggaacaggatccaagcccaggtgttggaagtcgtcttcagaaggtaaattccagtgtgatactcaaccccaaatacagaaataagaagagagtccatggaaagacattttgatatacagaataacaacaagggcttatatcacataacctccgtcttctcaaaaatatagaggccactataattaagagtgatggaggcaaggttacagctgacaattaagtggagagaaaaaaaatgtagaacacctgccatgtaaagaaatctcatcaagcctgtattttgaagcaaaggaaaacactgtggccaaacagccaagaaagctcatatttaatagaaaaaaataaaataactaaataatcactaaagaaatgatggcttttacaaccatacactgggagtgtcttctctaacattactgcaatctactttaagaaaattctattcacagaataatatgtgcttgtataataattatctggtcagtggtttaacaatttccacaaggctcaggtactcttaattttcaagtcattcactcaattaaggtaatgaacagattcatacagaaactctgaaaattctaaattctatattcagtgactgattagttgtagagcataattatgatcacaactagtcagacgttgccaaagtttcatttgaagtcacaggatacagttgattatgttaatcctcctttttgggggaatgtcttttatagagttctctcttactttctgagaggggatacatttgaaagagctgaggcaacaaagcatcccaccctaggtcttctgcagccaggaggttcttaagcagtattgtaagaacagatgccagttaaggaacttctaccatccagtccctcatggcccaacactataaaatattttaagcaaaacaaacaaaaaaaccaaagttaaattgcaaagaagaaataacatacaagatacaaattaataagagatctgaatagcagggagacactcctgtgtgaaatcaccaaaacattccttaaagaagtaatgttcaccttcatataaacttttttccttctgtgtaaacttagcattgctcttccagttcgaatttgtagtaaaaacattttgaaggaaaaatttgagtaactaccatcgagtattatgcttattactgggtgatgaactaatctttacaatgacccccaccatttacatgggtacattgtgacatggaatttacccatgtaacaaacctgcacatgcaccctcggtcctaaaataaaagtcagaaacaagaaaaaaaaatccattttacgcaacttcttgttaggctaaatgaggttctaattccactcttagtatttgtaagtattcagacatacatctaacatcctaaatttttaatgacattactattacagagaagtatggcttcaaccaaataaaactagactccataaggaaaaattttaaataagtgcctgacattgagatcgagaaaaagagaaaaaagcaagagagagagaaatagagcgagtgagtttctaagtgtttttgggctactgctttttcgagcttccatcaaacaacaggaaaattaagctctacacatgcacccgcatccctggacctcatcccctgctactccacacatctgccaggctggcccacctgcccactcccctgctgctgaccaattccttccaccatgccctggaactcactagcatgtgcaaaccccttccattctcaaactcctctgaaagaaaccatttttcacacttttgccctaaccgaaaccttcttgccctcctgataatattgtttcctataacaaaactgattataacataatataaaattaatctgtagaatatatggtcataagtattaatagataattcagaaatttcttaaatgcattaacagaaattttataaatatgaagaaaacactggctacaccaggaaaaataagtattttaaagttgacatcctatgaaaatctccccattctcatatgaaataaacaaagaaaagtgaaaaacaaggagaaaagctgaattagtgaagaaacgaggtgactttggctgctgcatgccataaaattcaagacaatttggctggacataccagtgaagccaacttgaaaacattcactaagaacttaatgaaaacgtctccttcccaagaaaattacactgttgcatcaagtccataaaaaatattctgcgggaagtaatgacacaagatcccatttaatatgctgagagttggatgtgagttcatgctcatgtctgcaacagggccctgtatttagaaacacatggaatagaaatccagagaaacttcatgattcactaactgaattgagcatttcttttgaaacttggcatacagaaacactaaataaaatggatacagtcatactgtttaccatgctgggttaaaaggaaaacaagataatgaaatctggattccagcgcatcaatttgtttcaaccaacctagagaaaaatcactgtgatcaactccccctgtgagaatgtccacaactctagtttcctcggggttcccctcagtcactccagactgaactggtgccaccgacgctcactatccagccctccaacacactaaacaggaggatgctaaggacatttacatgaatagtaaacagacataaggataatctattaatgaagagcagacctaaaatcactcaaggataaatacatttaaaaaaaaatcagcaaatgactcctcaacacataagacaaaaagaagaaaaaaaaaaaccaaaaatatccaaagcgttagtattatactagaatacagaggatagaagcgaatttgggatgtcgtgtgagacggaagatatgcaaaatgaatataaagaaagcatctgttttgcactctcaagataattaaagaattaacaatgagagattatcaacagtataataagacagattgaaatgaagaagaaacacccaaaatacagaagtaacctttaattttaaaagagtcattatgaatttaagcagaacaagaaacagtagagaagttcaagtcaatgacaaagagaataaatctgagaggttctagaatgtgtagtaaaagaaccaggaaaggagaaagacatgggtatttctagtgaccttgaagagaatgaaataaatgtgaaagaaccccatgcaccaagaaacaagtggcataataccctgaactaaaaaggacttttaaaacaattgagaaagctcaccacatactaggttaaattactcaaaattaaagcatctacatgacctagtgaaagtaacaaattcaaagagcaaatgagacacttataaatacattcagaaatgaaaaaggcaacatttactaagaaaaagaatcagaatggtctcagatttctccttgaaaacattaaatacaagagtgtgatgaaaaatactggagcattttgggggtaaagtctatacccacaaattctagacctggctggaatttggcattttctagcaactcagcatccaaatactcttcctattctgacatttttatctccctgttcttgtcagaaatctttttgacttaggagctgaaaccacttaaaaagagtaatagtaataataaagtaaaggattaatattgtggattagatgggaacaaatgaccaacagagatctgactgacagagtatccctcaaatcccccccagcggcatcatctccgaccaaggctccttccttcactcactcagatctagccaagatggctgccttgctatgcctccagggatgtgccaagcatattcctgtctcagggcctttgcacttcctgtaccatctgcatggaaagctcctacccggttctcagcatggttcactccttcacttcccttaggtttttcctcaaatgtgttcccagtgagccaagcttgcctggtcccacatcatttaccctgcctctcgcttttctgtctccacagcactcattaccactgagcacggtgcctgtgttatttatttttactgactctaccacacactatgtaaatgccatgagcgcagggatttctgtctagtttgtcctcgagatatctcaagagcctagatgaattgggactcacctaatatttgttgactgaatgacaatgactgattagaaaaatacagtaggttaagatacagtagtttcaaaagtgcatttgacacaatctcacattattctcataggtgacatttccacactcagcatttcctagatgataattattgtaaagggggcacaggaaagcagcttggaaaaaacatcaaatttgagacttcgaaacatagagaaataaataatatgttagataacagaaataaaactgagactcatctcaataagctgagatggatcaaaagatggaatgaaggtgaaataaaggtacagtcctgcagctaaaattctaaaacaaaatctgctgacaaactttttggtctcctctgacttcactgatttctccttctttctctcctctgctgactttccacatcttctccaccactcaacaagtggagtgtccagtttagtgcttgggtcttgactcttttctccacagacaagctctctaagaagtgtcacctactcccacggccttaaacatcatttatacaccacgaactcccaaatgcatatctctacctacgaacttttcttttaatttgaccatatatgcacttgctttctaaaaatctccaattccgtatctgattccttaaacttactaattttccaatctcaatcaaccccattcctcctatagttttctgcataacagtaaggagaaattttattctatcaagtgctcagatcaaaaaagttgggagtcattactcattcctctcttctcacccaccatatacaactacaaaccaaaaataaaacagtacattccccaactgactgaaagactgtcctcttagccaagggcattccaaagtagacctgaaaatctagttcaggcaatgatgggggggagggggttggacatgtctcattacaaccttctccctttgaaattcaggcacagctgaccagcattaacactaaaaaaggttttaagactgatgaaacagactttttgtagctataagacatcaaactccagcctgactctagtatagcagcatcacatgacggcaggccctgaaagaaattgaagtattttaccccaaatatatttctttgacatatgttgaaatggccctgcaaagctgtctcctggggaaaatctacattctgtagagaaaccctttccctttccaggtcttttctctgatccaggagagtctaagattctggtagctgtctggtctgataagagctctgaaacctgctacttgggggcttcatttgcatgataaaagcttgggctccaaaacccttaccttaagccagacattcctttctattgattccaggtctctgataataactctttcaactaattgcccatcagaaaatttttgaatccgactatgacctggatgctacctggcccccatgcttccagctgtcctacctttccagaccaaaccaagggacatgtactgaatgatatcttatgtctccctaaaatgtataaaaccaagctgtagcccaactattctggacacacctcagaacctcctgaggttgtcataggcatgtccttaaccttgtcaaaatcagcttctaagtagactgtaacaggtcttggatactttttggtttaccctcccataaacaaagcctgtctgctctttcttcttctacacccaacctctgatcctagttcaccattacaaccctaatcctagccatcatcctcccctgcctacactcctagactaccactgggtctacctgtttccactcttactgtgtatactctcaattcgacagctagaagacctaaatacccccaattccattccaaccttatttcttactggtctccgcatgactcactctgcacctgtcacaatggcctacctcagggcctctgcagttcctgtctcctccttctgctgattctctcattcccttcagattcccgctcaaatttcacttatgaaattaacctctcctgaccactgcatatgtgcaataagccaataagcaccctctgaaccaccatcactctgaagccccttattctgctttattcttccatgtattcatcatagtatttatcactgcctgatagatgtacacaaacacacatatacacatccataaattttctgaactgtttccacaactcccctctatactatgagaacctgaatactgtcgattttgctcaccattgtatccacagcaccttagaacaatgcctaaaacagaaatgctaaaaaaatattggtcattgaatgataggtaagaagacagggaaacaaagagaggaaaggaaaatagagaaaagggaaggggaagagacataaaacctacaggtctgacttcatgaaaaaataatgatagtttactcaaagctcaataaccagaaatggaatgtagcttctttaaaaaactaattctccattaaaaccgtactgacagatacataggtttcaaactaagacaggtatctgtcccacctcattttaccagggtcaagacgcaattagtctgtagtgttaaggctgcaatgttttaaagatatattaataatatatagtttgtccaaagactgtcaacccacatcttaaggaggcatatggaaaataaagtttagaaactaagatgttttactagaaaagacataacataatccctatactcaaagggtttggatacgaaataaaagtcaaaacaaatactggagaatggccattttgggaggctgcttggttctaaatgagaaagtacttcatcataattagaactgcctaggctgggctcagtggctcaaacctgtaatcccagcaccttgggaggctgaggtaggaagatcacttgagcccaggagttcaacactagcttgggcaacatggaaaaatcccatctctatttaaaaaaaaaattagctgggcatggtggcacaggcctgtagtcccagctatttaggaggctgaggtgggaggatcatctgaactcgggcagtcaaggctgaagtgagctgactgtaccactgtacttcagcctgggtgatgaactgaggctttgcctcaattaaaaaaaaaaagtatatgagaaagagaaaggggaaagaaaaaacaaaaccaaaacaaaacagaactgcctgagagtgtaaccagcacctttagtggaactaaagagcatgccttctgtcagggatgtgttagagcagaagccctctggccagtcaccacctaccaaaaggttgcccgaggaatttctaaatctgaatctttattgaaaatagtggcatactatttcataaggaaactctgagtattagtcaaataagtattgatcaagatacggggtacgttttttcaaaaaaacgttatagagatcttggcaactgataccatttctaggttatcagctcatacctttagtatttctcagagatgcgcttttctccaaatttggcataatgtaagagaatcttatgaataatagcgaagaaaaatcactacataaagtttcatcattttttctaatggccttataaaacagtatgtggtattgtcaatgacactgtctgaacacatggcagctttgccaatatcaacactgtaatattttatgactctgccaaagttcacttttcagagtccccatcttatcctcaagcatcacttttcagcattttctgctgctcctagcagctgccaaaattctaggtccacccctctgtcacttcctggtaccttttaagcgtccagaccaaggaactcttcaattgtgagttccacaaatgtgacattaatagcgaaggcacccagtgaaaccctgagactcacagagacctcaagagaatcctacattgctatggacacaaggaattcttccctcccctatctccacacccccaacccccagcgctggcccaggtcattttagagatttctttcttcagatgatcaaaaataaaggaatatatctgcatatgtgattctattaagtttttcaatttatgtcttacaataaaaactgatctctaaggttgcattaagttccattcaaactgattattttcaatatttcatccacacttaagatctttatctgtgtaatacagaaaaaactaagacacttttttccaaatgtaattaatcacttataattttatagcataaccagtatactaaatgctttcagtactcacctgccatagtttttaagcttgctaagactcttaactaggccatgaaaacagtacctttaatatttataaaatttctaagcaatatcttgctttcaacacgagttgtcatcttttgttctcccaaaaagaaagtgcatgaactcaaaggcagaggttgggcaggtagcggacatgagtaaagccagctacatggaggactggggctgcctggagagcatcatgcagctgaaggcagcttccgcttcccaccctgggaagactgctgccctgtgagagttatcttaccttctggttcaagggaagccagaaatccaatctttacatacagtgtctcaatttctaaatgttggcaactgactcagaaaaccccataggcacgtgcagccgaacaaaatgcatctgtgtgccgtactcagtcttgaggccttcaatttgcaccctctctactgactttattccatattaatgagtgatactttggagaggaaactcagtttttgccataatctttctgatactttaatgtgttagagtactgagagataaacaaaacagattcatttcctatactgcagtagtagaaataatattcacatcacttaccctgctgacttccttaggagctgattcatctggggatagagaaggaagagggaaaaacacaattagcgactgagtaggttttaaaatacaaaacatgtcatttgctttcaataaacttgaagggtttttttgcaatgcttcctcttacgaaatctatgaatttgattttttaaactgtaaaggttgaacataacatattacgagttaagaagtatacattaatttcacagggaaaatgaaataccaccaccgccttacctttctagaggttctaaaatggatatgatatgcctgcaagaatagctacactggggtatattcaactacacatacctaaagtggggtttataacacttcaatattctacacaatacaacccacatgaatatcccaaatgacctttaacactcgtgcttcgaaggttagttccagcagacctggagctggtgtgagctgttctgttgaaataagaaatgtacctgcatggcactctggtcaaggcatgaaacatagtcattaataatagtgctgctttgttccgtgtgtctgaggagttgtggggttgtttataccagcttgtcagcattggtgattggtaaagtgagactggggtggtttgcacagggtctaggtgagaatccctggaaggctctcccactggggctggctacaggcaagaagatgcctgtgtgaccaacagggtataaaacaagctggcagatacctcctcttggtccaccagttctgagtgttgcacacacaggtcattgattctgatctgtgagaaagtgtgtgtccctaagaggaggggccactggagctcagcctggcatcaacaggctccttgctgtctttttcctgtaataaacttcagatctgcaagcactatcattttggttcctgtgtcttcttgagcaatcaaaccctgttgtctgtcaccatcagaatgaacttaacataccaaaaatggaatgtagctcaatgctataggacagcaggtattcaaatcaacagtacctagtttttgtattactgtattaatacacacttgctcatatattttcttatcattgttgcataatggttagagtacggcctctgacttccctaagaatgtaacacatgtaacaattgtcatagggaaaatatcttatcttctacattgaagtggcaccatagaaatatttcatttactcttcaactcctaatcctctcctaagcctctctgaagatgagactatttaatcattacaacaaatttattaacagattctaaagttacagaggcatatgtgcttttaattttttaaagttttgatctaaaatatttaatgagaatgtttgaaaaagtcaaacaattaaaaggtatataattaaaaggagcaatgtgtgaacaggtttaatatcaagaccgcatagagtcacctagctatgacattatggaattttctaccctctgctagtcaccactacagatctgaaaattagttcaaggacagtgtgaatgtccagacatctgtaaataaatgttcctttggctttttctcttagtcttgcttagttagtacttctcaaacttgagtgtgcataagatagcctgtgacatgtgtttataaaatcaataattttttgctttatgggcaatttaaagtatttgaaagaaaaaaatttacctatggctgatttctggcttttccccttaggagctgatttagaaaatcaatgtctccaacttaacactcaattttagttaaatcaatgttaagtctagtatatttaagaactatagtattctacttaactgagaaaattaaggaacacagtgggatttcctgtgtaagggaacattgcctcctatttcttatagttggaattttcatttagttgaactctcttgcccaagaaaaatttaagcatgttgaagacagaaactttactttctcttctagagtagagttgcactgtgggaacacatatgatagacagtggcttagagcaggaggccggaactgggccacacagcaggaggtgagcggcggcaagcgggcgaagcttcatccgtattcacaactgctctctgtcactgcgttactgcctgagctccgcctcctgtcaggtcagcagtggcattagattctcatagagcgcaaaccctactgcgaactgcacttgcttgcttgggatctaggctgtgtgctccttatgagaatctagtgcccgatgatctgagatggagctgaggtggtgatgctagcgctggggagtggctgcaaatacagattaacattagcagagaggtttgacagcacagagaccacaggaaattaactgcttgcacactcatatcaaaactctatcagtgaggggcaagtgacaagctgcatctggctggtggcaggctttacagtggcaagtgagctgagtgcttcaattgcacagctgcatctggtggcagctttaactcagaatctgacacttatttagtccacgtgtgacttgcctattattttatttaccacttccatctgcacctctttcccacactatgcacttgtctcagtcacagttttgggaagcccacaagccaaccctagccaagatgagtaaaagacaaacatcactgtagagcttctttgaaaagggggaagacctcatcatgagaaagcagaagactccaagactgccaatgaaaagaaagctgcatttaatagaaaataacaagtcctacttaaattatgggttcattgcaacaggtgatgcacattcttcaagtccactgtgtatatgtggtgaccagctatccaaggaagccatgaaaccttcaaaactgcattaccacacggagaccaagcaccctgcattaaaagacaagcctggctggacgcggtggctcacgcctgtaatcctagcactttgagaggccgaggcggatggatcacgaggtcagatcgagaccatcccggctaacacagtgaagccccgtctctactaaaaatacaaaaaattagccgggcatggtggtacatgcctgtaatcccagctactctggaggctgaggcaggagaatcacttgaacccaggaggcagaggttgcagtgagccaaggtcacatgactgcactccagcctgggtgacagagtgagactctgtctcaaaaaaaaaaaaaaaaaaagacaagtctttggagttttcaaaaaaattaaaaaatgtgtacaccaagaacacaggcaattattgaaggccaccaacttcatcaaatgtgtctacactgacagcatcctttttttttttttttgagatggattttcactcttgttgcccaggctggagtgcaatggcgtgatctcagctcactgcaacctctgccttccgggttcaagcaatactcctgcctcagcctcctgagtagctgggactgcaggcgcccgccaccatgcctgactaattttttgtatttttagtagagacagggtttcatcatgttggccaggctggtctcgaactcctgacttcagatgatccaccctcctcagcctcccaaagtgcagggattacaggcgtgagctaccgcgcccggcggagagcatcactcttagtggctaactgcgttgctgaagctaacaggccctttactgttggtgaagagttgatcctgcctgctgctaaggacatttgttgtcaacttttaggagaggctgcagttcgaaaggtggcaggtgttcctctttcggctagcaacgtaactagaggaattaatgaaatagcagaggatactgagacacaactgtaaaaggggattaatgaatcaccaatggcacacaatccaggttgacgagtctatcaatgttgacagcaaggcaacaatgcttgttaatgtgtgatatatttttcggggggatgtgcatgaggatatgttatgtgcacttttgttgccaacgaacaccacagctgcagaactattctagtctgtgaatgattacatatcagaaaaactaaattggtcattttgtgttggtatacacatggacagagcagctgccacgactggatggctttctggtttcactactcaggtcaaacaggtcgcttctgtatataagtactacatactaaacaattgtgtggctggagctccttaggtcgcttctgaatgtgagtctgtgcactgtgtcatccatagagaaaggctggcgagctgaaaaatgtcacgtgaacaacgttcagcagaatgtgattaaaagtatcaaccacattaaagtacgtgcccttaactcacgtctgttcgcacagctctgtgaggagatggacgcagagcacacacatctcatacacggaagtgagatgctttctaaaggtagattgctggccagagttttggaaaccaccccagagatgtcttttagaaaaaaagtcaccattggcagcacatttcagtgacatagaatgggctgcaaaacttgcttacttgtgtgacctatttaacctgttcaatgaaatcaatctgtcacttcaggggagaatgacagctgtgttcaagtcggcagataaagcagctgcattcaaagccaaagtggaattacgagggtgacgagtgaacactgggatttctgacatgtttcaaacattagcagagattgtgaaagagatggagccagggccttctttcccacggctgacacgtgatcacctacccaatactaccaaccacaaaagaacccccaactgggaaggaatggatccgcgacgcatttgtgaataagcccggtaaactgactctctgtgctagaagaggatcaactgcttgagatggcaaatgacagtggctttaaaaatatgtttgagacaacttcaaatctccatatgttctggatgaaagtccaggtagaatatcctgaggttgccacaaaagcactgaaaagcctgcttccgtgtccaacaacctgtctttgtgaagcagggttttctgcagtgacagcgactaaaatgagattacagagtagcctggacataagtgacacacttcaggtgtcactgtctcccgtcaccccagacgggactgtctagttgcagggaaaaaagctcagggcttccactaattctacatcatggtgagttgtaccattatttcattatatattacaacataataataatacaaataacacaataaatgtaacatgcttgaatcatcctgaaaccactcctccgaccagtctgtgaaacatctgtcttccacaaaactggtccctggtgccaaaaggttgggaaccgctggtttagagcatggactaaggtttgaagcccaaacctgcagtcactagtgatattacattgggcaaggtgcctaacttctgccaccttacaagttcaaagtgaaataagttaacaatataaattgttactgaaaaagagtgtccctcccccagcacaaagaccattttcaaggtaacacagagagaatactgccccctcccactgatgcagttcatgattccttgcagatcttacaggaatttcaggttaagaacacatggtgtagaatgttcccttttccctgcacacttgcagcacacactcagcggtgaagtaccagaacagcatttcactcagatcagcaatgaagctctctttgaaataaaaagttagaggaacatggaaaagaagaaaattgccaggaataccaaattttgaggcactgatgaggaacaaattggcaaaaaaaaaaaaaaaaaaaaaaaaagttccagaggacattaatttttatgcagcataggatttttataaacatgtgtttttattcaacaaatatttactgaggaaccactgtgtgccaggaacttatctctgacctcaataaacttgcataccagtgggatgaataaattaggaaacaaatagatgaaataatttcagaaaataaatgtctatgcttgttaaagagaaatttagtttttagagaaagataaagcatctttgatccaaacctcattttaataccttttaaaagccttagcaaggatagtttatgggaaaaataaatgcgctaaggggattttatagtaagcacagcgttcacagcaagtacttaataggatagccttcaagggaagaaattaattttaaatactttataaatcaaaatctgggaaaatggtggataggaggcaggcctaacttgcagctcccactcggtggacagagcagcctgtgtaaagccacatcgtgaacttttgctccaagaactaccaaaggaacatcccaggcaagcctagagaatccacagaccctttgtaggaggtggattgcagctgcaggctccatgagacagccgaggaactgtgggttcacttgctttctcagatggaggcttgtaccctggggcaagttctcagccctgctcaccacctgtctggaaataaactcagtgtgttgcggggcatggtgggtgtgagctgcaggctccacgggagctgggtgaggcctgtggctgccggctttaccccacttttctggtgacctatatgtcacagcagaggccccctgggaacgtaactccattggtctaggaaccacactcccatcccgcacagcagtcacagcaacccctgcccaaggggagtctgagatcagacatgcccaaccctgcctccacctgatggtctttctctacctgccctggtaaccaaagacaaagcccaccctgcccatcgctgtagaaacctgaatatttacccaaaggcgaccctagggcgagcttgtcttctcactatacaacctcagctgatgcactcttgacagtgccacctcctggctggaggacaaccaacacaaaaccagtgcactaaacaaaaacacaaccaaggaccctcacagagtccatttcactccctgctacctccactggagcaggtgctggtatccacagctgaaagacctaaagatggatcacatcatgggactctctgcagacactccccagagacaagttggaacctggtagttctgctgtgtggttacattcagaagataaataataattgttgcagttcgactctcaggaagccccattcctaggggaaggggaagaaaatcacatcaagggagcaccccatgggataaaagaatctgaacagcagcccttgagtcccagaccttccctctgacaacagtctacccaaatgagaaggaaccagagaaacaattctggtaatatgacaaaacaaggttctttaacaccccaaaagatcatactagctcaccagcaatggatctaaaccaagatgaaatctctgaattgccagaaaaagaattcaggtcgactattaagctaattaaggaggcaccagagaaaggtgaaatccaacttaaagaaatcaaaaaaaatgacacaggatatcaatggaaaaatctctagtgaaatagacagcataaataaaaaacaatcacaacttccggaaatgaaggagacacttagagaattgcaaaatgcactggaaagtctcagcaatagaatcaaacaaatagaagaactccagagctcaaagagaaagctttcaaattaacccaatctaacaaatgcaaagaaaaaagaatttaataaatgaacaaagcctccaagaagtttaaaattacgttaaacaaccaaacctaagaataattggtgttcctgaggaagaaaataaatctaaaagtttggaaaacatatttgagggaacaattgaggaaaacttacctagccttgctagagatctagacatccaaatacaagaaggtcaaagaacacctgagacattcattgcaaaaagatcattgcctaggcacagagtcatcggattatctacagtcaagatgaaggaaagaatcgtaagagctgtgaggcaagagcagcaggtaacctataaagaaaaacttgtcagactaacagcagacttctcagcagaaaccctacaggtcagaagggattgtgattctatctttatcctccttaaacaaaacaattatcagccaagaattttgtatccagtgaaactaagcttcaaaaacaaaggaaagatagagactttttcagacaaacaaatgccaagagaattcgccactaccaagccagcactatgagaactgctgttaataaaagaaactctaaatcttgaaacaaatcttcaaaatacaccaaaatagaacctctctaaagcctaatcctcacaggacctataaaacaacaacacaatgaaaaaaacccaaggtattaaataaatagcagggcgaatacaatagtacctcatatctcaatactaacattgaatgcaaatggcctaaatgttccacttaaaagacacagaatggcagaataggtaagaattcaccaaccaaggctggacgtggtggttcatgccagttggggacaccaaggcaggtggatcatttgaggacaggagttcaagaccagcctggccaacatggggaaaccccacgtctactaaaaatacacatattagctgagtgtggtggcatatacctgtaatctcagctactcgagaggctgaggcataagaattccttgaacctgggaagtagaggccgcagtgagccaagatcacaccactgaactccagcctggggcacagagcaagacccagtctccaaaaaattacaaaataaattcacaaaccaagtatctgctctcttcaagagactcacctgactcataaggactcacataaacttagagtaaaggggtggaaaaagatattatgtgcaaatggacactaaaagcaagtggcaggagtagctatttttacatcagacaggacaaactttaaagcaacagcagttaagaaagacaaagagggacattatataataataaaagaactagtccaacagaaaaatatcacaatcctaaatatatatgcacctaacactggagcgcccaaatttataaaagacctaagaaatgagatagacagcaacacagtaatagtgggggacttcaatactccactgacagcactaaacaggtcatcaagacagaaagtcaacaaagaaacaatggacttaaactacatcctacaacaaatggatttaacagatatttacacaacatcctagccaacaattgcagaatatacattctattcatcagcacatggaactgtctccaagacagaccatcagataggccaccaaacaaatctcaacaaatttaagaaaatcaaaatcatagcaaggactctctcagaccataatggaataaaattggaaatcaactccaaaagggaccctcaaaatcagacaaatacagagaagttaaattacctgctaatgaatgatcattgggtttgaactacactataatagtgacatgatctatcaaaacctctaggatacagcaaaagtggtactaagagaaaagtccacagcattaagtgcctacatcaaaagtctgaaagagcacaggtagacaatctaaggtcacacctcaaggagctaaagaaaaaagaacaaaacaaacccaaacccagcagaagaaaagaaataagcaagatcagagcagaactaaatgaaatcgaaacaaaaaaacaaatacaaagataaatgaaacaaaaaggtggttctttgaaaacatccataaaattgagagatcattagcaagattaaccaagaaaagaagagagaagatccaaataagctcaataagaaacaaacgggagctattacaaacaacaccacacaaatacaaaggatgattcaaggctactatgaacacccttatgcacataaactgggaaatctagaggagatggataaattcctggaaacatacaaccctctaagataaaaccaggaataaacagaaactctgaacagactaataacaagcagcgagattgaaatggtaattaaaaagttaccaagaaaaaagtccaggaccaaatggattcatggctgaattctttcagacattcaaagaagaattggtaccaatcctgttgacactattccacaagatagagaaagagggaattctccctaaatcattctgtgaagccagtatcacccagatagcaaacccaggaaaaaacataacaaccaaaaaataaaactatagacaaatatccctggtgaacatagatgcaaaagtcctagctaaccaaatccaacatcatgttaaaaagataatcctccatgatcaagtgggtttcatagcagggatggtttaacattcacaagtcaataaatgtgatacaccacataaacagaatcaaaaacaaaaatcacatgatcaactcaatagatgcagaaaaagcatttgacaaaatccagcatcccattatgattaaaaccctcagcaaaattggcataaaagggacataccttaaggtaataaaagccatctatgacaaacccacagccaacattatattgaatgtgaaaaactgaaagcattccttctgagaactggaacaagacaaggatgcccactttcaccagttctattcaacatagtactggaagtcctagccacagcaatcaaacaagagaaagaaagagcatctaaactggtaaagaagaagtcaaactgtcactgtttggtgatgacatgatcatatacctagaaaaccctaaagactcatccaaaaagctcctaaaactggtaaacgaattcagcaaagtttcaggatacaaaattaatgtacacaaataagtagccctgctatacaccaacagcgaccaagctgagacttgaatcaagaactcagccccttttataatagctgcaaaaaaataaaatacttaggaatacacttaaccatggaggtgaaagactgctacacagaaaactagaaaacactgctgaaagaaatcacagacaatataaacaaatggaaacacatcccatgctcatggatgggtagaatcaatactgtgaaaatgaccagactgccaaaagtaatctacaaattcaatgcacttcccatcaaaataccaccatcattcttcacagaactagaaaaaaataatcctaaaattcctatggaaccaaaaaagagcctgcatagccaaagaaaggctaagcaaaaagaacaaatccggaggcatcacattatccaacttcaaactatactataaggccaaagtcctcaaaacagcatggtactggtataaaaataggcatatagaccaatgcaaacagaatagagaaccaagaaataaggcgaaatacttactgtcaagtgatttttgacacagaaacaaaaatataaagtggggaaagaacaccctattcaacaaacagtgctgggataattgtagaagaatgaaactggatcctcatctctcatcttatacaaaaatcaactcaagatggatcaaagacttaaatctaagacctgaaaccataaaattctagaagataacattggaaaaaccctactagacactggcttaggcaaagacttcatgaccaagaacccaaaagcaaaaatgccacaaaagcaaagatagatgggacttccttaaactaataagcttctgcatagcaaaagaaataatcagcagaataaacagacaacacacagagtgagagaaatctttgcaatctatatatctgagaaaggactaatatccagaatctacagggaactcaaataagcaagaaaaaaaaaaacaatcccatcagtaagtgggctaaggacatgaatagacaattctcaaaagaagatatacaaatggccaaaaaacgtatgaaaaaatactcaacatcactaattaccaaggaactgcaaatcaaaaccacaatgagatgccaccttactcctgcaagaatggccataacaaaaaaattaaaaaatcactgatgttggagtggatgtggtggaaagggaatactcttacactgttggtggcaatttaaactagtatgacctctatggaaaacagtgtggcgattccttaaagaactaaaagtagatctaccatttgatccagcaatcccattcctgggtatttacccagaagaaaagaggtcattatagaaaaaagatacttgcacatgcatgtttatagcagcaccatttacagttgcaaaaatatggaaccagcccaaatgtccatcaatgaatgagtggataaagaaaatgtgggggggggtgtgtgtgtgtgtaatacacacaacaaacatagtagtattccatggtgtgtgcatatatatatatatatatatttatttatttatttaataaagaagaaatccagaataaagaaaggtgatcatttaatgcctatattagaaattaatattgaaaaccacattttgcattccaaattctaaattgtgattttcatatgaactagctacaaagttactgagaatgcattttgaacaatttctactttaattgactgataatttccttgaggtttaacatagggtcatttttactaaatcttccatgagtaagtagcctgctttctgtgctcattccacaggatgggaaaagaaatttaagtcacacactgatactatggagaactttgtgactgacttcactgcacctctatccttcaacactatccatctcaatttgcctttcaggctgtagttattttaatatttctaagtgaagcacacgtatcttctctttatgggagataagtatttctatgaacattcataaaccactcatctttttaatatatatccgtatcttaggagttgaagcagcacattcagcctcccaccagccatttctagcatctctaacaattatgcaattttaacaattcatccacaagtatttaccaaaagtctacttcatgccagacaccgaataaatgtctccaatcagactgaagaaaatgacttaaatttcgtggttttgagagaatcacaaacaagaaagcttctcagacctagccagtggtggcagccaccctgtaataacaagaggcatcaacctgaaatcaacaacaacacagcaaggaagacagaggggagacaggaggggaaagagagagaaggagagggggtggaggggaaagggagagagaaagggacaggaaggagaaaaagaggaagggaaagaaatgagaaattgagtcttcagagacatttctagccaaattaatcagccaaccttgaaacctgccttacttagggacttttttaatatgcaagatagctaatttccctattaagtcaattttaccaggtaaaactaaaaacactcgagtatttttttaaatgcaacaaagtgttacaaggatattacttttacatcattaaattaatacattgttatttaaaataaaatcttgtagaaaactctcattcttacaaaataataaattcctttgctctaatctggtttgactctatttatccagctggaatctacaatatataagactcttttcactcaaataaggctggtttcactagactctcaaatatgttttgctcactattaactcaaaatccttttatcttcaaatatttactgagcacctactaagtgcctgtcagagttctttatgcttacaatatcttggagaataaaaaagatacaataatccttgtcttcatgaagctgtattctaaatgcaggtgactgtcaataaacttgataaataactatatcatacagcgagttggaaatgcttggttgggagaatgcagaccaggataaggggaattggaaggcaatgtgggaagaggatagggagcaggacgcagtataaaaaaagggtggttgcggcagtctcctggagaaggtaagcaaaaataagcaaagcagccatccaggaagaaaactccaagcagagggatcagcctgcataaagacgttgagacgcaagtgtgcctgccatactcctgccaccgaagatgacccccttatttccaaatactaagtccttccagactcagctcaacttctagtctgtctgagaggtcctctcaagagcaataagcccactgatctctcttttctcagaacttttctatgctcttttcctgttaggaaatcagaatacgacagaaataaggaagacaggtttggagtcaatagatctttcttcaaatctcagcttcacttaccaaccatacatgggtttcttgaccttttcaaacttgcctcccttatgtttttaaaatgagatgatttaggataatgttaggattaaatgagatatggataattcttacacagagagaatgctcaataaattgttttgttcctgtccattcaacttaacattaactctcttctgccttccactgatagctggacacacgtgaaggacttaacttcttaactaaatataaatttcttgacaataagagaccacgtctagtatttcttttacattactgaaaaataaaatcattccaaaatgattctgtgattattaagacacagataataatattttgcatacagaacatttttatttggtcacaaaaagagtgctaaaatgctagaaatcgctacttttaaccagaggtttaaaatctctttgtctaactattaaatacagtttccaaaatcagtttatttttattttcattcttactatatatgttttaagcatcaaaagctaagcgtttgtggaagaacatgagtcatgtaatcaagaactggagtaccatgttaactgatctgtgctaataaacccactactttgcagagttaccaatgacaacacgtgaaataaactacaaatcactggatggttggaaaatataaataactacatacttgtgatatttttcatcagaaataaaaaatgggggttacatataagttcacaagccatatcaaaaaaaaggaaaatcaatcactttcttctctgagagattataatgatttttaataacttgttgtaatcacattttctgacaatgttgtagtataatcttttgtacttaattatatataaacagaatgacaccatcccatcccatcccatcaccatcagtgagagtaacacgaagctttccaattccataaatgaaaagtgatgactaaaacagccatagtgtgaactgcacgtgttcttctcctatagaaaatgtaacaacttgtaaagtgccttccttatattttattttatagagatgagaaatatgaatatatatactagtataactaatatttacatatgatgatatccctttctctcatatctaaaagaaaatatcatatataaattggatttgacttaccaaggacataaaagcaaagttcaagaaagtcatcatgacacaaccacgtatatacgactcttcttttccatagtttacttcatagaacttagtcatctctgaatgatctacaactgtgttgattctgtaacttgaatctagatgctatcaggcccaggagcaaatgcaaccaaccttaagattcaccgtcagaaacctgagaaaatctaccccagagaggccaagacatggaattttttgttatatttatctgaatttatctactgatgctttaagagctgttgaaacatataaacgtatctatgatcatgacagaagaaacaaataaatgtaaactctgtcgacatttgaggcagtattcactgtcttaacttggatattcaataatacctgaaaattcatagtttaaaatggctatttataaacatctaagaaactttataattatgaataaaaatttactaagccttcctaaaactcttacaatgttttgtgactctttagaaacatttttattatgttgctttagtatttaggatgtggggaaatgagaagtccaaagctttcttactatatttataacaatttaggccaggcaccatggctcacagctgtaatcccagcactttgggagctagggtgggaggatagcttgaggccaggagttcgaaaccaggtggggcaacataatgagaccccatgtctacaaaaaattaaaaaatagccaggcgcagtggcatgcacctatagtcctggctattcaagtggctgaggcagtagactgtggcaggaggatcacttgagcccaggagttcaaggctgcagggagtcgtgatcctgtcactgtactccagccaggatgacagagcaagaccctgtctccaaaaaaaaaaaaaaaaaaaaaaaaaaaaaaaaaaaaaaaaaaatcagtaacagagtaagagtttagcatgaaagtgtgacctggtacttttctgaagttggaaaaaaaatcccagaatgtattgttcacctccagattctagcaattctctgaggtatacaagattccatgaaatttggctatcacacattactctatcagcagagatcttaactggaaagtgttaatagtagaagatcttggcactaaatggaatataaacattaagaacttagaatgaagtttaaagttgctgacttaaattgtctcattttgaagaatctgggtcatgtgctgtaaaagttcctagctgtctgcaaatctatcaccttacttttgaaaatgtttttgttattattagagtacatgattgctctaattactactaacttcattggtacatcttagaacttctcttctaaaactgttcaaaggaaaaattaaaatagcagctctattatgtctgcatgtagtagtttcacattcattccacttatctgacattagatcaaatgtgcactagatagaggaaatttataatattaagtctcttcttggattctgtgaacactgaaaattacaagaccagagtacttttcattaaaaaacattcttaatgtccacagataggtaaaaataatgagtggttctctttctccttcagaccatctaacaaggcaggcagaggaaaaaagccagggggaagagtctgatcaggccaacagtagccggggaagagtctgatcaggggaccaggggaccagcagcagaggaggaggttgtttactccatggcagtgaagcaggatcctgcctcaagtacacttacatctccagaaggaatgcagcctcactacaaaatacataaatgtacactggacatacgttttatttattatcaataccactcaaagaaataagaagccagacaaatgcttagagcccttgagacaaatactaactaataaagactaggaatggaaaaaaatgaatagtccacaatgttcagcaatgcggctcttgttaacaccatcctacttcttcagcatttctgttgtatcagttaggaaattatagctcatggacaattctgaattaagactttttacctattttaaaactattagcagcttatggcaatgatcaatgaatattcatttccctttgtctatagcttgaagtgacaaaactttatacttttataaaagtcaattttatccacatgttgaaagaaaactatatatagtattaaaaataatgttccatttttgctcatgaatgattaactgctacagaaattgccttctaataataaacaactttagaaaatcagaagaaaatatgtgaaatgaaagtttttagacattgaacacaaggcaatgcaagacagtgatcccagtgattaaacacatagggaaaaaaagtcaatgttcattcaggataaaagctcacagcaaactaaaatttaaggggatttccttaacatgataaagagaatctgtaaaaagtctacaggtagcatcacacctaatggtggaagattaaatgctttcctactaagatggagaacaaggcaagagcatctgatcgccccactcctattcaacaatatgtaattctacaatgctgaatatgcgaattatattcaacattattcaatattctcaccactccttttcagtaaacttttaaaaactgtatatacatacacacacatacatactaataacatagtttacattatatataatagatattattctgtatccaatatagattgaaaaggaaaaaaaaactgactactcacagatggcattgtgcagaaaagagagagagatcagactgttactgtgtctacgcagaaagaagtagacataagagactccattttgttctgtactagaaaaattcttctgccttgagatgctgttaatctgtaatcctagccccaaccctgtgctcgcagagacctgtgctgtgttgactcaaggtttaatggatttagggctatgcaggatgtgctttgttaaaaaagggcttgaaggcagtatgcttgttaaaagtcatcaccattctctaacctcaagtacccagggacacaatacacagggacctctgcctaggaaagccaggtattgtccaaggtttctccccacatgatggcctcatgggaagggaaagaactgaccatcccccagccaacacccataaagggtctgtgctgaggaagataaatgaaagaggaaggcctctttgcagttgagataagaggaaggcatttgtctcctgctggaccctgggcaatagaatgtctccaggggcaatagaatgtctcggtgtaaaacccgattgtatgttctatttactgagataggagaaaaccgccttagggctgaaggtgagacatgctgaaggcaatactgctctttacggcacccagatgtttggatgtttgtgtacgtgcacatcaaggcacagcaccttttctttaacttatttatgacacagagacctttgttcacatgtcttcctgctgaccctctccccactattaccctattgtcctgccacatccccctctccgagatggtagagataatgaccaacaaataatgagggaactcagagaccattgccggctcgggtcctccacatgctgagcgccggtaccctgggccaatttgtctttctctatactttgtgcctgtgtctctttcttttctcagtctctcatcccacctgacaagaaacacccacaggtgtggaggggcaggccaccccttcatggcatgaacacctaggtaaaaagttctgaggaggccaggcgcagtggctcacgcctgtaatcccagcactttgggaggcccaggcaggcagatcacgaggtcaggagatcgagaccatcctggctaacacggtgaaaccccgtctctactaaaaatacaaaaaattagccaggcgtggtggcgggcgcctgtagtcccagctactcaggaggctactcgggaggctgaggcaggagaatggcgtgaacccaggaggtggagcttgcagtgagcagagatcgcgccactgcactccagcctggatgaaagggcgagactccgtctcaaaaaaaaaaaaaaagtcctgaggaatctgcaagaaactactagaatgaatatgtgagttcagtaacgtcacaaaatgcaaggtaagaaaacttcaaatcctaaataaatagttaaggataccctgttgaaggatcagaattgttaccaattttccccaaattgatctgtagagtaaatacaggcaattcaaaatctcaacggccttctgtcgaacttgacaaggtatctgtaaaatatatatggtaatgcaaatgacccagatgagcaatgtcagtttttgaaaataaataagttgtagaagttatgctacattccaagacttcctacacagctacattcatcaaaacagtgtggtactgacataatgagagacatgtaaatcaacgaaccaaaacagaatctagaaatagacatatgcatatatgtgaatttaggcaaagataccaaagtgattcaatgaagaaaggataatctttttcaacaaatggtgctggaagaaatggatattcataaacaaattaacccttacctcacacaatacataaagattaatgtgaaataaacagatgcacatataagggtgaaaactgtaaaatgtgtataagaaaacaggagaatatattgagttaggcaatgatttcctacagtagacataaaagacacaaatcatcaaagaaaaaattgatagaacagactttatcaaatttaaatactttggctcttcaagagacactgttaagaaaataaaagccacagactgggagaaagtattttcaaaatacgtatctggcaaaagacctataactaaaacacataaaattctcttacaactcaatactaagaggatgaatactcaaatatacaaaacagcaaaagatttgaatagattcttcacaaatgatgatgcagaaatgaaaaactcattaaaacgtttaacatttttagtcattaggaaaatccaaattataataaaaagagatatcaccaagtacccattagaatggagaaaattaaaagaatgtgaagcaatggtattttatagtacactgctaaacatgtggtgtatctgaataatgggatactactgagtcaagaaaatgaacaaagtactggtccacacaaccacctatgcaaatcctacaaacatcatgctaggtgagagaaagcagacgcaaatgacttcacactacatgagtgtctttacatgaaattctatgaactataatgacaaaaggcagatcagaggttgccaggaactagaggagggtggagggtgtaggagggaacattacctgcagagaggtatatagggactttctgagatgacagaaacgttgattggggtggtagttacaggataatatacattcatgaaaactcattaaactatatagttaaacttgatcagatttattgtatgtaaattatacctcaataaagctgattaaacaaagaaacaagaaaagtgtgtcttctccataggcttgaactcgatgtgacgcaagccccaccatttctttcttccattcttggcttgggttttcattcaagatcccatcttgtctagggtgtactcctggatccacgcttcaacaccagctgagggcagcagcaggggagatgttcacgtgtccctcatcccctccattcttttcacagccacaaacaacttcaaggttattcctccacatttactaagaacttctcaacgtgactcatattattcctttcccttaaaaccgcttcaaatcattctgcacagtatcaacatccacgtggaagaatgcagcgggctggatggcaagcaaaccaaagcaatctgcacagggaatgatgggagttattctggcaatagggagttttaaccaaaacttaaggggccagcaggaacaacaagagtccatgcagaggcctgttgggcaaggacagccacaggtctctgcccatcaagaaataacaggccttggaaacgtggcacgagattcaataagaacccagaggatcaacattgaaaagccaaaggctccttttcttcactactatgatgttccctaagtttcccaatatatccacctgttcactggaatgaagaaaagttagaaagaagccattaaagacaggaactcttagatcaaccaactctggaaaatagtttggcgttttctgaaatcctagttttagatatttacctaagactaagtatctataagaccaagtatccaaaagaaatgaaattaatgcaaaaaaaaataagtaactgaaagatctttatggataagatggttttccactaacagtgggaaatataacccaaaagcagaataagattacgtaataaattatgttattttgcatatccaagtcaatcttgctactgtatttccacaaagaaagccaaaattattgtcataaaattctttttttagcacctgttaattataatcaattacaaaagtgaattaaacatttatttgcagaaaaggctgtataattcaaaagcactgcgacttatggctctgtgaaaatccataaaactgatgacagggaataattctagaatcctaccaagtagagataggtaaaacagttgtagcctaaggaggaagaatttttttagaatattattttggaaaatttgagaagataaccactaaagagagaaaaaaggtcatgtggttaaagtgaaataaattagagctcagcattatgatctttttattaaaactataaaaaatactatgatgtcttttattaaaactataaaaaaattaaaccgtgatagcattaaatatccagaattgtttaaaaataaatgacagcatcattaacttagataaatgattgaatattcttcatctccagtatgatcctggcccaatatgctgaggtctctaagactcacgatggttctccagcacagctgtagccacaccaacagcttcttggggcttcaagtcaatgtgcttagagacagtcattcatttattatcagaaaatctaaagcttttggtactgaacactgtgatttgaattttgcagctgatttttcaaatgtttctcagtaagactggtttttatttccaagtaagattcataaaatcttactaatatattactaataataacctaatatattaacataacataaaatcttactaataataacctaatatattaaatagattaaaagaaatatggtggcagatatcataattggcttaacataaattccagcctcctctgggagctcccttttgttccacttaggctggaaagctaaaaactacattttcagatttccgagcatcttatcatgtactattactaaggtgagactgaattcagaactgagttaagtgagaagaaaggcagggcctgcggttcccactttcctgaggagtatcaatccacagccaccagattgctgtcgcctgagcttcctatagacaaggagcaacttcagcagtcacagccaatgatgtgaaattctggggcctaaaagcttctcttcgtagctctgcctagagatgatccctcgagtccttctaatgattttgtaagtcacctaatatgtttctttctaccttccattgttttctattacctataaccaaacccaaatacaagtgttttattagtaaaaatttactttaaatgttataaattatgaaacatctcatgataaagccaacaaataataaaaaacacattgccttacaaattcaaaagactccagtttaaaatggctcaaatatatttacaaattgttttctttaaaagttaaatcaataaatatataactactcacatttcttataacaagaaacatacaaacataataagccaaccactgtataccattttgtgattaaacatacactgatccaactttcaaataaaatgatgatgagagccaaaatattactaatatgatacttttttaaaaagttcaaataaatatgcagctaggtcactataagctttgcctgagttctgcataaaaatgagttgaactgatggtgcaaagttaatcggttggtggtctccaacatattaaaactcggtacattgaaatatgtctgttgtcttattatagctaaaaactgcacaaaactattttgggggcctaaattcttttgaggtaaagccatagagcttctctcagagaaaacaacacacatttaaaaatcttacacataatctcagaaggatcacatgaactccagtctgatttcaccatgatcaggctacagattggttgcattcaaaagctggtcagtacacaaaacattttaaattctgaattccaagaaaaaaaataaaattcttcaaatattctaaaagtaacatgcataaaaatataaacaataaaacaataccaaatatatagtgaaaaaaataatattacttgtcttatttttcaattttattttctaactctacactgcctccactcatggtaaccactggcagacagtattcctgtcgggaaaatgtcttttcccgcttttttccattcccataacaacataactatataagtacttttgttggtttttttccccactaaaatggcactgtactataatgttatattgcagattaattttgtcacttagaatttcacagacattcctttctagaccatagagttccaaatcaattttttgaatacacgtataacatttcatacaataaatatatcacaatttattcagtatttccctttagataggcattacggttgatttcagtattctatctctgtaagcaatgttgtgataaatattttggcatgtatatattcaatattctccccactttaaaaatgttgaatattctcctaaaagaaaaatgttcccaatagaggttacttttctatagaggagattttacatcacgtataatagaaaataagtacagatgaacagtcatattggctaaataagcaattgtgggcacgttcaacacatttccaagtaacagtgccacgtctgatatggtgaaaagaaaaattgttcttgagaatatatctttgattggaaggtacgcaatctcactaaaacttccggcactcataggctttgccttgacacttggtttcaaggattttaagctaaagtaaggacaggtgccttatctgtcattcaaaaaagttataaaatgattcaacatattcacagctttttatttgtagagtatttttactggcaccagctataaataacacattggtttctctggttcattctagtacacttgaaatactgccataacaatcaaagacttatctcttcgccctactttgcattgcattctctgatgtctttgtcccggaagcacagcctctctgtttttcttctaatcagtaatcatcagctcaggaggtattgagcagtcttcacccctttagtaattgatgtttagaatttatgtttttgaaaagcaccatttggtgatcctggaaagagtgtggttggctgaaactacctgccaccctgctgccttacaactaggtttttatttctgtttccctaccctgtacttgtgtttcatgctggagttgaaattttgtcctatatctcaacatgtttggttagggctcagacatgctgggtagtaacacttacaaggctctcagtttgggtagaagttattctgaggaggaagaggtcctactcactttgttcctgcaatcaaggctagctagagttccgtttggagtagactgactatacagtagcccagtacaaggaggaagggctttagaaaccaaaggacaaacttgcctgacttcctactccttagttctgtcgtgaggattaaataagctaacacagtacttgtaaattaatgttccttttccccttatatgcactcttcatgagactcctactatcatgatctacctggaagacagacaccccagtatccaactacaccaagcccaagtccagtaagtttcttcaagaagttctacaatcatccaagtttcagcctatctcccgccagatttgtccagatccctattactaacttgaatggctcaaaaatcacataatcacagctgaatgatttttagctcccctttttctcttcctctccacttcattttccaactaacacttaactacacacctcttgggaattatcgagttctactgatgggccctattgttttgggggctttcagggtgatacaaatattttacggttttagtctcaaaaaggctttgaaaatcctacacatattttaaagtcttatcaagaaattctgaggctacatacaaaatgtcatctaaaatgaaacaatgttttcttaagacttcaaataaaccacctcaaaaaacaaaagtacatatattaaaacaaaccacttgaatttcaacttatgtagatatatttcaaggaatatttctacccaaagcccagaagaaagagactgttctgaaactgaaaagtagtattttaaaaggccattacttgtattttcaaaaacgattttatgaatgtatacttgacaaaacgacacgtacatatttaaagttaaaaggttgcaaagttcacatacacatgtgaaaccactgacacaactgaaaaaacacacaaatcaccccaaaagtttccgcagatccattataatccctgccaactgccatcccaagcaaccattgatctgttttctgtcactgtatattacattgcattgcctagagtgttgtataaacagagtagcatagtacagtcctcttttctctctggtctccttcactcagtgtaactgttttgagattcatccacactgttgcctgtatcaataatttattctttttattgaagagtagcattcctttgcatgaatataccacagtttatccattcacttcttggtggacctgagttatttccggttttattcctgtatgagttttttgcaacaacacaggctttcatttatcttcagtaaataccttagagaggaatgaatggggctcatatgctcagtgtctacataacttttaagaaactgccaagctattctccacactggtgagagcattttacactccctcaatcaacgtttgaaaagtccagggcctccacatccttgacaacccttgctatagtaactgggtttaattttagccactgcaagaggtatgcagtgatacctcactgcattttgtcatcaacagttttactgaggattcatttacataccataaagttcaccaactgtaagtatacaaaattcagtgttagtatgtttatacagttgtgaagctatcataatagtccagtctcaaaacacttccatcctcatcaaagaaagttcctcataaccatttaaatcagacccctgcacctacagagagctcagcaatcagcgatgtgcttcccatcttcacagattgatttttttctgggcatttcatataaacagaatcacataatatatagtcaattacatctggtttcttccacttagcacaaatttactcaggttcatccatgtcaaagcgtatattcatacttcactctttattttttattgttgtcttttattgatatatattattttcaatatttatgaggtatatataagtattttttacacgcacagaatgtgtcatgatcgagtcagggtacacgagtacttatcatttctatgtgtttgtaatatttcaagtcctttcttctggctactttattcttctgcatatggatatccaattttcccagcaccatttattgaagacggttgtcctttccccaacgtatgttcttggaacctgtgtcgaaaatcagttggctataaacatgtgaaattatttctgagttctttattctgttccattgtataatttgtctatttttatagcaataccatgctgtctggattgcaatcgccttgcaatataatataaaggcagggagtgtgatgcctccggtgttgttccttttgctcgggattgctttggctattttttggttccatacaaatttcaggattttttttttttatttttgtgaaaaatgacattggtactttgataaggattgcattgaatctgtatattgctttggacaacatgctcattttattaattattttgatctatgagcatggaatatctttccatttgtttgtatcctctatccttttcaatttctttctttcagtgttttgtagttttccttatacagagatctctcacctcctggttaaatttattcttaggtattatatttaattttttatagctattgtaaatgggattggcttcttgatttctttttcagctatttcattattggtgtataaaacactgctgactttttgattttgtaccctgcaactatactgtatttgcttattagctctacaagttttctgacggtgtcttttggtttttctaaatataaagagcatgtcatctgcaaagagggacaacctgactttctcttttccaacttggatgccttttatttccttcccttgcttgatgctctctggctaagacattcagtagtatgttgaataggagtgctgaaagtgggcagccttgtcttgttccaggtcttacatgaaatgctttcagctttcccacattcagtatgatgttagctgtgggtctggcatatatggtttttattattttgaaatatgttccttctaggcctagtttgctgaattttattaaatgagatgatcatatggttttcgtccttcattcaactgatgtatcatgtatattggtttgcatatcttaaaccatccttgcatccctagtataaattccacttgattgtagtgtattacctttttgatgtgctgtcaaatttagtttgctagtattttgttgaggatttttgcatctatgtttatcagagatagatatactggcctgtagttttcttgttttgctgtgtccttgtctggcttaggtatgagggtaatgctggccttgtagaatgagttggggagaactccctcctcttcaatttcttggaatagtgtgaggactggtattagttcactatgtttggcagaattcaacagtgaatctactgggtcctgagcttttctttattgggagacattgtatttctgattcaatcttgctactagttattggtctattcaggttttctatttcttcctgattcaatcttggtagaatgcatgcagcccggaatttatccatttcctctaggttttgcagtttgttagtgtatagttgtgcataacagtttatgatgatcttttgtatttctgtggtatcagttggttgtaatgtctccattttcatttatgattttgtttctttaggtcttctctcttagtctaactaatggtttatcatttttttttaacttttccaaaacccaacattttgtttcattgatccttttagttatttttagtcttataattttttagtatttcacttaggtctgtggtaatatttatttcttttgttctactacttctagatttagtttattcttgcttttctagttccttgcagtgtatcattagattgtttatttgaactcctacttttctgatgtaggtgtttgttgctattttcttccctgttagtactgcttttgctgtatacgacaggttttggtatgttgtatttccgttttcatttgtttcaataaatgttttgattttcatattaatttcttcattgacccaatggttatttgggagtatcttgtttaatttccatgcatttgtctagtttctaaagtttctttcttttattgacttcaagttttattgtagtctgagaagatacttgatttcaaaatttttaaaatatcttgagaattgttttgtggcctaacatgtggtatatcctgaagactgttccatgtgctgatgagaagaatgggtattccacaattatcagataaaatgctctgtaaaccttaggtccagctgatccaaacaccagtttaaacacaatgtttatttggtgattttcttcctagaggatctaatgctgacttctgacaggcggatgttgaaattccccactctcattgtattggagtgtctctctctctttagatctagtaatattagctttatgaatctgggtgctccagtgttgcatgcacaaatatttagagttattatatcctcttgaagaattgatctctttatcattctacatgatctcatttgtatttctttatggttttttacttaaagtctgttttatctgatgtaagtatagctactcctgctagcttttggtttctatttgaattgaatatctttttccatcactttagtttcactctatgtgtgtctttacaggtgaagtgcatttcttacaggcagcatatagttggatcattttgttttgttttgttttccattcagccagtctataactttttcagtagagattttaatctattcacattcaaagttattattgcatgggaagttgttattgtcacattgtttttttctggttgtttgtatattctttgttcctttcttttctcttattgtttgtcattgtggtttggtggttttctgtaggggttccatttgagtcctttctctttctgatttctgtgtttgctttaccagtgagttttatacttttatatgtttttacgatagtaaatgtcatctgtgcttccagtttaggacttccttgaacatttcttgtaggactggcctaggaatgatgaattccctcagcttttgcttgtctttgaaagatgttatttctccttcatttgtgaaagataattttgctgacaatagtaattatagtaataaattattatttattaatagtaataaaatactagtagcctaggttgacaagttttaaaaaaaaattcagcactttgaatatatcattctactctctccttgcctgttaccttggtcttctgctgagaaatccattattagtctgacaggggttgcaaatagtattccattacatgaatgtatcaaacttatttattcaccagtggagagacatttgaattgtttccagtttggagctatactgaataatgctgctatgaagattcatacacatttcttgatgcaggcatgtattcctctccctttagcagattctcaagaggaaaactgatcagttgtatgttaagtataaccttttaagaaactgacaaactgttttctgaaatacgtgtaccattttattttcccaaaagtaatgtataatgattaccatttcaccacatgctcaccaacatcagttattgtctgttttcttatacttattttaatgagtacagagtagtatctcattgcatttccatagtaactaatgagattaagcatcctttattggccatttatatattctctttgagatcattcatactcagatctgttgacttttaaaaaaatgggttgtcttattattttgtttaagaatcctttatatattctggatacaagttcttagtgaactacaatttactgtttttttaaaattttttggactgtgcttttggtggcacatataagaactttaccccaccaaagaccatacttttttctaagaaattttagaatttagctcttacagtaaggcatatgattcatattaaattaatgtagcttatgatatgacagaaaagtatacagtctttatagttattgtttatataatgtatgaatatataattgtcccctaccaactatcctttccaaaaatcagttgttttggcatctttgttgaaagtgagttgaccgtgtacagatttatttctggactctcaattctgtttcatcgatttgtatgcctatctctgcagcagtacaaaataaactaacatacagtgtttgtacagtaatttttgaatcatgtaatgcaaatccttcatattgaacttcattttaaaatattattatgattcttctaagaggtcctttgcatttccatatgcattttaaaatcagttaatcaatttctataaaaagacctgcggggattttcataaggacttctttgaaattatggatcaatttggggagaattgttatccagacaattcataaagagtaaatctgtcttcattcatttcgattttctttaatttctttcagcaatgtttcatagttttcagtttacaaattttgcacttctgctaaatgtcttaagtattttattttttgatattactgtgaattttaatttctttcagattgttcatttttatgtagaaatactacttatttttgtacattgaccatgtagcctgagaccttgctaatttattcattagttttgtagttttttgtgaagtgttttgaatgttctccataaaagatgttgtgatttgtaaaaaatataagacagttttagttcttcctatcaaatctggatccccttctcttttgccttattgctcaagttaacaactgtccttctactctgctgagaacttttctcatgaaattttattttgaatttttactagtatgttctattacattaactgatttagtaatattaaaccaactttgtatttctgatataaatcccacttgtccatactgtatcgtattttttacatattacattggtttgctaattttttaaaaggattattgcatttatgttcatgaacaacatttatcggtgcttttcttgtgataccttagttggctttgatacgaggttaatacaagactcacagaagaagttgaaatgcttttcttccttctctattttctgaaacagtttgtgatggattggcattattctttttaagtatttaataaaattcaccagtacagtgatctggaaggcagtgtttgctgtgggaagatgtttaattactataagcctgtatcagtgtgtaaacctgcttggttttacattccactaggaccctttccaaggagtgaccactgggagctgtgaagagatggggaccttctccagtttccactgcacatgtgcatatcttcagccagaaacaggtttaccccaatcttgaatgaaatcacaggctagtagagcctggccggccctccgctaggtgctggcccccgaaatgccattgatgggggatgaggttattgcttatgactccaagttgagtgagtccctgcaactgcagaagagaagctgtcagaacctctggaccaactactagagtcagggggtaccggaagtagctccaggccataacaccatgatgcccacagtttttactgcaggtcagcagtttttaaggtatgaatgattcttggattgtgtattgcctttgaatgatgtccagagcactaaaatggctgtttttgtccatattttccacttcataattgccttttggggagaggatttcctgttgtctcctcttagctttagctagaaatccttttatccaaactattcatttttactacagagcagcaattttcaatgtgtagttcactgacctctgggctcctagacaccctttcagagggcatgcggatcaaaactattttcagaataacactaagatgttatctgtcttacttatattctctcaggagtgaacactatatttttcagaagctacttaatgctttgacagcccatgacatttgtactttgcattctaatgtttctaaaatgtttttaaggtcataagttcacagtttaggatataaatatgttagtcttcagaggttaactatgttctcaatacttctatagtgcttttatttgctatatttaattatacctattgtaatctctgcaatgtcattaacatccaataaataattacatgaaattctaaattttcttgtacttacataaaaacataaaatgtatacttttatataaaattattggtttaatattataatcattttatcataaaataaaatttatagtatacacacacacacacacatatatatgcttttgttcttttttttttttttttttgagatggagtctcactctgtcacacagggtggagtgcagtgggacaatctcagctcactgtaacctccgtctccagggttcaaacgattctcctgcctcagcctcccaagttgctgggactacaggcatgcgccatcatgcttggctaatttttgtatttttagtagagacggggattcaccatgttgatcaggctgctctcaaactcctgacctcatgatccgcccacctcggcttcccaaagtgctgggattacaggagtgagccaacgcgcccggcctattttcttatatttaagactgtatcattggctttaaaagggggagcttagtaaatttattttcttaacccactgctgttctatttatattttaaaacactgaacaagataaaactgacctatcagaagattctctgatttatggaagagagcaatctactccaaaggaactcggtgaaactgtaaataagaaataaaaaatctgctaaaatatcatttccttggctttaagaatttatctcatcctgccttaggcaacagaacattttcaaataatattccaaatagtttcctcctatctaaggccagccccttcacttagtgctgtatcttgttctctcacctggtcaaggccatagctccagcaatctcttctccgtcttccatctacaatttttccctctctattgaagcacttcccataagcatacagtctcttaatactcccatgttaaaaataacaaaaatgtcaccttccatatgccattccctatctcctctccttcaaaacacatcttaaaagattatgtacatgcttcctccctaaatcccctccttaatttatgagtcatagtattcttaatatatgagtcatagtattctcaaagatacgcgcacatcaaaaagaggctctcctgcccctgtttttatggacctacatcatagaactttctactaccattgtacataaaaccttatttgatagcggtatttgcctaacagaacaaaagcccttaatgatctgacaccctctcacatgttaagcatacgaggacaaattataagcagccttcatatttctaaaaagtaattttcataaatggataaaagagtgaggttaacgtgaaagcttctggggcttatgaataggtcacttgtttttcctcattatttatccaaacaaaatcactagggaaaaatttttaacaaataatcataaatatcatgttttactttaaattacatacataattactccctttaaccatgttcttacaaacggcaacagggccacattagagtaaaataaaacctacttttagacaatgtatccttgaatactaaaaatgattcactgtgataagcaatatataattactctaaagaatacagcttccaattactataaagaactatatttttaacataatgtgctaaaaagtacaaccttatattcatcacattaccatgaatcaaaaaaaatctcattaaacacattacagtgcttctgaattattcaatcattctatcttgattcattaaatgggtatttaatacacacctcttgtgtccaacattacataagatattagaaacttagtgaatgcctggcaagttatgccaccaactgattcttccttttaatttaattagaaaactagtaaataaactacatgtctatgaaattgaaactagtaaaataaatatgaaatagatgacatttttcacaaatacatcttacaagtcttaaatagactcaaaagactcacagtctctatcaaaaataagatttagtttatcattcaaatttcatcagagacaaaaacataagacaagatagttcaacacaaacaccagttaaagcaattaggacccagtatttcccatgaagagaaatctctcattctaaagtattatttaaaatagcattaatattatccataatttcccccaaattggaaataatccaaataggctttagaaagtaatccgataaattgtggtacatccatacaacaaaatactactcagcaataacaaggaacacacaattggtacagacagcaactcggatgaatctcaaaaaggctcgacactgcatgatgtcattcacacgacatttgggaaaacacagaactatagtgatcactaacacagaagtcattgccaaggacggggtgaatggagggcaggattataaaggacggcacaaaaaagtgccattcttcatgctgaggtcagtggtggttacgggaatctacatatgtgttaaaattcatagaactatacacgagaaaaatacaaagtcaattatttttaatatattcaggttgagtttttaatatatacagctatcattttgtgagtgattccatgtgtccggtgctaatccttacatcattcctatgaagttggttttattcccattttaggtatgagaagcaaactcaaggaagttaaggttaagtaattaaatgaggttattcagctaaatattaagtggcagatcccaaattcaattttaaagttgtctgattccaaagcctgaacaaaatattttgctaaacactctgatgttgctagaaaacactgacttctaaaaatcacagcttcgttcaaatccataaattatgagagcagaacaaattaattaaggacattaaatagagggcacaaattaaaatgaccaaacatgagtaggtagggtcaaatgaagagtaatctttacagtagaacccttcatctgcagttttactttctgcaattgcagttacccacagtcaaccacaatattaaatggaaaattccagaaataaataattcataattttaaattctccaccattccgagtagttatgatgaaatctcacactggccagctccattctgcccacgacatgaattttccctttgtccagagtctccacgctgcagatgctcctgaccctttagtcagtagctgtctggcttacgggatcaaccgtcctggtatcccagtgtttgtgttcaagtcgccctcactttacttaataatgacagtaacgcacaacagtagtgatgctggcaattcagatacaccaagaggccgtaaagcacttcctttaagtgaaatggtgaaagttctcaacttgataaggaaagaaaaaacaattgtctgctgaggttgctaagatcagcagtaagaacaaattttctgtccatgaaaccgtgaagaaggaaaaataaatctgtgctggtttgccatccgacctcaaactacacaagttacagccgcagcacaagataagtgcttctctaagatgagaaaggcattaacatgtaagggtggcagtcatgtacagaaaccagttccaattgatggcaacagggtttggtattatcagtggtttcaggcatccactggggttcatgaaatgcatatcagtgcatacagggaaactactgtacttactggaatggaaagggttttgaataaaaagaaagatgagggtgagacaatgttagtacatttctgtaatctgtcatggaactatcattttagttggatttataaaaagaacattttcacattgacatcagtggcatttaagaataagctagaatagggaacaagtatttttgcatttgatagaagaaactggatcctcaacttcaatgaaggtattcagttcaaacttacgatatacggctgaccgactacccccaagaggaagaataaacagacccatggtctatgggttttgaataaattgagatatcattaaacaaaaatctaaaagagttagaatcttaggagttacagaaatcacaacttctaaaaccaatggcatcactttgtttaaacaaacgaacaaataccaaaatgtctatctcatccagggtaataattgagaaatctcatggagactgagatgaggagaggaaaaaaaaaaaaccacatcagaagaaaaatgagaaggctgagcagaggaaagattgaagtcctcctgtgtactgtcatctacttcaacctgtggctagtagcaaaatactccctgctgctcaattcgtttaactatttgccttgccttgcttcatagaacacgtgtttggcttcatgctaaaagtattcccagatatatgaagaaaacagaacaaactcaccccctagctttctttcaagctatgaaagtgatttctgaaaactcctgaggtgcctatgataacacgtgtgactgttgtttaatatacatatttatatatttttaagttgaagtgtagaaaattatgtggctcgattttttctggttttctttttaatattctcaccactggctggtgatgaacagggtagggaagaaatgcctaagtcctatctgacagttatctttttcaaaatgctcacctcctttttgtattgaggctctacagttttgaaagtttacttcagaaaatcaagtaagtggaaaggaactcagtggccttcactttgcttttatttctcttgaatccagacctaaaacataggagcaccaagctgccttttcaagttttaaaattctgtttgaagtgacaatcacgatatccccagaaccagtatcaatgctaagtgataacaccatcaagttccttctagaaagtaattaagtacttcttgacttatatagagttccttttgtttctcatgggaaaggaagaatagtttgaagcacgttctatcataaaattcctaataaacagcccaaatgtgatctgaaaattgttttaagttccaagatgtaacataagaaatttcatgtaccacctctacttttaaaaataatctcaatcctaccaaataaatcattttataaaccatagagaacgctcttgacattagtaatatgtataacatctgaggaggagacttggaactacttcgtgcttgacagtttgaacaaattccaaggggagtatgatgaaggagagggatgggcatgaggacagctactaccctgggcacctagtgatttgacagagcatctaggagagtagagcccacagatttttcagatcaagcactaagaatttcctaacttccaggcccagagctacttataggccaaatagtgaaacaagataaatgtttcttttgaagtcctcaatggccctttaatcacttaaaatgagtctgtcggtcaattactgaattcatatattcaacattaactgagttactagttggccaggaattaagaaacaagattggaatatgacacaccctttgtactctaagagccatcagtgtattgggtggactggacaattacatccccagaaacagaccagtgagaaaaggaagctttctctaaaacctcccactgtagaagcccccttcaggctctgggaagagccctaggacaggcatactgcatttcattgtgctttgctttactgtgcttcacagatactatggtttttttttagaaattgaaggtttgtggcaccccagcagcaagcaagtctatcagcaccatttttccaacagcatgtgctcacttggtgtctgtgtgtcaaattttcacgatattcaaaatactttttcatcattatatctgttatagtgatctgtaatcagtgatctttgatgatattactgtcattgtttggagagctacaaaccatgagatggtgaacttaattgataaacattgtgtgtgttttgactcctccaccaactggctgttccccgatctctctccttgagcctccttattccctgagacacaacagaatttaaattagaccaactaacaaccctacaatggcctcaatggccttccttttgttcaagcaaaaggaagagtcacatacctctaactttaaatcaaaagcaaggaataattaagcttagtgaggaaggcacgtcaaaagctgggacaggactgaagctaggcctcttgcactagttagccacgttgttaatgcaaagcaaaagctcttcaaggaaattataagttctactccagtgaacacatgagtgatacaaaagagaaacagctttattgctgataggagaaagctttagtgatctaagacagaagattaaatcagccacaatggtccctcacgtcaaagcctatccagaacaaggctctaattctcttcaattctatgaaggctgagagaggtcatgaggaagctgcaaaagaaaagtctgaagctagtagaggttagttcatgaagtttaaggaaagacgccatctccacaacataaaagctcaatgtgaagcaggaagagctgatatagaagctgcaggaagttatccagatgatctagcaaagatgattcacgaaggtagctacacctggtgctttctggcactataaatttgactactcatataagtgggatcatataatatttgtccatttgtaactagcttatttcactgagcataatttcctcaaggttcaaccacgttgtagcatgtgtcagaactttcttcttttgtaaggctgaataatattttattctatgactagatcccattttgtttatccattcttctgttcatggacacttttgctgcttccacatttggccatgaacagaccaacaatgagttccacactgaatcagtaataacaaaaagcctaccaaccacagaaaaggtcctgtgtatgtgaatacaaagccaaactctaacagatgtacaaataagagctggtaccaatcctagtgaaacaactccaaaaaaaattcaaggaggagggactgctctgtaactcattctacaaagactacatctccctgatagcaaaatctggcaaagacacaatgcaaaaagaaaactatagtctaatatccctgatgaacatagatggaaaaatcctcaacaaaatactagcaacccaaatccagcattatatcacaaagttaattcgccacaatcaagtaggctttattcttgggataaatccacataaaagaccacataaaaaaaggtctttttaaatgttcatctcaataaacatacagaaaagtttcaataaaatccaacatcccctcatcataaaagccctcaacaaactaggcactgggagaacatacctcaaagtagttaagagccatctataacaaatccacagccaacatcatactagcaggcaaaagctagaagcttttgcttctagtttaataactgaaacaagacaagaatgtccactcttatcactcttatttagcatagtactggatgatgtaaccagagcaactgggcaagagaaagaattataaaagacaccaaaataggaaaagaagtcaaattatcgctcatcactgatgatataattctgtatgtagaaaaccctaaacaatctaccaaaggctcctagaactgataaatggcatcaataaaatttcaagatacaaaataaatgtacaaaaatcaatagtgtttctatataccaacagtattcaaaccaagcgccaaatcaagaatgcaatcccatttacaatagccacaaaaataaaaaaaaatacctaggaatgcatctaactaaggaagtgaaagatagctacaaagagaactatgaaacactgaaagaaatgattacataacacagagaaactgaaaattctatgcttatgaattgaaagaaacaatataattaaaatggccttatcacccaaagtaatctacagattcagtgccattcccatcaaactatcaacgtcatttttcacagaattagaaaaaactattctaaaattcatatggaaccacataaaagcccaaattgccaaaacaatcctaagcaaaaagaacatggctggaggcatcacactatccaatttcaaactatgcaacaaggctacagtaacccaaacagcacagtactggtacaaaaacagacacatagagcaatgaatagaatagagaacccttaaataaagccacaaacctatagtaatctgatcttcaacaaagttgacaaaagtaagcaatggagaaaggactccctattcaataaatgaggctgtattaactggctagctatatgcagaagaaagaacctagaccccaacctatcaccaaattttaaaaattaacccaagagagattaaagacttaaatataggacctaaaactataaaaatcttataagaaccctaggaaatacccttgtgaacatcagacttggcaaataatttatgactcagttttcaaaagtaattgcaataaaaacaaaaattgacaaaaaacctaactaaagagctctgcactgaaaaataaactattaacaaacagaccattgtgacggttaatactaagtgtcaacttgattgaaggtacaaaatattaatcctgggtgtgtctgtgagggtgttgtcaaaggagattaccatttgagtcagtgggctggggaagacgggcccactcttaataaggtgggcaccatctaatcagcttccagcgaatataaagcaggcagaaagacatgaaaaggtgagactggcctagctttccagcctacatctttctcccatgctggatgcttcctgccctgcaacatcagactcccagttattcagttttgggactcagactgactctccttgctcctcagccggcagagggcctattgttggaccttgtgatcgtgtgaattaatacttaataaactcctcactatggatatatatctcctattagttttgtccctctagagaaccctgactaatacagatttctgtaccaggagtggttccagaggaacagaatattaaaaatgaagttctttcgttggttttggggttcctggagttggctgcttaatatgattagaccccaaaacgctaaggattctacttctaacaatatggagaacaccaatagtccttggcataaactgtttagaaagttatgcaaaataaatacatttgacactcctgattcaccgcttgtaagaggcaaggagtttagtgactctatacataatacctttgaccatatgtggagaaccaaggaacataatgaagttggttggttgctcctaagttcattgaacaaagtgatgaaaaaaatgatgaacccagggattctgtctcctggcttcagaagcagatacaaagcctcaaatctgctaagattgccctgagtcagtcttatctcctgcagaggaagagctgaaattgtggaaaaacagacacaagctcttatcatgcaagtggctaacctgcaatgaaagatgcatgcacagcctcgccaggtgtctgctgttaaagtgagggcattgattggaaaagaatgggaccctgatacttggaatggggacatagaggaggaccctgatgaagctggggacaccaagtttgtaaactctgaggaaccttttttgccagaagaaacagcttccccatccccagtggtggcaacatcccctccctgacccatgctgccatcagcctttccacctttgtctcaggagataaaccctgcactgcttgaggcaacagtgatggcctcccgaggcagctgccagggaaaatgatgttgattctcctcaggagccacccccaatactcctttgcttctagacctataatagtctgaagtcccggcgagcccctagaggtaaagttgagagtgtgacccatgaggaggtgcactacacttgaactgtttgagttatctaatttatataaacataaatctggagaacaggcatgggaatggatattaagggtatgggataatggtggaagaaacataaaattggatcaggctgaatttactgatttgggcccactaagtagggagtctatttttaatgttgcagctcggggagttaaaaaaggtcctaacagtttatatgtttggttagttgaaatatgcattaaaaatggcctactatgaggaagatggaaatgcctgatctcccttgggttaacgtagaggaagggatccaaaggcttagggaaattaggatggtggagtggattagacactttagacctactcatcccagccttagagggtcccgaagatatacccttgaccaattctttgcgaaatagatttgtgagggcagcacctgcatctttgaagagccttgtaattgctcttctctgtacatcaaatctaacagcgggaaccacagtcactcaaataccaaatttaaatacaatggaaataactggatcccaaggtggcaggggccaagtggtggtactcaacggtcaaaggcaaagtgggtgtagatactataatggacagcagagacaaaacagcaatcagaatattcttactcgtgtagagctctggcattggctaactaatcatggtgttcctagaagtgaaactgataggaagtctactgtattcctacttaatttttctaaggagaaaacttctaggtcaaatggacaaaagagtaatttaaattataaaaacagacaattatggcccctcaattaatttccagactttagccagtttacagacccagaaccccttgaatgaaggggaggacgggtccccttgaagaaggaccccactatattaccaacagtttatgcggtgaatctttctctcatccttccccaaggagacctccggccttttaccaaggtaactgtgtactggggaaaggaaatgatcagaccttttgggtactagtggacactggctctgagctgatgttgattccaggggactcaaacatcattgtggttctccagttaaagtaggggcttatggaggtcaggtaattaatggagcttcagctcaggtctaacttacattgggtctagtgggtccctggactcatcctgtggtcatttccccagtgtcagaatgcacaattggcatagatgtacttagcagctggcagaacccccacattggctccttgactgggagggtgagggctattatggtgagaaaggtccaatggaagccattagagctgcttctagctagaaaaatagtaaatcaaaaataatatcacatctctggagggactgcagagattagtgccaccatcaaggacttgaaagacgaggggtggtgattcccaccacatccccgttcaactctcccatttggcctttgcagaagtcagacggatcttggagaatgacagtggattatcgtaagcttaaccaagtggtgagtccaattgcagctgctgtaccagatgtggtttcactgcttgagcaaattaacacatctcctggtacctggtatgcagccactgacttagcaaatgcctttttctccattcctgtccataaggcccagcagaagcaatctgacttcagctggcaaagccagcaatatacctttactgtgttacctcaggagtatatcacctctccggctttgtgtcacaatcttattcggagagaccttgatcacttcttgcttctgcaaggtatcacactggtccactacactgatgacattatgctgattacatccagtgagcaagaagtagcaaacccactagacttattggtaagacatttgtgtgccagaggatgggaaataaatccgactaaaattcagggatctcctaacctcagtaaaatttctaggggtccagtggtctggggcctatcaagatattccctctaaggtgaagaataagttgctgcatttggcccctcctacaaccaagaaggaggcacaatgcctactgagcctatttggattttggaggccacacatttctcatttggttgtgttactccagcccatttattgagtgacccaaaaggctgccagttctgagtggagtccagaacaggaaaaggctctgcaacaggtccaggctaacatgcaagctgctctgccacttggactatatgacccagcagatccaatggtgcttgaggtgtcagtagtagacagggatgctgtttggagcctttggcaggtccccataggtgaaccacagcggaggcctctaggattttggagcaaggccctgccatctccaccagataactactctccttttgagagacagctattggcctggtactgggctttggtggaaactgaatgttttgactatgggtcatcaagtcatcatgcgacctgaactgcccatcatgaactgggtgttttctgacccatctagccataaagtgggtcatgcacagcagcattctatcatcaaatggaagtggtatatacatgatcaggctccagcaggtcctgaaggcacaagtaagttacatgaggaagtggctaaaatgtccatgatctccactcctgccatctgccttctcttcctcagtctgtcagtctgtaccgatggcctcatggggagttccctatgatcagttgacagaagaagagaaggctaggacctggttcacagatggttctgcacgatatgcaggcaccacccaaaagtggatagctgaggcactacagcccttttctgggatatccctagaggacggcggtgaagggtaatcttcccagtgggcaaaactttgagcagtgcacctggttgtgcactttgaatggaaggagaaatggccagatgtgtgattatatacggattcatggactgtaaccaacggtttgggtggatggtcagggacttggaagaagcatgattggaaaattggtgacaaagcaatttggggaagaggtatgtggatggatctctctgagtggtcaaaaactgtgaagatatttgtatgccacgtgagtgctcaccaatgggtgacctcagcagaggaggagtttagtaatcaagtggataggatgaaccattctgtggacaccactcagcctctttccccagccacccctgtcatcgccctatgggccaatgaacaaagtggccatggtggcagggatggaggttacgcatgggctcagcaacactggactgagtgtccaatttgccagcagcagacaccaacactaagccctcgatatggcaccatttctcagggtgatcagctagctacctggtggcagttgattatattgggcctcttccatcatggaaagggcagaggtttgttctcaatggaatagacacttactctggatataggtttgcctatcctgcatgcaatgcttctgccaagactactgtccgtggattcacagaatgctttatccaccatcatggtaatccacacagcagtgcctctgacccaggcactcactttatggctaaagtagtgcagcagtgggctgatgttcatggaattcactggtcttaccatgttccccatcattctgaagcagctggattgatagaacagtggaatggccttttgaagtcacaattacaacaccaactaggtgacaatattttgcagggctggggcaaagttctccagaaggctgtgtatgctctgaataagtgtccagtatatggtactgtttctcccatattcaggattaatggatccaggaatcaaggggtggaagtggaagtggcaccactcaccatcacccctagtgatccattagcaaaatttttgcttcctgttcctgagacattacattctgctctcctagaggtcttatttccagaggaagaaacactgccaccaggactcacaacaacgattccattaaactggaagattgccacagggacactctgggctcctcctacctttaagtcaacaagctaagaatggagttacagtgttgactggggtgactgacccagactatcaagatgaaatcagtctattactccacaacgaaggtaaggaagagtatgcatggattacaggagatccgttagggcatctcttagtattaccatgccctgtgattaaagtctatgggaaactataagccctgtgattaaagtcaatgagaaactacaatagcccaatccaggcaggactacaaatggtccagacccctcaggaatgaaggtttgggtcactccaccagggaaaaaaccatgacctgctgaggtgcttgctgaaggccaaggaaatacagaatgggtagtagaagaaggtagtcatcataccagctacgaccacatgaccagtggcagaaatgaggactgcaactgtcatgaatatttcctcctccttttgttaaaaacatgattgtgcgtgtatacacttgtactaatatctttatttccttttcttttatcatgttacgtaagatttactgacttcatatcggcattgaagtattgttcactttatggaatagtatttgggttggagattggtgcatctcctgttgtacgaaggatagctgtattatgttaggcgtaattatgactttattattgtctttatttgaacattgcctatgatcgcaggagacgtgtatgggttcaagttgacaaggggtggacttgtgatggtttatactgagtgtcaacttgattggattggaggatgcagagtattaatcctgggtgtgtctgtgagggtgctgccaaaggagattaacatttgagttagtaggctggggaaggcagacccacccttaagctggtgggcaccatctaatcagcttccagcaaatataatacaggcagaaaaacgtgaaaaggtgagactggcctagcctcccagcctacatctttctcccatgctggatgcttcctgccctggaacatgggactccaggttcttcagttttgggactcagactggctcttctttctcctcagcttgcagacagcctactgtgggaacttgtgattgtgtaagttaatactttaagtaaaatcctctttatatatgtgtgtgtgtgtgtgtgtgtgtgtgtgtacacacacaccctattagttctgtccctctagagacccctgaaacaaccaccaagaaagtgggagacaatatttgcaaactatgcatccaaaaaaggtctaataaccagaatctataaagaacttaaacaaaccaacaagcgaaaaacaaataaccacattaaaagtgggcaaatgacatgaacagaaaaactacctattgagtactatgctaacttcctactgagtactatgctcactacctgggtgatgggatcaattgtcaaacttcagcatcatgcaacagacccatgtaaaacacctgcacatgtaccccccccacgaatctaaaataaaagttaaaatttaaaaatagtttccagcaaaactttattctttgatgctccacaaacgtaatatagatataaaaagtttttgcttcaattttaaaaatttgagccactgcattaagatatgtttaagtcatcagttgatactgacatgacaaaccatcagataagtgtgctgatgttttggagaggcatcaatcaaccagggagactgaaacttcactgatattttcaaaccaaacaatactatgaaaattcattcaaaatatatattatcaaatctccttcaaacctttcaataacttgacattgcttgcagcatgaaatcctcaatctttatacatgtcccaaaaggccttgcatgacagatccttgaccacttctccatcctcctcctctacatgggagcctttccatcacttccttcctctcccttctatttaatcaactctagtcattctttgtgcctctgcttaaactctggtgtctcagggaaccctttccaaacccccagaggagatcacatactctaactacatgcactcattgtacgttgccctttccttttagcacttgtataactgatttcagttatatttatggtctaattggttgcttactatttttgccccatttagattcaaagctccattatagctgaatctgtgtctaatgcttagcaagcgttacgcacatactagatatttggtaaaactgaggaaaataaattaatttgtaaacccaatgagaccaaaactgagctgtgtgcttttctatattccagttcagccatcagcttcttatgtgacaatctaaatgactaatgataatttattattgaggggaaaaaaggaaatcatcaataatggagcattcataaatgtagactaaatgttcattatcctttgaacaaaaacagaagttggggcaaaaccttcaacaacaaaaaatttccagatgcccttaaaatatttttctatttctttcctattaaaaaacagtatttacaagaacaatgtaaatgtacctataaatcccacatccaaaacaaccacaatcacatattttattagcatttatgtgttgattattatctcacagaaaagaattatatatagttctgcaactcaccatactttatttaagctatcaattaaatacctaattttgaatatttatgctctttctacttttcctattacaatcaatgtagaacaccaacaggctaatatatgaaatgggaattaaaagacaaaacctttaaaccatcttcttgcattcttaaaataagaaaaataatttcaagatttataatctgtagcaaaactacctcatagcataccacatcaaaattactggtacaaaaatgaacaacaacaatttaaaaacccaaaaacttttttaaaaaaaggagtaacaagcatattcattgtatccaaactgttgtttgaattgaactgtcatgctagccaaccggctttacactaacctctgctttccgtgaaactggcttctaattggaattgtttgtgccagctcctcccgtctcggggctctgggagaaagtcaatcacaggagctctgctttcctgcctttgctcatgttgctcctcagcccatgacagcaccacatttattctcccatgtttattctccataaggagaatagatagattctccttatctattgctagataagcgcatatctagtatgtgcgtaacgcttgctaagcattagacacagattcagctataacggagctttgaatctaaatggggcaaaaatagtaagcaactaattagaccataattattgaaatcagttatacaagtgctaaaaggaaagggcaatgtacaataagtgcatgtagttagagtatgtgatctcctctgggggtttggaaagggttccctgagacactagaatttaagctgtgcctggagctactagtagttcccaaactagcaagcatcagaattacctggggagctagccaaaacacagacttccaggctcctccaccagaggttctgatttagcaagtctggggtgagacccgacccatgacatttctaactagttcccaggtgatgttcatgttactggtctggggatcacactagtatcagcggcctagttcaaccactccaagaaaacactttccagttttcatgcctcttcatgacttcaagtctcacagtcttgtctttataaatctacaccatcccatttaacacttgcttacacaccggagtcactgctctctaaaggcttcatatattctttcaccacaaaataagaagtttctcaaggtcagtagcacaagaaatactactctggtgacacaaattactcaggatacagcagacagagagcatggactcagtatctcagcccagtcagaatggctaaaactaaaccatgtggattcttcaatctcaagcaaatttaatttattttaaaattcatacttgcttagcaagtacattatactggattttttcaaatatatagtcacaaaatatattaaaataaccttattctttgatggtgtgtttatctgacttcccctaaatgaaagtgatgttcttgagagaagcaagtttatacagtaatatgtcacttaatggtgagatacagtctgagaaacgcattgttgtaattcactgttgtgagaacatcatagagtgacttgcacaaacctagatggtatagcctacttcacctaggctataaggtggtatagtctatctctcccaggctccaaacctgtacagcatgtgactgtactgaatactgtaggtagctataatacaatggtaagtatctgtgtgtctaaacacagaaaaggcacagaaaagatatggcattacagtcttatgggaccaccttccttcgtagaggtggactatatttcttgttctccaattatacattcatagtggatactcaataaatacttgctcattggcatactaaatgactagccagaaaatgaatagtactggcacattccaggtacaaccctctcaagtggatgtttctagaaataattattcaaccttaggtcaaataatttagatgactgttaaatcttcaggaagcttttaagaagcagattctttttaactgggaaatggttttgccacttatatttcatagggttttaatttgtttttaaaaatcacttcagaaatcaatatagtttgcaacaaagctattatatttatttgaattagtttcataatctctaacattattcgtgataatatgacttaatctataaaattatcaaaatccaaataaatttggttggactgctgtggatccttggtcaaaaggcataagtgatttccctaacctggccaaatactctcagaaagaatatatcagatgagaataggcaattttatggtggtatgctcatagactaagaaaaaagaaagaagactcaaacaaaaccagatatgacaaaggagacattttaacagataccacagaaatttaaaggatcattagagactgctatgaacaaagatacaccaataagttggaaagtctaaaagaaacagaaaaattcctagacacacataacctgacacgactgtaccaggaagaaatagaaaacctgaagagactgataacaagtaacaagatagatgcaataataaaaagtcttccatcaaaaaaaaaaaaaaaagtccaggacctgacagtttcattgatgaatttcccaaaatacttaaagaagaaccaccccaattctattcaaagtatttcaaaacactgaggaggagaaaatactttcaaactcattctatgaggccagcattatcctgattccaaaaccagacaaaaacacaacagcaaaaagaaaattacaggccagtatcactaatgaacatgatgaaaaaatcttcaacaaaatactaaaaaactaaattctgtaatacattaaaaatccattcatcataattaagcgggattcatatctaaacatgtaaagatggtttcaacatatgcaaatcaataaatatgatatatcacattaatagaatgagacagaaagcatatgatcatttgaatagatgctgaaaaagcattcaataaaattcaacattcctttatgataaaaacgctcagcaaactggctatagaagaaacatacctcaaaacaataaaggccatatacaacaaacctatagctagcatgacactgaacagggaaaaactgaagcctttcctgtaagatctaacaagacaaagatgcctgctttcacaacttattcaatatagtactggaagtcccagccagagcaattacacaagagaaagaaataaagagtatctaattggaaaggaagaagtcaagctgtcctggttttcagatgacacgatcttgtatttcaaaaaacataaagactttagcaaacaagctatttgaactgatacacgaattcagtaaagttgcaggatacaaaatcaacatatgataatctgtagcatttctatatgtcgaaagcaaacaatctaaaaatgaaatcgagaaagcaatcccatttacaatacctacaaaagaaaccccgggaatctgccttttaaaatatatatatatatatatgatacatgtgtagttttgttacacagatacactgcacagtggtgaggtctgggattttagtgtagccatcgcctaaatactgtaacctgtacccattaagtaaattctaattccttactctcctcccaatcttccacccttccacatatgcaagatctattattccactctctatgtccatgtgtacatattatttaactcctacttataagtgagaacatacaatatgtgatttccatttctgagttatttcatttaagataatggtttctagttccatccatgttgctgcaaaagacatgatttcattattttccatggctgagtagtattctatggggtgtgtgtgtgcgcgtgtgtgtgtgtgtgtgtacacacacattttctttgtccaatcatctgttgataagcacttagattggttccatatttttgctattgtgaatagtgctgcaataaacatacaagcacaggtatcttttctatataatgatttattttcctaggaataaacttaagcaaagaagtgaaagatacctacaattaaaactataaaacattgatgaaaaaaactgaaagcaaaaaaatatggaattatgttcatggattggaagaataatcatgtactattaaaatgtccatactacccaaagcaatctacagattcaatgcaatctctctcaaaataacattgttcacagaaatagacaaaacaaccttaaaattcatatagaaacaacaaaagacccataaaagtcaaagcaattctgagcaaaaggaacaaagctggtgacatcacattacctggtttcaaattacaatataaacctatagtaaccaaaacagcatggtactagcatataaacagacatatagaccaagagaacagaacacagatggcagaaataaatccatattttttagtcaactcatttttgacaaggacgccaagaacatacaatgaggaaaggacagtcaagtcttctggtgctgggaaaactggatattcatatgcagaagaatgataaagtacacccctatctctcaccttatacataaatcaaaatggattaaatacttaaacataagacctaaaactaagaagctaccagaaaaaaacattggggaaatgcaacagggcattggtctggacaaagatttttttgagtaagacctcaaaagcacaggcaaccaaagcaaaaactgacatgtgatcacctcaagcttaaaaacttctgcaagcaaacaaagtgaagagacaacctacagaataggagaaaatatctgctaactattcaactgacaaaaaattaataacctgaacaggaataaggaactcaaacagatcaatagtaaaaaaaaaaaaatctgagcaaaaaattagcaaaagatctgaataggtatttctcaagaggagaaagacatacaaatacccaacaggtatatgaaaaaatgctcaatatcactaatcatcaggaaaatgcaaatcaaaaccacagtgagatatcatcttacctcagttaaaatgactgttgtcaaaaaagacagaaaacaacaaatgctggcgaagaaaggggaatgctcgtacgctattggtaggaatgtaaattactacagccattatggaaaacagtatggaggctcctcaaaaaactaaaaacagagctaccataaaatgcagtggtactgctaactatatatctcaaagaaaggaaatcagcatatcaaagatatatctgtcctcccatgtttattgcagcactattcatagtagccgaaatatgtaatcaacctaagcacccattaatgggtgaatggataaagaaaatgtgatatatacaaaacgaaatattattcagccatgaaaaatacaaccctatcatttgcagcaacatggatggaactagagtccattaagtgaaataagccaagcacagaaagacaaaaattgcatgttcttactcatatgtgagaggctagaaaagggatctcacgaaggaagagagtagattggtagttaccagaggccgggaacaccagtgagaagaaatggttaagagtggttggttaacaggtacaaaattacagttatatagaaggaataagatctagtatttggtagcacaatagggggaccaatcattaaacctgaatagtagatttgggatattctcaacacaaagaaatgataaatgttcgcagtagtggatatctcaattacccagatttgattattacattgtatgcttgtatcaaatatcacctgaacctcataaatatgtataattactaagtattcataataatatattcataattttaaattttaaaatatgtaaataccaaagatccatctttatgataatgtgaacacacaattaacagaaataatagaatatgccaaataactctttatagatgaattcgtatgaactttatctcctttctagtcaccagatggtggactcatgtttatttataattcagatcaagacattcaacacattttctggtttccattaccaaaaaatataaataaaatatatgaaaattctgtgtaagaatgtaatttaacatttgagacaaaaaaattgaaggaaaaagagaagagtgtccaaaattaggtttcatgcaaaccatttcaaaaacgtgtttttttcttatcatgaaaatatactaatagttaatatattatttattagtatcccacttactaaaccttccaacaccgaatgttttggcaaagtaatttatgccccattaatttaatatccttcttccgtatatatactagcacagaaaccatccgttacatattaaaccatacaaatgcaatttaatctgaattttaggttatcaaatagtaggtttagggggcataatttaaatcctacttattctaagaataaaatatctaactgctttattcgtatgaaaattaaatcccacttctagaatcactgaaaggagaaaaacatatactaactacattatttgagaaaaaagaaaacttcaattatttgttgaaaaaaatttaaggtatcaggcagcacaaatattttcattactaattatttgaatttataggtacaatgatagtgatacggtcggctattgaatattttagacacgatcatagaaataaaattactgcccacaaaaggtggcattctacttacaattttcaaatgattgtgggttcatcaatcaccctctggaatactaagtaactcgcctttaagaaattaatgttacaattacatttgaggtttttaagaaattaatccacttattttaaatattattctactacaaaaagatgccaaatatagtcatgctaccattcacttcttcatgcaccctttctaataccaccgacactgtcaactcacaattttttacattaggggccaaaaggagacactgctgattgtcaaggtaagtcgtgattcttcctacttataactgaaatactggaacggcattagtggtgggaaattgttttccattttagaatattcttataagaaatgcaaaacaatggaccttcattatatcctaatgtttatttaataatatatactttgtacaaatacagacgtgtaaatgttaaatcatttagtaatctgagtcttgaagggtaccagctggaggaaatttactgtcaaatttactttgcataaaaatataacatttagtgggcaacatatgcctagataattttctttattttcctacattttttcaaaatgaatgtatagtcgtttgatgaaacctgtttaaaactctgcttcgaagctatattttcttctgaggatgtatcggctttaatgcttcctgaggaagtttttatatattccctaaataagtacaacaggttataaaatgaataaatgcaatctctaatttccatatatcactgaaaaaatggtggtttggaatttaggttcagagatcaacttttaaaaagcaattttcctctcaactgtagatagaattttatgtatctgaaatgaaaatgctatgaaagcaataaaattaaactgaaaataagagttagaaaaaaagactctggaatttagatctttgaggagttgtcatgttatatacatttcccaaaacctccttctacctgtcaaaacaaaatctcgtcgtaatcgcgcctctttctctgtaagactttccctgacagggaaactaccagcttggactctgcttaaacccactgccagactaactagaagaaaggaataaattacaactccttccttctatttgtagactgagaaccctttaacaatttaataatcccagcacctgaacagaacttgacacacagtttgctgaatgaatgaaaacacaaggaacctgtgggaattaaaatatgtatcggctgggagcagtgccgcatggctgcaagcccagcgctccgggaggctggggtgggggatcacttgaggtcaggattgggagaccaagctggccgacacgttgaaactctgtctctaataaaaaaaaaaatacaaatagtagccgggcgtggtggtgcgcacctgtaatcccagctactctggaggctgaggcaggagaatcacttgaaccttgaggcggaggttgcagtgagccgagagcacaccactgcactccagcctgggcaacagagcaacactttgctcaaaaatcaatcaatcaattatataatatcttccctcaagcaagaggctattaaatgagtatgagggacagaagcataaaaatagctctgtgtccccatagtatgagaagcaaatgtagcgaccctcaggctatttcacttggaggtttagtatttaaccctccctaatttattcattcattcgaaaatgtgaggaatacaaaatttactatgatgcacgcagttcatgccttcaaattgatctcatagcgagcgtctcatgattctatcgagattcagatgcctgacccctggtgatcctttagcttccctttgaaagtttagccaaatataaatccttttgaaacaaaataaaaattctgctgcaatactcaaatcaaatacggtcagcgttcacactgcttacaggtgtttttttcttttattattatttttgacataataattgtacatatttatggggtacagtgtgttacacggttttatttcattttcttttttctaaatgacaaaaaatgaaataatttagataggcttgtctcattttcaacaagctattctccaatatcttctatctgccacagtttctgttcctggttccactcatggaaatgaaaacactccctgaaaatcctctccacaaaaattttcttcctcaaaaagttttcggtgaagcaacgtggaaggagaataaggcatacttgagaacgggactttctttttttgtttgtttggttgctctgctgcccaggctggagtgcagtggtgcgatctctgctcactacaacccacacctcccaggttcacgcgattattgtgcctcagcctcccaagtagctgggattacaggcatgcgccactatgcctagctaatttttgtatttttagtagagtcagggtttcaccaggttagccaggctggtctcgaactcttgacctcaagggatcttcccacctcggcctcccaaagtgttgggattataggcataagtcaccacgcccagagaacaggacattttctaaagtaacaggaagaaaggaaagaagggaggaaagaatgaagggaggaagcctggtttttatataggcctcaagggccatgctacagaatttcactgaacatgaagcgatatatgatgagatacattcttttgataaacactctcagaagacaggctgaagggggtcttactaggctgcacagtggaatgtaaggttcctttttatatacttccagtgcttgtatccctgtttactactgatgcattctgctaagtggctctatgtctattcccacaactagatggtaaactccaagtcacatctcactcagccgctttccactgtccctagccctctgcaaggtcaaataaaaaacatctccttataagaaaaaaaaaaagttaagtgaggaggagaataactgagtagagtttcagttacacactgctggtcttaacaattatttaactcttctgtacatgtgttcaataaagtattatttgattaatatagaaaacaaagatttgggaggtaggaaatgacacactgacaatgtttatgaaaattcaagagttagtttttatggtagcactacaataggttctaggacctgtactcaatttcatatcccacaaagaccatatattcttacactacactattatccctcattatatagcaagctgaaatttgcatctttttttatcaagtgcttaagcaaagctcagccacacttttgaaagtgtcaaacatttaaactgttttcaaatgtttgaggcttataaaaactaaattatgctatgtcaagctttctttaaggttagtcttgatattaaatgccaagattgagaagacaatgcctgtttctgatttattatttctcttctcccctccctctcaatccacacttacaggcatacacatacaaacacattcacatacacttactttaaaaactacttcatatttcagcacaaaagccctcatttaaaaaacattaccactataaaaaatgcaaaacaaaatttcagaaactttaaaaattagtgagaaaaattacctatacttctaacaccataacattttaataacaattatacatttttattcattgctattagacattttagaactttaagataacacctttttacactaataaagtttcccccaaatagtatctttgtgtttttaatataaaagttatacaacaaacctcctagttctgtacatgtatcccagagcttaaagtataatttaaaaaaagttgaacagtcaaaaacacatataaaattgtcacaataaaaacaatattcacagaaataagtttagccaaatataaatccatttgaaacaaaataaaaattatgcaatattcaaatcaaacaatccaatatattaatatacattcagtttgaggaaaaaattattttgcttcccatcccctttgagcctctagttctttattcgtgaatataactgcttcttaaacagtctccattaaaaatacacgtgtttcagagactaagagaacaacatgcaaagagactcctactgtagaaagctactttgcagaaaatttaaaccacgatgtgcttaaaatgccaggatctcaaaagttaaaacagtggttctgcactccttttctcatttcatgagtgtttaggtcaaaaagatgtccttgttcttttttttttttttttttttttttttgagacagtcttgctctgttgcccaggctggagtgcagtggcgcgatctcggctcactgcaagctccgcctcccgggttcacgccattctcctgcctcagcctcctgagtagctgggactacaggtgcccaccaccatgcccggctaattttttgtatttttagtagagatggggtttcactgtgttagctaggatggtctcgatctcctgacctcgtgatccgcccgcctcagcctcccaaagtgctgggattacaggcgtgagccactgcgcccagccaatatacttgttcttttactgaaagtttactgacaacaaatcttctagagtctgagtgtgaatgaaagtcaaatgccaagtctacagtgctttcccaatataaaaattgtttttatattggcttgtttttgtaaaggatttctttttgtaatagacttatctttgtaaaatatagtatctttgaaatacatactatgaataatgtttatctaatcactaaaaataatccttaaataaaatcaattataatactgacttctgcatttttcaatatggttgtaacttaatcaactgaattctcaagatttgccaaatttttatttttaattagtcacggatctttcttttgtatttatttcttctctaacttactttatctttttaaatggaataactctgatagaattacagtgttaatatttgtctactttatatttcacactctagaatatattaaatgcttagtcttttgccgtaagatagaaaaagctggtttaaaatgagatccacaagagaccttaccttctgatttgttgttcttcctcttcagccatttctctactgtctctgcactaacactttcagatacaaattcatctaatacctgggggtgaagagaaagatatgccttcactttttcatctgtcaaacctgtaaaagaattgaaaagaataaaattcacctatacaacatcctcatatcaatgaaaggtatagtatcacaacacattatgctaagacccagcaacctctcatctaacggagagagggctggaaagagcgggaaggggaagctactgcttagtgggtacagagtttctactgggagtgacagcaaagttttggaactagacaggtgaatactgcccaacattgggaatatacgtaatgccactaaattgtacgcttaaaacagcatttaaaatggtaaaaaaacaccatttttcatatatacgtgtgtgtgtgtgtgtgtgtatgaccacaataaaaaagaatgcagttagtttagcaattttaaactacagatattacatcatgttacatagctgtttctagcaataaatttcagagttacatatgaaccaatgccaagaaccaatgctgtacattaaggcttacagagtacttattttttcggtatatagttaccacagatttagtggtcaaagcaagtgaaactctagcaagagtagtaaacaggaaaatgtagcactgaaacattataggtgctacaaattgtttaataaataaatgaatacattattatcttttattgccttacaacacaaatccttcctttttctcaaagtcattaaacccagtggtataactaatgttcagttcagaataatcttgacatttattcgttaatattctgtgtatgtagtcagtttcactgaaatacttttcatagtccaatgataagtactgaatatacataagatttgcaaacaaagtattttcacatgttttcatatctcacatataaagtatatgttttcaatttggtgctttgtgttggtatgccatttcattaaacaaccccaaacacaaacaggctttgaataattatccttcagtgacgggaattatttttactactgtatcttttctgtgaattatttgaataaattaccctttttagggatggttaggttaaaaaaaaaaaaaaagcaatgaaaaactgcactctgagaaaaaaaagaaggaaaggaagcatatctttatgactccagagagtaggctgtatgttttcccaaacagacaaagcagagaattcatatgtgttaattaattctgctgggaactaaagtcacaactgttgggattctacaacagaatggtataactgaaaaggaaaatgacttctttcaatgaaattggtagttaaatagtcaatttaaacacacacacacacacacacatatacacacacaaatagagttgtataagacaaatgaaaataagatctctggctatattcaccctgcaaaagagccccagtggtgtaaaattcagtgtgagaaattctataaaatgctaaagataattggctcaataaagtaagtaagtgctctcctggcacagcaaattatagtccctaaaaacaaaaggtgcaggatactacagtaagctgatagcatacttgacctttgagaagacagataatgcaaatttcatgctctctttaggtcctccatattcaatattgattccttcttaaaatttctttctgccactcccatgacacaaggctatagaattcttatcctaactttctaactgctcttgaattctactttctcttcaacaatccataatgacgacaccaaaatctaaatcaggaatcttaacatatttttaatctccagtctagctactttcccatcacctcaagctccatcttaagtcaaaactatatgagttatctccttctcacttcttcccaaagagattttaactcttggttttcctttttgtgttactattactctacattttcccagaaactgaggctgaaaaatatagtaataactgactcattccgacttgtcatctcatttcatcttagtgcattaccatacaagtcatatttgccaaattacatgagataaaagatatgcatccaaaataaacaaaaaaacactcgttaaactcaacaataagaaaacaatcaacccaactgaaaaatgggccaaaggccacttcagtaaagaagatatagatatggcaataaacatttaaaaagatgctcatttgttaatcatgaattgaagttaaaacaaaaatgagattctattacacacctattagaatggctaaaattaaaaaaaaactgacagtaccaattgttggcatggatgcaaagcaacaaaaattatcatttaatcatgataaggatgcaaaatgctacagtgactttgaaagactgtttggcagtttcttacaaagctaaatagagtctttctgtatgacccaaaaatctcactagtaagcatttacccaatggatatgaagacttatgtccacacaaaaacctccatgtgagtgtttttggcagctttactcataatcacccaaatctggaagcaatcaagatgtccttcaatacacaaatggataaacaaactgtgatacatccatacgactaaatatttcacactaaaaagaaacgggctaacaagccatgaagtaacatggatgagtcttaaatgcatattgctatgagaagaaaagccagtctaaaaaggatacatattacacaattccaactatacaacactggagaaaaggcataagctgcagaggtagtaaaaagatcagtaactaccaggagctcaaggggaaagggcaaattatgaataggtaaagtacaggggatcttttaggatgatgaaactattctgtaagacactataacgatgaatacatgacactatgaatttgccaaaaatctgtagaactttatagcacaaagagtaaactatcacgtatgtaaatttttaaaaactcaattacaaggtcaggggatctcaggatggaaagcataatgcaacacaagaatctaaatgtattacacatgtaatataaaacgtataaaacaacctccctgaagcgggtggcagaggataaggtgctaacctatagaactttgaaaataagtggggtctgtgagactagacacaaaataaactgtacataagcaccacactctagttgataaagttgttgtcccaagagggtacagtttgacactggtcaattaaacaaatgagtggtagatggtggggacaagatttctcaatggtagagtgagatgttacagataaacaaaaggaagagttcagaatgatccatgtggtaatgaattaaagttggagatatcagtgaactcatgtatgacaatacaaataaaaatggttacatataggaatattggtagataacgtatatctcataaatacacacaagtctcactttgctatgttagctgagagggcctagaagcaacaatatcccggtataattgcatacatacagcacctagagcttggttgctagtatcagtgtacaataaaaggaaccaagactccatgaagaaacagctaaatttaggataagaacagaaaatacataagcttggagtagctgatgatttaaaatttgctaccagtaaatcgcacagacagacaaatacagacaactattccaaagcaattgtgtatatttgaacgagtatattttaaaatatatcattcctgctaataaactacaacctttcatctacataacattttgccagagtggaaacagataaaactaattaaactgactttcattttcatttcatttttcagcatctggcaggagtactcatgagcaggggcaggttaaaagtaataaatgatagaagagaagcacacgggtattgatagactgaatgatcagggtaagttatgaagagctgatgaatttcattaattttcgcagtgcaatctgcaaatgcccatggaaactgtcatgaaggattacagtctaaacaaaaccaaactgaaaagcagagtggtacatgtagtggttagatttaacactggtacctgaagatacacaacaaaaggcataataaagactgatgaatattttagtaaagataattgcttctatggttaatgattcagccagcaatctgaggggtagataagaattaactttcttttcttgctgagtaactcttttaaagaaatggataaacaccacagcagtatctctacttcaacattttgatattgagccatagagcagtgatgaaaaggattgacacctttgagtttccacgcataataatgcaaaacatcagtaaaaataaataacatcaacaatgatacatttttatatctttgtttttaaatacagtagcattgaggctacttttcttctgtcttcacagaaatcttacaagcttctcataaagtaacacattactatgctacccttttggtttttgctttctgcaagccacaaattcaactttctttttcagatgaagattttgcctattcacgcatatgtataaatatacatttaaaacttttatcaaatcacaccaaaaaatataatggccctaggtactcaacagccagcttcaaccatcacaattcatagccaatattttccatctctaccacctactctcctctcatataatttcaaagcaaatccaagaaattattttaatatattagtacatttcaatatgtatctccaaaagataaaactattctaaccataaatactactatcacaaataaagagaaattattatttttaattccatcaaaaatatccaggctttaaatctcttttttttttttttttttttttttttactgcttgttggtctgcactaggacacaagtaaattccacatgttgcagtagctcggaatttcattttttaaattatatttaggtctctttggtccaataatattccctccatctcttactttcccccattataacttatttctgaataaaataggtttttagtcctatggtttacttcaatctggatttttctgactttatccctgtggggtttagcatgttcctccgctctctgcatttcttgaaaattgacattagtcctcaaggcctgaagagatgtaggttccatttggggtacaatctggtcagtgttactgcacacttctgtcagaagttttttgtgatgtcagcagcattagtggctcttgagtgactaattcagtagggcttgacaatggtgattttcctcattctatcatgccttcttcatttattagctgaaataatatgaagagaaacttagcttcatctactatgtggttgtccggtgggacagttcatgtagatcaaacaagacaaatgcttaatttgttcccctttgttcaccagttttgaaaataatgagtggatgcagtaacattctcccatgggtaaacaactaaaaaataacagtattactacgaaaccatatatttgaataaatttgatctgtttcttccattgtaactattatccttaactggtgctcaaattgtcccatcttgcagccaggtggagcagcctcttcaagcaggttcagtcattctgacaagaacctagtcgatctcaacagcttccatcctctgctagtatgagatatcttaggttccttttgttcattttctgccccagacatagagtcgtactctttttctcaggatctctagttcctttcagtaaatagaagtatttcaatttcaggaaaatggaactagattacataatcattcattgttctatcacacaacaaacatataaggtgggtttctttatcctttaagatatataaccaagacaaatatataagttattacggttttttctgtttttgtttttgtttgagacagagtctctctgtgtcacccaggctggagtgcagtggcgtgatctcggctcactgcaagctccgcctcctgggtttaagggagtctcctgcctcagcctcccgattagctgggactacaggtacctgccaccacgcccggccaattttttgtatttttagtagagacggggtttcaccgtcttagccgggatggtctcgatctcctgacctcatgatccacccaccttggcctcccgaagtgctgggatcacagacgtgagccaccatgcgcggctgcattattatgttttaaagtcacttgaaatattcaactctctgtggctatgtcaccaactgaatgcaaattaggttcatttctgatatatctttaaatgtgtctttatgacaatatattatcctaataagccaaagcctttattatttctgaagtctcatcaccttaatatctataaaaattatttattttaaaagtcagtttcaaatcggaggctaaagaattattgttttactcattctaagaaagaatgttaaattagtaatcataggtactaaaggatctattgtaagaattaggaaaaagcatttttcagtattaattctaccattttaattgtggagaaagatcccaattttgtgtctgtattaattttaaaaaccagtcaaaagcatatggcaagtatccagtatatccttcctcctctcccattatgcctctcgcccacgacacctgagttctgactcctacaattccacatcacagtgcttttacatgccctaaaacacgtcttcctgaccttaaaagaattattttctgccacattaggtatcttatctcaagccctctgtccttcctcaatcacagaaaagggaaaatacactaaatttccattatctcacagtaactaaactcagctaggttaggaaaaacctttaaaaaaattctaaggtatacgtaaccaataatctcttatttattgtaataattatctcaattttgtaatttcttctgtgtttagcccagatacaaacaataagtaaaatcattttcagcttcttacagtgtcagtccaactgtaagataaatttgggggagaataccaccatttcatgctattaattactgaactataatagtccagttatcaaagaacagcttgaactgtgagggggctgtaatgcatgtcatatgaggaatgggtgaatgagtacaaatgtttagtttgaagaacacaagattattgatgggcattgctgtttaatctgaatgttattaagtataacaggttaagatatttttggtttattcatatcttgttttgttttttccatccataaacccagggggcaaaactagaattaataattgaggaagtcagataacaattcaacttcaggcagaatgtttaggaaacaaggcttctgtaactggaatgggctacatgagcagacagtgcatcctcccacaattgaaatgttcaatgaaaggaaaatccaataactttacagacctttcacagcgtgagatggtttcatattttccaagcaccaagagataagtatatatacacatttacgttaaaaaatcttattagtttcaaaagacaattccaaaacatataccagaagtagtaaattttctttatatttctgtataaataattgtagcaacttagtaacaaaatctgtcaagttaaaagaaaacgtatcttgtgtcatactaagcagtgttataccaccacactgctcatcagcaatgttcttattaacctgtgtgtgtgttctccccaactgcatacaattgttctaggctgtacacatatgcacctatgtaaaaccttcctttatttgtccaaaagcaaatgaaggtcagcagatgtataactttaaaatcaggtaagtttgctttcagaatcccaaaattcaacttcatacacctccttctctgtatttacctctcatgcatttatactacaactgtttcacctccttccccaccaaaaagataaaacagctaatagcatttgttaataactgttggcctactttgaatgctctctgcatataagatactatgttatacacgttacacatactagcccaggtaagcctcagagaactaagtatgtggcacacagaaaatgttcaaaatatttacttaataaatgaattataatccccaaaatatataacaggaaaatgaagcaaagagaagttaaataattgtagcagttttctattggccacagaagcaataattagggttggaatgaagatataagcccaggatgtcagctcttaaggccagactgccttgtgtttctttacacttcctcccgtctgaggttattacactttaacaggagtgttattggtcagggctagctccaatttggaattaaaatttacacgtttttacctcaaattatcaattgaaaaatctgactgctaatctcaggctttgataaagaggtggaaagaaatctttgtagcagaagccccctggagacccaagactaatcggaaaataagtctaactggaggatggaaagggagcagtcagtagcaatgatgccacttagccctatgcttcccccatttcagtcctccagcatgccaagcccttcctttcctcacctcatccatggtcttcgctgctatctgccctcaatcccctcctctcttacggctcagtgagacatttagccaatttaaaggcagtttcactggagctaccttcactagccacacactctccactcactgcactatactctcattgtaccctcctcctcctacacttcaagacagtcatcaaaagctgaaatttcttacttattagtaggaatttattagacttcagcctcttcagctagactataaactccatgatctgtctcattctctacatagcacagtgcctggctctgggcagaaaaggggttaacacagcagacctgacagtgctcttctacttagaaaggctgcttgcaaggtcagcccttggctggcatcaaggactttggctctgggggtgttcccagtcaacagttaactaaagaccaggccactgtgcctagactgtttgtgcatttgtgcaaacaatatgggttcatgctgaacacctgcgttccttctgagagtctgaaaagtttagaacatgccaggcagagggtgtgtacctgaccaacccccaataagaaaactgggaattgagtctctaacatgcttccctggtaggtaacactagacaaacactgttagacgtcactgctggaggaatgaaggtatcctcggaagcctgtgccaagtctctcctggatttcacccagtgcacctcttccctttgcggattgtgctttgtatccttcggctctcatcaagcatagccttgagtacaactacatgcccagtcctgtgagtacttccagcaaatcaccaaactgaggggtaattctgaggaccctaaacacacagactatcatcaagtgaattaattgcttagtaatcctttgtcttgtatgatttcacagaagactaatagggagtgctataggtttgtttgctgaaaacggcccagttcacaagatcacagacggacccaccaggaatcccaaatcctacagcaagtacctgagcaaaggacccctccactcatagcctgctgtacctacttaaattcccattcctgcccaaagcctacatgagattcttttctttctcttacttctatcttcactttccttttttcatctaaagagtttaaatatgtaatatgtcaccctttacataaaacttcatgaacataacaatttatatagcagttctttctaaccacttactgattaagagatagataggctctaaatttctttttttggggaggaggggggtgtcttttttttaaaggcaaagtcatttatatggaaatgaatggaggttatccaggtgacagacgtaaacagttttcactatcattaaaataacttgaaagttttggtagaaacaaagagatgtttctttagattttggttaactcgattgactagtactgataccatttttaaccaagaaggaaaaacaggaagcaaactaaaaacaaatgccttataataactatccttgtccccaaatatatcacctaaaatcatttctttccatccaagtacattccactgaaagagaattggtctatgacctagaaagcagtcatttaatgagccttggtttaatatactgccagtattctgacctacataattgattacttatttcacgtgaattaacagcctaaggggtgccttagctgcagagaagatattgtttcccacattcacaatttgcatttatcagaagataaattccatactgctgtatttctaaaccaaagtgaaattaattacttgctttctctcctaagaacataaatgaaagtttcttttaactgagaaagtcaactacaaacttgagctgctcaaaatgataacataaagatgaaaaacattttttgatagaactattaagagtaagcttaaacccaccaaaatttaccctttctgtgactcagaaaaccaatctccaaagtgaagtctcaaatggagacaagacatgcaggcacaggttatgttatataaaggatttaatgctccatctctttagcataaatataattccagatctacagtaactcggtgggggactgggggttctgaggcaccagacgctcaaatataggctattttccttaagaaagtcacttaagtgtcttgagcaatacctcataagcataggcaaccaaagtaaacatggacaaatggaatcacatcaagttaaaaagcttctgcccagtcaaggatacaatcaacaaagtgaagagacaatccatggactgggagaaaatatttgcaaactatcactctgacaagggatgaataaccagaatatataaagagctcaaacaactctacaggaaaaaaacctaataatccaatcaaacaatggccaaaagatttaaatagacatttctcaaaagaagacatacaaatggcaaacaggaatatgaaaagatgctcaaaattactgatcatcagagaaatgcaaatcaaagctacaatgagatatcatctcaccccagttaaaatgacatatattcaaaagacaagcaatagcaaatactggcgaggatgtagagaaaagggaacctttgtacgctgtggtatgaatataaattagtacaacccctatggagaaaagtttggaggtccctcaaaaaactaaaaattgagctaccatatgatccagcaatcccactgctgggtatatacccaaaagaaaggaaatcagtatatcgatgagatacctgaactcctctgtttgttgcagcattgtttacaataatagctaagatttggaagcaacctaagtatccatcaacagatgaatggataaagaaaatgtggtatatatacacaatggagtactattcagccataaaaaggaaggagatattgtcttttgcaacaacatggatggaactggagatcattatgttaagtaaaataagccaggcacggaaagacaaacatcgcatgttctcatttatttgtgggatctaaaaattaaaataactgcactcatggacacagtgagtaaaaggatgattaccagagaggctaggaagtgtagtagggggctaggaggaggtaggaatcattaatgggcaccaaaaaaatgaacaagtgaataagacctactgtttgataccacattagggtgactatagtcaataataacctacctgtacgttttaaaataaagaatgtaattggagtgtttgtaactcaaaggataaaagcttgtggggatggataccccattctccatgatgtgcttctttcacattgcatgcctgtatcaaaatctctcacgtacgccatacacatatacacctagtatgtacccacaacatttttaaaaaataattttaaaaaaagaaagtcacttaaccctgtaagcctcactgtccccataaacaaaagatgggccccaaaacagtacctactccatagggttataatccatgcaaacacctgagcacatactaagtgacttgtgacagttaattcagtaacatctatcttcatcaaaacagtagcaccattatattaagaaatattatgaaattaagattgtaagagaaatgccttcctgttagaaaagaccatgctactgttttagatacattgataataaaatctctatttacctatatttaagaatatttcatctaggtgtgtctcagaataattaatggtttagatacatccatgatgcttatattgagaagtatcaaatccagaaattgtctagctagccatcatattaactggaaggtgtacccacaaactaacctcaaagataccaagacagtctaatgtgagagcttccaggcagaacccacagagatgggtgcccaaggctggatccagccaatttgctacaaggaacaagccagaggaatgtgaagtcaaagacaagtacagttgacacttgaacaacagaggtttgaattgcactgctcctatgtgacgattttttcaataattatactggaaaaaattttggagattttcaacaatttgaaaaaacttgcagacgaactgcatagcctacaaataccgaaaatttttaagaaaaaaatcaggtatgccataaatgcataaaatatgtagaaactataagtgttaataaacttatgttattgataaggcttttctgtcaacattcagctatttgtacttaagtttttagggagggaaaagttatatgcaggactgggctgggggggtcagtacctctaatccctgcattgctcaagggtcaactgcataaaacaacactccacagagtgctggcggttaagaccagcttaaggcaaatattcaaccttgagagctgagcttacacaaaacagtcaatgaatcaaaacgggtaaaaacaggaaaagaataaggggccaagggtttggtcaaagtaatacaaggaagtccaaggcttctgccttgaagacagctgtgatggacacagttcccttctttgtattgtgacatagttcaaatggttcttgagatgtgctagctaatttggattaaaggggacaatagtcattaactttgaaggtaacagatatgttattacattatatgataacattaaccaaaccactaagacccaactctctgtcacctgaaagtgaaagtgaattctcaagtgctggacaatagccatgaaatacaagtaagcctaatgctaagtaaatacattctgtacctcagccacaatgcacacaatgagcctgtggacaagcatatcggctatgaaagggcaagtacagccttgcctgggagtctagaatcactttccacatttaaaataagaatttaaaatctatgactgtctactgaggttttcagtaaagccttgataaatcttaaataaaaaaaaaaaattctgagccgggtgcagtggctcatgcctgttatctcagcactttgggaggctgaggcaggtggatcacctgaggtcaggagttcgacaccagcctggccaaaatggtaaaccctgtctctactaaaaatacaaaaattagccgggcgtggtggcatgcgcctgtcattccagctactcgggaggctgaggcagaagaatcgcttgaacccaggagacggaggttgcagtgagtcgaggtcgtgccactgcactcaagcctgggtgacagagcaaaactccatgtcgaaaaaaaaaaattcttataaatactcccatagaaataaaccttatagtatccactgtcttgagagagattaaaatacgttacagaagaaagataagaaaataggtttctggtagtataatttaatctggtgggaaaagaaacaaaaaatggagaaaagagagaccaaagaaagagacttatataccgattcataattaataaccttcatgatcacagtttcaactgggatttaaagaaagcaagaagaataacaaccataatttcttatgcccatttagtaaaatattgtttaaaatgaacattatcatttatttaaagactttaaaaattataccctaaaagtgaatgacatattttaggtattctataaattattcctttccacttatcaaaatacgttttttaaaaatcatgatattcatatgcagacttgaaacaaataaaaatcacagaatatataggttttctacataaataagctgtcatattttttccttctttgctagcaaatataccttcttgaaaatgtttgattatcaattcacccaagaatttttttagacttcctctataaaaggatattactatttatatttcctcaatgcaatgtaattcatttaaaaatactgtgaagtctgactatgagtcaggcattgtattttgttttaggatgaataagggaactcaaaaaacgaagacaaacaaagatgaatagttagtggataagcatgctgcaaggtcgataagggtacaatgaacagaaacatgaagtatagctgacgtgattaattctaagtgttgagattctttttattcagtacgtgtatactgagtgcctactatgaatcagacatatcttgacatgcaatatataacaaacgatatgcctaacctatggagcgtggcaatgcctcaaggatctagaactagaaataccatttgacccagccatcccattactggttatatacccaaaggattataaatcatgctgctataaagacacatgcacatgtatgtatactgcggcactattcacaatagcaaagacttggaaccaacccaaatgtccgtcaatgacagactggataaagaaaatgtggcacatatacaccatggaatactatgcagccataaaagaggatgagttcatgtcctttgtagggacacggatgaagctggaaaccatcattctcagcaaactatcacaaggacaaaaaaccaaacaccatatgttctcaatcataggtgggaactgaacaatgagaatacttggacacaggaaggggaacatcacacaccggggcctgtcgtggggttgggggacgggggagggatagcatgatattcatatacagacttgaaacaaagaaaaatcacagaatacataggttttctatataaataagctgtcatattttttctttctttgctcgcaaatataccttcttaaaaatgtttgattatcaattcacccaagaatttcttttagacttcctctataaaaggacattactatttatatttccccaatgcaatgtaattcatttaaaaatactgtgaagtctgactatgagtcaggcattatattttgttttaggatgaataagggaactcaaaaaacgaaggcaaataaagatgaatagttagatggataagcatgctgcaaagtcgataagggtacaatgaacacgtatatatacctaatataaatgacgagttaatgagtgcagcacaccaacatggcacatgtatacatatgtagcaaacctgcacgttgtgcacatgtaccctaaaacttaaagtataataaaaaaatataaataaataacggaagcactataacaacaattcaagtaaaaaaaaaaattaaaattctctttaatactggctaagcctagccaacagaaactggtgacaaattatagataatgaagcagtaggatatgtcaaaggtgactccaaagtttctagcttaggtaattgaccaggcagttatgctagaacatgattaaaaatataaaaggtggtgaaggattcatggaaaagaaaattgttttggtttgggatctgcttaaatgtagttgcccataggacggctatatggttatttccaatacgaagtaggaaataaaaatgtgcagccaaaaagaagaaaataggggctaagagggatatacgtggaagtcatccattttgataatagctgaagatttacaagtggattagatttcccaggaatactgaatcatatcctatgtggcaaagaaaatgtgaattctcatctttgtcctatattattggtttaaatcataaaagaaaattacatactgtctcattagaaatatttttaattcattctagaacaatttgaaacatgagaatacttttttcaacaagattatacagtaagcccattaataaatcccttctttattcaaatcatcaagattcaaaaccaccaatatagtatcttagaggataaccttttgtggtaggcagaatttgaagacagtccctaatatggtttggctctgtgtccccacccacatctcatcttgaattgtagctcccataattcccacgtgttgcgggagggacctggtgggagataactgaatcttggggccagtttccctagtactgttctcgtggtagtgactatgtcttacaagatgtgatggttttataagggatttctgctttcgcttctctttcattctctcttgccgccgccatgtaaaaagtgcctttcaccttctgctatgattgtgaggcctccccagacatgtgaaactgtgagtccattaagcctctttttcttcccagtctcaggtatgtctttatcagcagtgtgaaaacgaattaatacagtccccaagacttttccctgatatgcacactctgcatgatctccggcactgtgaggatgtattttacttccacaataggacatgttatgctacaggttggtcctaaaataggaagattatccaactgggcctggcctaaccaaatgagtcctttaagagcagatattttttttctgttggtggcagagttcatgattcaaagcacaagaaagatttgaagactcattgctggcttgaagatggagagccatatgctaagaaatgtaaccaacacctaggagctaaagagacctcaagctcacagccagtaagaaaaggggaccttcagtcctacaactacaagaaactaaattctgccaatggcaagaatcagtttgggagtggagctttccccagagcctccagaagagaactaagtaacgccaacacctttatttcagtcttgcgatattctgagcaaatcaaatagttacacagggtctacagaactgtgagccagtaaacgggtgttggtttaagtcactaaatttgtggtaatttgttatgagacaacagaaaactaataaacctttacttttctaaagtaaattctaaaaattgaattacttttattattaatccagttaagtaaaaagaaacgtattttccaaactatgtcacccttaaccagttaagcaaaaactgtaactgctgacagttgtcaagttgtaatcaatactttgtttagtgtaagcacaagcccaggggagaacgtctatgcttttgtaaatctcatgttgaactgtggccccaggtgttagaggtgggggctgctgagaggtgactggattatggggtggtgtctaatcgtttagcaccatcctcctggtgctgtctcgtgatagagttctcatgagatctggttgtttaaaagtgtgtagcatgggctgggcacagtggctcatacctgtaatcccagcactttgggaggttgaggcgggcggatcacgaggtcaggagatcgagaccatcctggctaacacggtgaaaccctgtctctactaaaaatacaaaaaattagccaggcgtggtggcgggcacctgtagtcccagctactcgggaggctgaggcagaagaattgcttgaacccaggaggcggaggttgcagtgagccgagatcacgccactgcactccaggctgggtgacaaggcaagactccaactcaaaaaaaaaaaaaaagtgtgcagcagtacctcctttgctctttctcctgctgtcatgtgaagacacgtttgcttcccctttgccttccaccatgattgtaaatttcctgaggctgaccagccatgcttcctatgcagcctccagaattgagtcaattaaacctcttcttcataaattacccagtctcaggtagttctttacagcagtgtgggaagagactaacacaataagcctacagttcaatgcaaaactgaactgtaaaatcatgtaagccaaaagaatcacaaatacaccatcagaaaagggaaataataacaaaaacgtaacatttattgctgttgctgtaaaagtgttgcactacatttttttctggcctaacaaattaatgtgttttgagtgttttaagatgtaagtcttaattgtaaactgaaataaccaataaccagttattggtcctaaaataggaagattatctaactgggcctggcctaaccaaatgagtcctttaagagcagatagttttctcccattggtgccagaagttcatgattgaaagcacaagaaagatttgaagactcattgctggcttgaaaatgaagacatgaatacatcagattttttaaaaatctaaagaactacagagctatcaaattttagcattattatttttaatagttgccaaattgtaaccattatttatcaaattctagtagagaaataagagaaagtttttttaaatcattaaatttgaatttcagaaaataaatactggccaggtgtggtagctcatgcctgtaatcccaatacttaaggaggccgaggcaggaggatcacttcagcacaggagttcaagacccatctgtgcaacacagcaagaaatgaaagcatcttccttgggagcagaactaaatgactagaccagcatgaccatcattagtttactagatatactatatctatgtattattttaataattaagacaattacaatgttaagacagttcaaaagatataaaccaaatttatatttaaagggtataattcatattatgtataaaatagaatgtagcctgttattaaatctatatacctgaagaaaagtaatgaattagacttaagtagacacaaaaggtctcaattttccaactattttacatgaaaacaaagacactagtattagctcttctcaagataattttcagataaatatgatttaaactacaacttaagacaaagatgaaaaaatctagagaatatcaaaagaaagtcctaaccattaaaaacagcaactaacaattcttcaagacatgtttgattatttttttttgtttagcatctacattccctagtcctaccactttcttctcaactatgccacaatctgagtcacaattctgttttccaagtttccgtgacactgcactgctccactactgccctgtactgaccatgttatagtaggttagcagggagatggttctcttatcaactaggcctaaagatccttgaggaacaggagaattgtcacagtcagagcccacctggcctggcacgtagtaaaatttaaatcataagttctcagctgggagaatctttagtcccccaagagacatctggcaatgtctgctgacattatgggttttggttgtcataagaggaagggggtaccagtgacatctagtgacatctagtgcgtagaagccggcgaggttgcctaacatcctatggtgcacagaaagcctcctgacagctaagaattatccacagaaagcatcaacggtgctcacgttgagaaatcctgttttcaacaagtgtttgctcaaataatgtggactttatgaagacaacaaaactgcataaaatactgcaatcagaataatttcagtacttattataaaagtatggcatataagttaaatatcccacaaccgaatacaggaaaaaaaagaagaggggagggggaggggcaggggagaggcaagggaggggggaaaaagaaaaaagaaagagaggaagggggagagggagagagggagggagggaggaaggagggaaggaaggaaggaaggatttagtaatgagatcaagaagttactatgctattgcattgtagataaataaacttaagcaatttgcttctaattcccaattatacggaaaccacaggcacaagaaagtattgatgtttagcactgacaaagaaaactaagtatagacatcatttcttggtactgcccctcacagctgaatgtttcttgagtgatgcagcctttctcacctatttatctaacatataaaataaaaattatacctctaactcatggctttcatgagaattaaacataatatatgcaaaagacataaaccatggctcaaaaatggtagatacagctgggtgcagtggctcacatctgtaatcccagcaccttgggaggctgaggcaggcccgatcacttgaggtcagaagtttacgaccagactggccaacatagtgaaaacctgtctctactaaaaatacaaaaattagccagacatggtggtgtgtacctgtgatcccagctacttgggaggctgggacacaagaattgcttgaacccaggaggtggaggctgcagttagctgagatcgtgccactgcactccagtctgggcgacagagggagactgtctcaaaaaaaaaaaaaaggtagctataatgatgatacaaatgaaaacatacatgtacctacagatataaacacaaacccatcctcctcagtcagtcaccccctccaccctctcccactgatcatagtattcaaagagaataaactattatttgtgatttcaacaaaagaattaagttaataaaaaattgctgagccacaaaacccttggctggaatttctcttcccctaaaatcctcaattcaaatacatatcctttaaaataaatatttagagtcaagattattaactggtggatttccaaggacaggtttcctgaagagtccaacactgttcctcaaagcaaagctgtttagagagtcaagaaacatgagagctggtgcttgctccttattaagaaaagattgggggttgaaggtagagaggcacccaaggctctctagtcctgctgcccatccttaagcctacacaaatgcaagagggagaacaaggactgataagacccgttttgacaatcttggttagacaacaacgaaatgttgttgaaaacatcttcttaatacagagattactaagaaatggttgttttcaatcttgcattaagccaattcaaacttaataaatgaaaatatcacctatggccacctgccccggtatattctaagactacggggcatagtaatagctactgtagacatgttacttccttgtccagtcaagcaccccagtgaagaattcccatagcacatattatacttctgtttgtttacattttatacaatgcctctcccattttctgcgagtaaatttctatattagttaatgctaagtaactgacttggagcttgtctggcaccgaatacatcttactttaaacattttattttctgcttataaaatggaaataacaataggatgaatcaaggtttcttcctgaaagtgagaagttaactaactattcctctccaatattcttaactaaagaagtggagcaagagagtaagtataaatagctagaattgtgcttataataaaaatctgcccaaaatgtgtcaaaaagttggcagaatggattttttaaaaataactcaactatatgttgtctataaaagatgcaatttagatacaaagacaaaaaataggtaataggctgaaagtgagaggatgggaaagatattccattcataaagtagccaaaagagagctacaagtcttagctaatgcaataagacaagaatagagaactaaaggtttacagtttgggaaggaagaaataaaactgttcacagatgacatgactgtctatatagaaaaatttttttaaaaatcaacaaaagcttcttggaactaataagtgattatatgagattttcagaatatgagttaaaacacaaaaatcagtatctttcctatattccaggaatgaacaagtagattttgaaattaaaggcacaatatcatttgcactagcactcaaaaaatgaaatacttgggtataaatctaacaaaatagatacaaactctatatgagaaaagctacaaaactctgatgaaaaaaactcaaacaactaaataagtggatacatattccatgttaatggataggaagactcaatattgtcaagatgttagttctacactcagtgcaatcaaaatagaaatcccaggaagttattttgtggttactggaaaactgattaaagtttatattgagagacaaaagtctcacaatagccagcacaatattgtaagagaacaacaaagttcgaggactgacaatacccaacttcaagacatacaataaggctacaataatcaaaacagtgtggttattagggaaataatggatacgtggatcaatggaataaaacagagagcctataaacagacccaaataaatatataaaactgatctttgacaaaggagcaaatgcaatacagtagagaaaaaatactcttttcaacaaatagtgtcaggaacagccggacagcctcatgatagaaaatgaatatagacacacacctcaaaccagtcacagaaattaaataaaaatggatcatagacttaaatgtaaaacacaaaatgataaaacccctagaaaataacataggagaaaatatagatgaacctgggcatgtcatttactttttagaagcaacacaaagacaagatccatgaaagaaagaattgataagttgtacttcagtaaaattaagattttctgctctgcaaaagaaactgccaagagaataaaaagacaagccacagattgggagaaaatatgtgcaaaacacatatcagataaagacttaacccagaatagacaaagaactctaaagctcattaataagaaaacaaacaacctgattattaaaagtccaaaacattaacacatacgtcatcaaaaaagacatacagatgagcaaatgaaaagatgctctacattatatatcatgagggaaatgcaaattcaaacaacagtgagataccattacatacctatttaaatggccaaaatccagaacactgacaacaccaaatgccagcaagaatgtggaacaacaggatctcattcactgtttgtgcgaatgtgaaatggtactctggaagacagttcggcagctctggcaaaggtaacagtgtgggtcaatgtctggaaatgaacgccagaaaacataggacaggaaatctccaagtaactcaattacactgcggaacatgataccaaggagaagattctggagataaaggtgtagatagagcaaagccaggacaaatcacaaagtgcctgataagtcatgagttgctctgttctaaaggcaaccaacagctgctaaagggctttgcttaggcatgacagtgacatgatcataatcatatttttaaaaaggaaactcaactctagtaagtgaaatatgaaaaaatgagcaagtccaaatcccaatccttactgtcatacactattagtaagagtctatatcgatacaatcacattgaaaaattgtttggcaggaatctaccgaaaaatctgaacacaggcatattctatgacccagaaattacacccttaaaagtgcatacttaagtccatcaaaagccatatatattattacaatattcaagaaagcactatttatgatagccaaaacatggaaactaccaaatatccgtcaacattagaacagataaatcacttagtatattcacacaatggaatatcatacaataatgagaacaaactattcagaactgcatggaataatatgagtgaagtacacaaacataatgttgaacaaaagaaaccagacacaaaagataaatactgcatgagtctatttatttaaagttggaaaaatgtcactatctgtaagaagtcagaaaagtgttaccttaaggggttagcaactggaaggggacacaagaggggctttcagtattatctctatttttcaatcaaggaagctaagattcacaggtaaaattacttacaactagtaagttgtggaaatggcattcaaatctatgcctgatttttaaaaatacatagccatgggctaaaaatgacctagagaaactgtcaaaatgttcttcaactaatgtttattgtcctatgcctttatgcacactgactccactgctaatagtgccttttcttcactgataacttccctgtaaacacctgcttattacttctactatgaaacccattcccaatctctccccatatacttaacaggctcagtaaccaggtatttcgtctctctcaatactttttaaaaatatatatataatttatcgagtacttattaggtaccaggcattttattggtcttttcccaataaggataatggggttcgaagatataaataatccaaggtcacatgtctaaaatgtattaaaactagaatcgaaatcaaaactttctgaatgcaaatctaaagctctattatattatgtgtccatctttcaccttatcttattgctgataatctatttatctgctttgacctcaagattcttatttctttggaagccaatagtctctacttacctttgtaacatctgccctaagccaagtgcccagcacacaataggtacgcaacaaggcattttttttttttttttttttttgagacggagtctcgctctgtcgcccaggctggagtgcagtggcacaatcttggctcactgcaagctccgcctcctgggttcacgccattctcctgcctcagcctcccgagtagctgggactacaagcgcccgccaccacgcctggctaatttttttgtatttttagtagagacggggtttcaccatgttagacacgatggtctagatctgctgacctcatgatccgcccgcctcggcctcccaaagtgctgggattacaggcgtgagccaccgcatccggccagcatttttttaaagaactaagtatagtatacccaccctccttatccacggtttcactttctgcagtttcagttaatcacacagtcaaccacagtcaaaaatattaaatggaaaattccagaagtaaacaactcataattctaaattgtgcactgctctgagtagcatgataaaatctcacatggtacagctcagtcccaaccaggacatgaattctccctttgtccagcgtctccatgctgtagacacttcccatccctcagacactttgtagccatcttgcttatcagatcaactgtcatggtatcccagtgtctgtgttcaagtcacccttattttacttaataacaacccaaaagtgcaagaatagtgatgctggcaattcagatatgccacagagaagccataaagtagttcctttaagttaaagggtgcaagttcttgatttaataaggaaagaaaaaacaaaggtatgctgagcttgctaagatctgctgtcagaataaatctatccaagaatttgtgaagaaggaaagagaaatttatgctagttttgctgttgaaaatgttattggtgagaaaattaaaaagacactattctggaaaatcacaaagtttatacagctacacttgttcaacagaatagccgttagtgacaagtagctactggagactagaaaacttgctactctgaagtgggatgtgctgtgagtgtaaagtacatactggatttcacagacaacagtacaaatgtaagaatgtaaaatatttcatcaaataattctttaataatcagaagctaaaattctaatattctggaataaattaagtccattttattattaagttaatttcacttacttttttaaagtggctactagaatactttaacttatgtgtgtcatctttacttcacgttatatttctgttgaacagcattgttgtaggggcctttttttctccttactcaaggacataatctaaattgtccctaattgagactattaaaagcacagtggaaacagcccatgtaactgccatcatttgtcctgggttccacatgaagaaatgaatttattattctttcttcttttgcacgagtgttgtaagactgtgtcaatattcaaagaacatattccaacctttccaatgtgcttaaaaattaaccttgatatcaccattgtttaagtgactgctgtgggtctgaatgtttgtgtcttcccaaaattcttatgttcaaatttgtagtataatataactatctctgtttaccttcacagcctgtgacagtcttccctccgttcaaactgcttgtttcatgtctctttataggaaatgttcctcttgtcttgttaaactcataccctcctcttaaatctacttcaaaaatttgttttttaaccaaggaagaatgcttcacaggaaatgttactccctactctcattccggtttactgttccctgtgtaggcactatcaataaatgttgaaggaaatgcagaactgcataaagctgcataaacccacatatgttctttgctgttaagagaaaaagaaaaaaattgaaagtgccaaaagtgtttgttttctggagaggaaaaaattaagcaggaaaaactttccaatgtaaactacacaaaaattacctgttttaaccaatggagagccaagaaaagttaggacacaaactacaatgtacattcttctctgttatggactaaattgtgttcctccaaaattcatgtgttgaagtcctaacccccagtacctcagaatgtgactctgtgtggagaagggacctttaagaagatgattaagtaaaatgaggtccatagggtgagaccttaatccaatatgactagtaccctaatggcagccctagcaaactaatgctctcctttctgaaaaaaagtatacttcaaattgtttaaaaggcagaatgaatcttttaataactggacaaatattgtgtcaaaaataataagcatacaaaaacaaaaaccatcaatctgatctgatatctaaaacaagcaaatgtagcattaccatgttcctaatgcttaaatttagctcaagccactaggagaaacaattataataaatggacagtccttgagtaagaattaataccaggccgacagtgatattttcacatatactttcaaaacatacacacttgaattttacaatttacatgattttgctttgttaatatcaagaaaacagcgtatttcttttaagctgtacattttcaaaatcaaaaccaatcttctcaaacactacttaattttaaaagaggaaataactcgattttctttaatgataagctggcatctcaacacaaaagggtctgtcagaaaatcaatgctatataagacatacatcactttcttaagcattgatgtaaagtctttctctggtctttgaagtagaaactacgtcttaatcatcttatcctcagtgctagtaattacagtcgattattattagtagcattatgttctataaagtccaaacactgaatcagcaaatacttgaccaatgcttgctcctattggaaatacaaggttaggttcctacaagcctttggtgacattttcatcaaccaatcaatacataaccctactctgtacatgcacatgtccacaaatgacagtgaaaacactgtgaggattggggttacaaatcaattttagtgagtaagcaaatgagcaaatacaaaattcaaaaataatgagaatcaactgtactttcacacactaagcactaaacaaatgtttcagaatcacatgaacagatggataaaaccattatcttactgaagtgctttcattacttctagtaatttcattattttgatcccatctacgacacttatatgacactgaatccgccagctgtttgctagcagaacagcaacctgagtctttgggaaccacatctgtcctctgccttgcttaccttgcaaaaaattgatttcattatttattttactacatctttgctgataaatatgaaaatactggagaagcaaacaccatgaaattctgttgggaaacctaggaattcaagtcctgccaatagactggaacaagaaattacacaccacttaggcatcatcaatgagatactctaaacattcctatgcttgagagtcagtatcactgctatggaaaatgttatctgagtagtcagtatcactgctatggataatgttatctgagtgagacaggccagagttcctaagacagttttcttcacattttgttcttgaagagatagttctctcatttgtgacctcagccactttcacacattgtgataccctttggaagcattacacttcacctcttaggcaaactgagtttgcttttaaaaagaaatccccattcttaagtgtttagtaccagttgacctgcctgtatttattttctcataatccacagtcacgctacactgtttgaagctgtgctgcaaatacttcaaaagtttctattcacttgctgacactatagctgttccacttcagatcattcattacacagcccccaacttgctatgctgctgtcaaacatcttgtccctccactgtaacagctgctaattctttcttaatatttaggagccaaattgtccctagtgactaagaaatgctatgagtagaaacacaggcatctaagctgtgcaccctactaacatgaacttactgcacagagcagtgaagcacagaagaattgtgtccgcttatctttacatcagagaaagatttaaatatggcacttccgctttcttgaaagtttcatgtatgtaacctattacctctaaaactctgatttccttccctaatacttaatcatttcatgagagcaagtttagtgcttgaagaaatgtggaattattattctggtctctacggcagcatttaatttaaaacataaaattctaattatcgaagacgactaccaaggtactcttagctctaccacttacagaattactgaaatacatcacttaacatttctatgcctcaatttcctcatttgaaaaatggagataataataatctctacacttcatatatgaaagttgctttaaaaaactcagaaaatatcagctcttattaccacctaagtataaaaaaattagtttatacccagtcaacaaaacattcatcaaaagatacaatatgacattgttataaagtggtttctgtaaaataccttaatccaaaatgtcattttaacaattcagtggcatttctaaattgctaaaactcttttgcttccttggtgacaaaaatgtaaacattaaatagtcactcggctgggtgccgtggctcactcctataatcccagcactttgggaagccaaggctggaggcctgtttgagccttaggagtttgagaccagcctgagcaacatggtgaaaccccggaggctgaggtgggaggatcacctgagctcagggaggttgaagctgcagtgagccacgatcgtgccactgcactccagcgtgggcgacagaatgagaccctgtctcaaacaaacaaaccaaaaagcagtcatcctcagctttacttccagtatgtctcaccattctgtagagtgctaattgtaattcacaattctcactgccaactttgttcaactagcgttcacgttaaaatttcaagtttagatgacaatgcaaaacttgctatatttcactaatctgagctaatctcataattaatgactaaaagttttatatataatatgctaggctatttagattttcaggtctttcatcctgatataggcaccttggtctgcccttttcaacaaggcagccataaaattacaggtttgtaattatcttcattctttaggacttcataaggagccattaaaatagttaaacgacattttatagaataatgtactgcgcagacttttcactatgatgacaatttggccgtagagcatgttctgatgtctgggttttttttttttttttaatcagtagagagtgcgtttggcctatgcattagtagattactactagtcttgaacagttccatctcatgaatctaacatttttcatatttcagtataaatgccaataagtaattgagataaacagcttgttaggcattaaatgttactgaaatgaccctagtctacatttagctttccccctcctcatagatttactaagacagggttcattgtccaaatactggtgacagagtttaagagcttatatgagacatattgaactatgcctttcatcaaatttgccacacttactttttcaccaaaaaatgacaaattcaaagccttataagtggcaacgaactgatcataaaacattatgtgtaatgaattgaatgtatctttgctagcaaacattatttctgccaaacaattcagaaataataccaaaccatttaaacagacaggaatctggcctacagtcaagaaaagcaataaaaaaaaaatacctcaatagctgctttttcaaacaaagagtcttttcccctgctctggcacaaaatttgggaaaagagccaaggtgctacttctcggccctctgacatcaggggaagactgtgtgcgtcagccggcccagtagggacccctggcttatgacaatgcaccatgtgcttcttatcttatcagcttatagtgcctggcacttcggccattactgtgtgaaccctggaggaaggaaggtgtttgtaattgtgagagtgtaggttaaagttaggagcgaagcaggttttagcaacttattaacaaaacaaactgttcaacatatggcattaataataataaaagcctctgccttcaaactcaaacttaagagaaagtgagtcttttaaaggggtgttctagctgtatatgagaaccacttccactcctacttatgcaaataaatgtcaaagttgtagtccagaacagtgactccattacattctttaaaaaaaaaaaaagcaatttgttagaaaatgtacgtgtgcctcttatattagctctactaaaaatggtgcttggggattgggaataggttaactgctttcaaatgttgaccaatatttgcacctctaaccaacgcaggggacagagttccacccactcaggtgagtggagctcagtcacaccactggagccaggattgagggattcaaagagaatttgctaaagacagaaactgtctcataaaaactatttcacctcaaaattaattttcaaaaaacctatccttgacttaaaaatcattttaaaacaactttaaaatattcagagaaacatcacacttgctacttgaaaactaatcttgtcgatgtaatcaacacgtacattctgaataacaaaaataagagttttacttactagtctcggctcagactgtacattaaaaagctctttgttaaaagtgagagtgcatttataccatgatttacaactatctcaaactaatacacctcataaactgtcatactggtcatacagctaataaaacaatagatttctgatattacattataactgtttattattccctcaagcttacctgttaaaacaggatatgattcatttgctccctgctactcctctatgtgggttagaggtcatgccattataaaccatgaataagtagaaaaattatttactccctcctgtgacaaaattcccctctctgatgacaccatcctatccttacacctcattcttcctttcataacttttgagtcaggtatttgccctcaactgtacactgtggtcactgttcatctagtttctctcccatttgaattaactttgcctcacctcattattgagtttaaagaccactgccgattactgcaataacacctcagcaagcaccacagaattctttgcttagtcccaccccacactaggtaaacccaatcattcgagttttgtgacctgcatttctaactggttagagaaaaatgcagtcatgtcaattcttttctgcctcttagatggctccctatactgatcccacagcagccagaccaagactgttccattactactaagcatccggacacagcatgatcaccctgacacgtgacctagccttttgttactcagaggatcctttatttttcccctccaatgtttctctgaacctctacccactttctagcttctctcctaactcagctggctctcttttttggttcttgattccttcttttccttgctcactcagttatttcccctttatgtctcatgtcttcaaactctccttgccccttttaatgtaaagatttctaagacactaacacttccaccaatcctgaaacatgatcaacaacaacaaaacatccttcacacctggtaaacccatcacaccttctatttttctttcaccatcaaagtcaaaagagtagtccagtgcttattttaatgtccttaattctaattcatgtgttaataatcacccaatgatttcattccccataactgcactaaaatcattttttggttaaaccaactttccaaattgctaaatatcattatctcagtcttcatctcccttggtctcagtagtatcagatattgttactggagactggatatcattctttggttaaaatcattttttggttaaaccaactttccaaattgctaaatatcattatctcagtcttcatctcccttggtctcagtagtatcagatattgttaactaatccgttagtttcttggaaatttctcctacataacatggtaaagcaggtcatttagccaataataaatttgcctaaagcaaatatgtaacccaccctatgaaaaataaagggaaaaatcacccaactagaacaccacagaaatcctcaaaagccattaaaactaacccatccagtatgaaacactgtaaacttttcggtgcaatgaaaccctgtcaatgatactgtagggggcttgactgaaggttggcaccaaaaagagtcaaggtgtgaacaaaacaaagttctcatcaattgataattttaatgaattggcagatcaaaacagagctatagagtactagtttgcttcctgtctatctgaatgtcccttctaaatttcttttgctggcttcgtgtcctctactcacctgttaaatgttgggatttcctctcttctatcctcattctacattcttttccttcaaagtcttctctacccccatctcttcaactgtaacatctctgtggatgacttctatatctataccattagcttctaaacaaaaacaaaacaaaaaaatcaaataactaacagataattctcagcatggctacactttaacctacttgaatcttctccctcttctcctccttcacctccctctttcatatcccatctctttaagtgaaatcatcctcctcttaaatcatctaaactaaatatcccagtcatcctccaatccaccctcttcttcagtccctaaatgcaaatcactgatttctgtcaacagtaccttcacagtgtttctgcctcctttaaaccttcttcattcccactgctattacctttgttcagacagttagccatcattttcccctctcagggaagctcaccatctccagctcagaataaatcccaatttgctacatcagtcatggtaatgctctccttccctgaaagtcattagtttagctctcacacagaaaagtccactcttcttccaatgtgcataccaggcctacagccaaagagctgatcttgccaccatcaaaacaaagtccattagcaaagtgggaagggtaaagaagcagatccaaagggtgtgagtaactgaatccatcaatcctggagttgcccttcctaaaaggctcatgttttatgacgccagttttccctattgtttaagtaatctgaagcaggtttctcttacttgcagccaaaaggtgctctaactgaacagccccatgccagcgtacagccttctccctcaacttgcctttctggtttcaggtctcctgatcaatctttcttcacctactctactctcagaagtactctcctgggggacgtggagtgatccttgggcccaaaagtccatgaccagcccatgcccggctggcattccaagaccttccagggcagcacgcaacactccatgctcaagaaactctgggaagtcttctagggcttcagcacagcaggaaactgggaccacgaagctactgaatgggctataaaggccccacacccccaagggcacaggcgacccccatctctgggtgccaagccaaggagctgccaatgggctttacacccatggttctggagtccacctgaggcactcgttcaccccaggtcccctcactcttggagctccccacacgtgggccgcctgctatgagtccctgcctcccagccaccatccacttcaagactggactagagcagccctcatgcaatcagcagccacagcgaaggtggcacatgacgggtgggcacaggcacttctgatgacatcatgcccaccctagaaacgccatccgcccgcttccggcctgggcttcctaggacggacgggaaacttcctacagctggggagggcccgagacccgagtccagcagctagaggacacaatagaaaatacacaaaacaagagaaacccaggaaactctctaaacatgggccctgccactccttgcaccgggtcacctctgtgccatctccacaggcgtctgctcgccctgactagagacaggaaccaggagtgcccactgggtgagccacgaccttgagctcagtacaagcaggaagttcctgcttcattcaatccgaactgacttcaggtaaatacaggggtcccaattgtgggccgaatcgtccagatgctcagggcggccagcctcagcctaagggaagcccagcatctcttttagttcaacagacagcagcttttcttcttctttggatggctgcactctcaagagttttgtttgaattttttttttttccccatgacaaattaagtcaagattttgtaaggggaaacttcttactcctccccatggtccctaccctccctgcaagaatccagaagcactgttgactgttacagattcccttttgtaaatgctacaatgcaatgaaacaacatggtaggggcaaagtccaatttaaccaaaagaacaacagtctgtttcagatttttatttaaaaaatttgattagttcctcactgttccagaataaagatgaaaaacagagtatggaagcacctccaccatctggccccaaacaaccttcatctcccgctactctccccattcctatggtcctcaagacttccataaaacccacacctataccttaactctttcctactaaatgcatttaccctttttggccgccaaactctttttctgtttttttcttacatggcataatataaagtccgtctctccaatttatttctacccatttctgccttagtgtcccaaccgcccaaaagtcaatcatgcatctattgcgcctctgctaagtaatggtaaaatgaaaccactgctgctccccttaagggaagaccgaccacaaacagctacacatcagtgggataagaagtgtcctaactgtacatgaggtctataggaaaaagaagaaaagcaacagactaagtgagatactaaggtcagagaagcttctcacaaacaaatggacacccacattgagccttgtaatccacgaacagacaagacggaaagggcatctcagacagaaggaacagcacataccctcccaagaaggcatgaaggatcaaccttttagggaagtcaaaaattatatatgatgaaaggcatgtggaagaagtgaaggatagctgctcagagtaagcaaaggcagtttaaggatactgtatgccatgctaaggacttcagaattttatttgtaggtggatggaaacatgcaagatttaaccttgagaatgatataagcagatgtggattttagaatgctctttactcccatagaaagaattgattgaagccaggaatgcccattagtcagtcccactgcagcagtgcagttgagaaacagtagcaaaataaaactcataattacatggcagactgacaagactagatgaccagttacatgcacaagattagggagaatgactgggatgatacaagtcctccctgactcttcattgtctctcacacctcacatccataccattaagcagtcctgttgttgcaaacttcaaaattcatccaaaacctaatcatgtttcaccttcccaacagtcaacaccatcaattccagccactatcatccttcacctggctactccaatagctttctaactggttaacctgcatgcatctatagtctggtctcaatatagcaccctgtcaaaacataaactagatcatgttgctgctctactaaaaaccctccaacatcccctcatctcacacagcgaaggccaaagtccttacatggcctgttcctcatgacctctctgaccttgcacaaactaggcatacatccacatcctggccttttccctagcttgtgcctctgcctggaatactgttctttcctcaggtgtctacatcacacctcctgcgagctattgttcaaaatgtcaccgtctcaaatgagagctacatggtatttaatattgttgtctcccagcccctactagcccaactcctgaccctcctcactctgttctacatcatttttcctgtggcactctaaactttcgaatatcctacataatttacttttatttgctgtccatttattttactagaatatatgaattcacaaggacagggctcttccgttttgttcactgatatatcacaagcacttagaacagtgcctgctcaatagcaggtgctcaatacatatttaaattaatgaatgtttgaataaatgaacccaatacttggggtcaggagagagtcatgaggaggaatgggtcgggtatgtcttctagaaatgaaacctgagctgagccttaatgagaagaaattaagtgagcaactaagtgctctggaatttccagagatgacagcatgagaaggtagtgatgcaagaagggcatgggactacaaacagtttgatgttgccagagcttaaataagagaaaaagaggtagaaatgaggctggtttttgtcaattagtgaaaggtcctgattatattccagctcaagtaagtttactgtgagtttctgaaacatcgatcagccgttagtgaggacaattagttttaaggaaaaagtaatgtgcatatataaggtaatggtgatgtagttgagagatattttaaaaacataaccagcaggacttatttaatggactgaatatggagagagtggtgaatgagaataaagataagtaccacctttcaaactcacatatatatggtgtaatgagaaagaagatggtaagtgtcctacccaatgagaagacaaagaagatagtaagtctcctacccaatgagaaagaagatggtaagtctcccacccaatgagaaagaagacggtaagtctcctacccaacgagaaagaagatggtaagtctcctacccgatgagaagagaaagaagatggtaagtctcctacccgatgagaaagaagatggtaagtctccaacccaatgagaaagaagatggtaagtctcctacccagtgagaaagaagatggtaagttcaatttttgacttgttaaattatataatttttagcacattaagttagaaaaattggtgataaaaataaatattaatttcctttttagatccattatggtgacaccatggagaaaataagaggtaagaaaacctgtcaacagtttcaattctaactttaccactcataaaaatattcaggtgttaatttaaatctttcctttccaaaagaatactttagaccatttaatactaattagaacctcaccatgctttgacagaagaacagtgctatggacagaatgtgtccccccaaaattcatatgttgaagccttgatcctcagtgcagtggcatttggaggcagggtccttgggaggtaattaggtcatgagagtagagccctcactgacaggattagtgccctcacaagagctgagagagagattcatgcccttataagaaatgagaaagagatgacttatctctcaaaacatttctcttgtaagaaagcagccatctgtcaaccagggagagggccctccccaggaactgcatcagccagcaccatggtctctgacttcccagcccccagaactgtgagaaataaatgtttaaaagtcacccagtctgtggtacttgttggagcagcccaaattcactaaggcagatgcataagcattttgcttaaaagtatgataaacagaacaaaacaatttctcatcatgtgtttctgaggcctttacaatttgagaattttgctttgattattctggtggacaaaagtgctaaatcctacttggactggggattaatatattctctttggcacaaaggatttgagtagccctaaactgatctcatatttaaagcagagactatgaatcagtcagttgttctgagaggaacatttggactagaagtctaacaatggggtttctagttttgattatttcatttacttgccaccaaatgtggtttcagtgattttccttatctctttatccaactatatgcttatttgtatattcagtaactatttttgaacactaacaacatgctatatactagaaatctaaggatgacaagaccatggtccccgcttttacttaagcaggtagacaataagaacagttgaagataaatagcattagttatgcctgacccacctatttcccagggcttttatgaagcttaaacaaactgaattttttcaaaaatacacagctctatacagaagtacagtgctaatatttgaaggcagatattcaccataacagcatatttctctatgtaggctgttttgagtagtcactatggagcttaatgaggtaagtggaaatacagggcccaaaaatcaaaagtcacaaccaatggaaaaataaaaactgtacagtgagagcttcttaagtatgcagaagcaaatcattacaagcatatgatttctatgtcgatttaataacaggactgtatttcaaattaagtacatttttctaaggtacagttgttcacatcaaatgatctaattgtcaagtctaaataaaataaatctacctatgtttaaatgcacaatgaaaaaaccactgaaatttaaatttaagtggaagactgttaagaaaaaaaaaactgaatataaaaatttgactcaactcaaaggaaaaaaaataactatacaccaaaagaaacaccatggattcaagggtcatgagaacaaacaaaaaaaaaaacaggttttactctttggggatttttactaccttgtcttgttttttaatcaagacaagtatagatgactctctatttacgaacttttatctcttgaagttctttacttagttgtccttttcaaattgttacacattcaaaaattaaaacaatataaaatatatatattgagaagtctcattctcaccagatttctccccaagaaaacacacaagtatgttttcctgtgtgtcttaccagtatttcttcgtgcggcaaataactcaaaacctttataaatacaaacaaaacacatccatatgtgtcaaccaccaagtaccggcctccacagctgcttgttcgatgcaaagcttttctgagccagctgcttatgatagcattagtctgaatttgttgaatgcctactatgtgcgggggcagtatactaatcattttccatttactaaatcatttaatcttcaaaatgatccagataaattattcttactatcctcattttacagaagaggaaagaggattaagaagttaggtcacttgccaaagtttacatagcaaatgtgtacctgagctatgtttcaaaacaaataacaaattagtgtgcctaaagatcctctttaacgtatattctctacctcttcagtcttactgcttctccaaagtttacaagtaaaacagtcagatactccaggaggccaaaaatcacttcccaaaagatacccacatccaatccctggaacctgtagaatgttgccttatggcaaaagatgagattacagttaaagatcttgagaggaggagtttaccctgtattatccaagtgagccctaaatgatataacttcaaggtattccacacagcattccttctaatcaaggaacttacttcacagcaaatgaggtatgacagtggacccacgatcatggaattcactgttcaaaccatgtccccatatcctgaagcagctggcttgacagaaaagaaaaggggtatttgaagtctcagcagcaggtaggtgggatatcttgcagcgctggggcaatgttctgtgggagattgtatatgtcctaaactagtgtctaatgtatgataccgtttctcccatagccaggattcatgggtccaggaatcaagggtggggaggaataggaatggcaccccttaatattactcctggtgatttactactaaaatgttcacttcctgttcccacaaccttatgctctgctcgtccttagcttcaaagggaggaatgtttctaccagaagacacaatggctccaatgaactggaagttgagactgccacccagtcactttgggctcctcaggcctctgaatcaataggcaaagtactggctggggtgattgatcctgattgccaggaggaaatggagctgctactatcgggtattctggctccaggcccaaatcgtctgtgtgatctttcaggtccaatagaggcagttacaaagttgtgcctggcagccctcatggagaaaagctgaccccaccacacaacatgcttggtgcacagtcagtgcactgcagttttctggaaggagttgcagttgaggactcaggcttccctgacccctgggccagtcatgctcatacacatatgttccttccttgtccaggcacctccattcagccgccttcttactggggggcctggaggaggtacttttcttccctttgatttggtactttcccatacctagcccttcccccagccaacaggcccataaagacgcaggagccttttgtttgagacttcccagcagtgaaatgcacccctcatctgagctgatccacctgactctcaccagtgccattctgcagatgacagccagcacctctggggagccagcaccattttgtgtctcttgcttatcccagcaagtgaacaaagccttagttattcctttttgtttggccccttgtcctaatcaaccacctggacacctggttgcttttcggctacaaaaagaaggttaggaagaacatgtctggaatgcagaataccccttagggcatctgcatctgccaccatgccctgtgactgaagtcaatggaaaaccaacaacccctttcaggcaggactgttaatgacccaggcccctcaggaatgagggtctgggtcaccctacaggcaaagaaccctgagcaacaggctgtggtgctcccagagggcaaagggaatatggaatgagtaatggaagaaagtagctataaacactatctaggaccaggcagtcagtttcagaaacaagggcttcaatgtttatgagtatttcttattttgttattgagtatgtgggtatacacatttttaagcaagaatctttgcattcttcctgctcttatcccttatcatctaacataagatgcatgaataacattgaactttacatcatggtatttaagttccaggaagttaaggaaaacagtgaaaaccaaccaggaacttttgcatcctcttctggggaaagggttaacacatttttggttgtaagtaagatagctgcatcatgtcctgtggaaatatgactttatgggtgtctttatttggagattagtcatagtttaagaagaagtatatgagtgccaagtttacagggggtgatggccagttttatgtgggaacttgactagtctaatattcccagcaactcattcaaatacaaacaaggtgttgctgtgaaggtattttgtagacatgattagcagtcacagtccattgactttaaggaaattatccttgataatcttagggggacctacgtgcaatcacacgtatccttaaaagagggaggcagaggaatttttgagagagaagtgcacagaggaaaaggggatgtgaaaatagaggcagagaatagaatgatgctgccacaagccaaggaatgcctggagccaccagaagctggaataggcaggaaaggactctcccttcgagcctctggagggtgtgcagccctgccaataccctgattccagacttctcttctccagaatgatgagagaatgcacttctgttgttttaagccacaacgtttgtggcatttgttagagcagccacaggaaactaatataggtgcttaacaataaaacatagtaagaaaagaaattttatctgaggaatgcgagcctgttgtaaattatcagacccacagaggcatgagagtgaggcagcagtcgcatccaacatcccccccttgcgctaagtaatcagctcttgaagctgcttgctatgtggactcttgaccagctgccgccacaagcagctatcaactaaccaagcaaggccactcactggacaccataccccataccccacagttcaccaatgtatagtcaatcactaatcaatcttatttgtctaaccaacgggaattcctgacaaacagcagttatcagcccactccctgccccccttttgctttggaaaacctgcttctaacaaaggccgaacagagctcatatccaaggtgacctgggtctcagtcttccagatggctgtcctctcaccttagctcaagtaaactttttaaaattatattttgtgcctcaacttcctccttcaggtcaacaatataatgagaatcaaataatattatagagaaagaatgagatagtacatgtttccattaagttactgcacaagtaaaactagtttttaaaattgaattcttattcagacaccaatagttaagatgtcctccctcccactatgccacaaaatatgaaacccattactcttcaatatttcctttcccattttgccattttcttagagatctgaccaggtggggcaaatagtcatgtcccagaagagaactgatactatatatcaaaaggcctaaaagaagaaaagcaaacctctaattaaaaatgttaataatatccacaagggccaaatgatagtttacacccctgaagttatatagaaataatattctaaatcatactaccatattgtagtttactaagaaaaccacaagtaacgtctagaagccaccaaaatccatgattcttaatactttaagtgacttttcataagaatgttagttggcttcagaggttgaaataccaactcgcttccttgatttgaaatttggttggaagccaacatctagaactcggtaatgttatctacagcagtctttcttatataactcttttatatttgccttgaaaaaaaaatgctgagctaatgacaaaagacaatcttggggtactttgtcttaaaatctgagggtggagaatcagcatgcaagcaaaacttcaggtggcagcacctttggaaccagcacctagcaaactgtggggcatccattcatgctctgggggatgtcaccagccatcacagagggtgaccaactctaaaggatgagcgcaggggaagtggaaaaggagagagtagaatggcacgtggaatgtgagtttctgacgggcagagattttgtcctgtttgttctcatcgtatcacctgcatgtggaacaaagaagacagtaaatatccatggaacaggtcaatgcacagaatatgtgggtggaggaatgaaagaaagaagtaaagacgggaggaacataaactttttgaaagtatatacagggagaaagcaattagaacgatacaaggagaaagttacgtaccaaaacccagctcttgaattgaaatttaatacgtgtctcatgcacagcagcaatttacggaaaacaaaatgagtaatttccttaggttcttgggtcctagatgggggtaagttatttttgctgtaaaattttagcatgtattccctaaacagacaaaggaattactcatttaattcattgtttcatcttattaacattagaagtactgatagaaaattaaatcactgcatgtttcattaagttagatgcagaagagacctagtgattagcaaattccagacccacccaatatttgggggatttctctaaatgtcagatatgaatttttttttcctatttacctgattgataggatagaacaactaaggtataaggactttgggaaattactgttaaaaaaaaatgcaacacataattttcatatgtcttccaggaaagaacaaccattatttttggccttttaaaattcaagctgcaaaccacagaggttaaatgaggttaaacacctcataaaggtccctgcacacagaaacattcagaaaacactgctgacagatgactgtcattggtatggacggcttagagatctagcaaccaaagcaagattcattacgatgtttgctttaaattttgtttttgttaccactccaataaaactagatgactctattctattttaaccagtattagcctttgtattttctttatcatcaataagaaatgtatcttttgttcttaaggtaatttataatgctggtaaataccgctctaaaaaaatggtatgtataactatatgtctatacctttcaaactaagttattcttaaaattgacactaggtgaaaatactctcctttcccatcttaatattagaaaaaaattatcttgggggtggtagtaaactgctggagagtgagggaaataaagtgagatttttttttcttttttttttttttttttttttttttgagatggagttttgctctttttgcccaggctggagtgcaatggcatgatctcggctcactgcaacctccacctcctaggttcaagcaattctcctgcctcagcctctagagtagctgggattacagtcatgtgccaccatgcccggctaatttttgtatttttagtggagatggggtttcaccatgttggtcaggctggtctcgaactcccgacctcaggtgatctgcctgccttggcctaacaaagtgctgggattacagtgagccaccactcccagcctaaagttagctttatgattttactttgtcccctactatcaagtcagtactttcagatatattccataaaaagagggaaaacctacattattctgccattttaagaaaatatgatgtcatagttcatgaaatccacatctcaaatactagtacagtgaagaaaacatgggttctgggagaagacagatgtgagcttgaatctctaatccaccacttattaatgtaacctctctctggacaatttccctacctacactatgcagtttttgtgaatgttaaatgaggtaattaatgttaagactctagcatagccctaacacacaggaagtactcaacaaatatttaaaataaatattcataaaagtctctgtaagtatctttattttccaaatattctaccacccaatgaaagcattaagaaaccagttcttttcaaatcagccatggccacaaaactaacatatttaacacagattaatatattgccaacatatacaagctcacttgtacatgtctgtacaaactgctgaagtccaaaaaataaaatttcatcaattgcaaacatacagagcatgcaaagtactataggcctttagatagtttccaattctgtttacaagcaaggtacaggggaaaagttaattgggtaaaatgacttgaaatgacaatgagtatcagctgtataaggtcccacgcagcctgctgtgttcaccacagcactcagcatggatggcctccacatgcttgtggaatacagaatatgaaatttccccaattttagttgttctcttaaagatttattactttatatttaaaatgcattggttaaaactttaaaaaatgttttatttctttattatttcatttagctttaagtaaaataaagacaatcaaaaatgaaaatgaacactagaacctttttttaaactttgaaaatcaagttaatattttctcaggctggtttgggagtacataggtattcattgattcacatgttttaaattaattacatgtgtcttcagacacataacagtccctggcatagagattatttttgaatggatggaaagaaggaaggaaaggaggccttcctggaggaagggaagaaagacaaatggatgtatgagaaaaattataaatttgaaaaaaatgtcaccgactgaaattgtctatattccaggctaaataacttatctgcatatggtatgaactgcaggttaagtaacaagttagaaagcaagggaacagattttaaacaagtctaaccaatcagccactaaaaaacaaaaaaaattcagatacatttaaaactctacctttaaatataaatttcatttaaagaaaatgtaaatcattaagaaaaagacttcaaaaggcaaactgttaagtttaaatatgcatactatattatttcagtttttatcacaaattgagataaaaagtacaaaggacagcagatgcttctgaatgtcacttgaaaaatttggattttcagttgtacacatctgaggttgaggaaagttattggcaaaaacatttcaggagtgtttatgaagactagaaaaggttccgggatagaatctagagggcaggttatactgatttacaagaaagtagtcataaataagagctaatactcattgggtagtcacatgtgtttttcacaaaaattctatatggtaagaattagtattattccctccattttagaggatggaactgacgcagagggaggttaaatagctggccacacagctagtctgtggcaaagctcaattaaaacccaggcgtctgcttccagagtcatgcttgcagtcacaagagtagaaatacatactgaatcaagttgaaccataatgcaaatcacagcaaacataaagagtatgtacttttcattttgacccaacaaacaccttttgagtgcttattatgtgccatgtacaaaactgtagcctcctttgtacttcatgtaattccaaatttacaatctgttttgggtagacactaaaaaacaacttaagatggtcaggcacagtggctcacgcctgtaatctcagccgtttgcgaggccgaggcgggtggatcacgagatcagcagatcgagaccatcctggctaacacggtgaaaccccgtctctactaaaaatacaaaaaataagccgggcatggtggcgggcgcctgtagtcccagctactcaggaggctgaggcaggagaatggcatgaacccgggaggcggagcttgcagtgagccgagatcacgccactgcagtccagcctgggcgacagagcgagactctgtctcaaaaatagaaaaaaaaaattagacatttaactcaagtacaacaaccatgatgacatcatagatatgtatgtaatttcccctcagctaacaaagtatttaaatcaaaataaatgagaaaatgagacggagttgctttgcccacatactttctcattctattgtattagtcatttggatcataagaacagcaaagcaagagaagaggtatttttattgggaaaaaaaggagcataggatggcatgaaagacaggaaatcaaaagatcatgtgtaattcattgtaaatttggtaacatggaaaaaagtgaattgtgttgcagccgtatctataagtcctaatggctggcacaaagggggctttttctttcacagcaaaaaaaagtagccaagtggattttaagaattttctctgacaagtattttcattgtgcttctgttattctttgaaaacagaaactggaatgaggtataagttctgcacttggaatgaaattagcatgattgtatagttggtgtcaataaataaattatttgttggctttgctgttactctgctctactattgtaaaatctgtcagtcccggctgccatcttcccttcaaaacccaagtctcccaattaaaagaaccacagctgtatggaatgggtcaccagagatttgaacctccacaagcattactcactggtcctgccctgctctccagtctttgccaaaaggcaatgtcaagttcacctcctacttgggacacccaaaatgaagagcttaaacaactcttcaaaacatgtgtgttgttttttgcttttttgtttttttaagttaaattagctattgaatgtattttagcccaatataaattaaggatataatctacctgacattgccttgaatggggttctatgctgtttacaagaagaaagaaacttaaaactccataaagctgacctattcattcatcaatgctttttatttaaaaggctctattatatgtccatcccagaaaaccaaatacccattttaaaacacaaatagacaaaaatgctatagtagcatatgaaaaacactccctgcagcattggttttaattcaaatccttacatatatatgataaacttaaaagtttaaaatgtgctaagctggaggcatcacgttccctgacttcaaactatactacaacgctatagtaaccaaaacagcatggtactgataccaaaacagatatatatagaccaatggaacagaacagaggcctcagaaataacgccacacatctacaaccatctgatctttgacaaacctgacaaaaacaagcattggggaaaggattccttatttaataaatggtgtagggaaaactggctagccatatgcagaaaactgagactttccttatactttatacaaaaattaactcaagatggattaaagacttaaaagtaagacctaaaaccatacaaaccctagaagaaaacctaggcaataccattcaggacataggcataagctaagacttcatgattaaaacaccaaaagcaatggcaataaaagccaaaattgacaaatgggatctaattaaactaaagagcttctgctcagcaaaagaaactatcatcggagttaagaggcaacctacagaatgggagaaaagttttgcaatctgtccatctgacaaagggctaatatccagaatctacaaggaatttaaacaaatttacgagaaaaaaacaccaccatcaaaaagtgggcaaaggatataaacagacaattctcaaaagaaaacatttatgtggccaacaaacatatgaaaaaaaagcccagcatcactcgtcattagagaaatgcaaatcaaaaccacaatgagatatcatctcacaccagttaaaatggccatcattaaaaagtcaggaaacaacaggtgctggagaggatatggagaaataggaacacttttacactgttggtgggactttaaactagttcaaccattgtggaagtcagtgtggcaattcctcagggatctagaactagaaataccatttgacccagccatcccattactgggtatatacccaaaggattataaatcatgctgctataaagacacatgcacatgtatgtttattgcggcactgttcacaatagcaaagacttggaaccaaaccaaatgtccatcaatgatagactggataaagaaaatgtggcacatacacaccacggaatactatgcagccataaaaaagggtgagttcatgtccttggcagggacatggatgaaactggaaaccatcattctcagcaaactaacacaggaacagaaaacgaaacactgcatgttctcactcataggtgggaactgaacaatgagaatgcatggacacagggaggggaacatcacacaccggggcctgtcatggggtgggggttaagggagatagcattaggagaaatacctaatgtagatgaccggttgatgggtgctgcaaaccaccaaggtacatgtatacctatataacaaacctgcacgttctgcacatgtatcccagaacttaaaagtataatgggaaaaaaaaagttcaaaatgtcctggctaacaaagttgatggcatgagtcagtattctgatatgatcaaaagcagcacaaatacggggtactacaataaacctaaaaaaggagccatcaatgaaaattgcatatactgaccattccatcagcaaaatctatacctaatactgagacattacattagttacatttcaatttatttaaagactttctagtaaacctttatgttttataataaaaacattttattataacttgctgagatatttttaaatgatgatgttctaaactatccatcttgtaaggacacttactaatattatgaagtatgtaggtcattctgagtacgttaaggatgccaaatccagtcaaaattccgaagactgaaaactatgctcagattccttgttcaggcatagtacacaagataaattattgtaagtgagctaaataaccaatattaaaacctgcaccatatgacaacattcttaatcagactaacctataatgtataagctttctaataattactttctatgccaattactttgtataatattgttttacaaaaattaggaagaatcctatggtactggatttgaattggagatagcattataactcatcatttaaatatacatttcctagctgtatccactgtaagggcctagaaggaataacatccaagttgcaatgagcacatctagtgctcaggtcttggctactaaataccatttcccactgaacagaaccagagttccttggagaagtggctgattccaggtctgaaataggaacatacaaagtaaataagggaaatgttgtgccaagagagcaagtgtttctgaggttaataaagacatatgaaatatagtaagaaaatgtttgaaagaacgcatactggccaaatctgggtagtttgaatatcggaaataataaatacagcaatagattataacacattaagtacaaaaaagaatagaaatggtaatatattataatactgaatagagaaggaatccacgagtccttaatgatacccaaagtgaagcagaacaaaaaagtgggagcagagtgagggaagttcttttctctcagaagaattcaagctataaatatagatggaatagtagaattcattcaaaaatcatcattttataagccccaaagcaataattcaggcaaagatcatcaatgaatagtaaaaccactgagtgatacggtgttgagaaatattatattcacaagatctcaaagtatcgttccatggattactcatcacaaaggagaaatgatacctttatggtggagacatctggcagactccatctgaacctagtgagcaaatttagcatcaccaaaaatagaaaggacatgcaacgcaatggtaatttgtgccaagccaaagaaccatatactcatgtgcatgttaaaaagtacacttaaaaggatggcaggaggttaagtctggtgtggtgaacaagatcagatcatgaattatgattatccgcaatctacaggtgaagaaactgaagttcagagaagtaactttgtcaaagtcacgtatctagtgactggcaaagctggaatttgaacaaagtgagtcaattctgaaacccagattctttggactgcaggagcctggcaatcccagccatcactgggtttaaggcccaggtccagccatgtggaaatggctcccttaagccctagccagctgcaggggccagccctgcagctcacctgccgtagcctcagtccatcctttgctagcctacttgtctctggattagtcctctcatgggagtcaaactaacctgccacctgcccaccaaagctgggcaacatcactgttacagaaaagatggctcgaagcctttggctatattatagagttaagaaaactggctcaattatcacacagatggacatctgcaaagttaataaagacaggcctgtagaacaatcaaaattaaattattatctttcattgttctagtccattcaaatgaatgaaattgaacatgcgacatacccatgaaatgtttgcccatgttccattatcagggcctcaaatgaaaatcagtccttattttaatcaacttacacccagacttgtgtcataatatagccaaaaacctactccatatctccaactaatacgtctgtcttggtccattcaggctgtaacaaaacaccttagactggataatctaggaacaacagaagcttatttttcacatttctgaaggctggaagtccaagatcaaagcaccagtagactcaacgtctagtgaaggccccttcttcatagatgagccctcctatgtgtctgcacatggctgaaggggaaagcagcattttggggcctcttatcagagcattaattaatcccattctcaggggtacagccctcatgacctgaccacctcccaaaggccccacattctaataccatctaccttggtgattatgttcaacatatgaattttggggctggggaggacaaatattcagaccacagaaatggccaaaaccaaacacctaatacagtgttgagaaatattatattcacaagatctcaaagtatcattccatggattactcatcacaaaggagaaacgatacctttatggtggaaacatctggcagactccagattttcttcctaaacctgatgatcctccattattccatcaaggctgaaaccctgaagccatcattggcatctttctctcccaccttatagctaatccatcaggaaatactgttggctgtaccctgaaaaagtatccgcaatcctttcatctctcatccagtctactgtgtccaccacggccccagccaccaccagcccttgcctggtttggccactggcctcctcaatcgtctccctgcgtctgccctttttctcctacagtcggttctcaatacagtagccacagtgatcttaggaagtcagatcaggtcacttatctgcttaaaactcttcaatgaaccaggtgcagcagtttatacctgtaatcccagcacctctggtggctgaggtgagaggatcacctgagtccagcagttccagaccatgctgggcaacatagcaagaccccttctctacaaaaaatttaaaaaattagctgggtgtggtggcacacacctgtagtcccaactacttgagaggctgaggtgggaggactgcttgagcccatgaggtggaggctgcaggtagccatgattgtaccactgcactcagcctaggcaacagagtgagaccatgtcacacacacacaaaaaaaatatgtaagtgaataaacaaacaaactcttcagtttcttcctgtcttactcagagagcagacaaaatccttcatggggtcctgaatatcctaggagaacgttgctctcctcctctactgacatggccgccttgcagtgcctccaaatatgccagccatattctgagactaaatttttgcaattgctctttcttccttctgcttgaaacttgttaccagctgtctgcctgctctaaatttttgctcaaattttacctacttggtgcagccttccctgcccatgttaattaaaatggtaactgcccttcactcctttttctccatagtgcttatcaacaatctgacacaccacatattttcctgatttatttctgtcttacccctcctctcctttaatgcaggtatcctggaggaaagtgattttattttaatctattcattcactgctgtattcccaattcctaaaaaagttcttggcacatagtagacacccgatacctgttacataaataaatacatgataaacccacacatacagaccatggattaagaaaattatcctggtggattaagtttcttaatagtcactttcttctaatatagagtactaaaagccaaatcaggttttaatggagaattagtcaaaaagatatctcaattctcaaatcgtatgtagaaaagtaagccaatgagtctttggctgtatttacacccaagcattttcctatgtaaaactcaggttttggccacaaaaatgttttctcccttaggctatctgggttgatggttaaagtgacatatgtatgatattaatgcgaccaataaatagaaggaaacactccctcaaatatgtccaaacgtagcacataaacaaagacttacgtgcattttataggacagaaaaaaacaaacccactttagaaacggaatgactactttacatgttccagttagttcttttccagatagcttaacagctgtgcacaagatctcagcaacatcaaactgcagcagacaggagaaaagccggatgataccaggtttactcacagtttttgttgtgtccttcataggcccttaagtcccacttatatataatggattgtaaatggaaggtaacagaaaaaagactgtgaggctggtaaaatggaaaagaaaagaaatggcaacctgaggtcagctgtgtgtgacccacatgcaagactgaagtagaacttgcctccttgtgaacgaaacagggcaacaagagctccactagcacaggtcacgctttggtctctgctcacctgaggcactcaatgccacgagtcaagccaacaaaccactcacaactctaattttaagagagtctttttccacttacttttttgttgaggggaaaaaaaccccaaacctgtcagtttgccaattaggttttacaataccaacatacattttagcagttatttaagtatatctgagaatggtggaaattattgttacaaagtttggaagtatacttcactaatagtatttaatttcttttcttcttattaacagatcttagagagagagagcaccaacaatatcaaagagatcttaaaaacagaatgtttaagagtcacatgcaacacataagcaatttattgtcaagatttctttcaaaaagagaagaaaggaaaggcatttttagcaaaactgtctttaaaattttccaaacttaaaacacttgtacagaagttgctccatatcatgaaaatgggagttcataccttcctttataatcagggtacaaatggtgtggcccctgctgtgtgaccttgggcaatggacttatcctaaggctcagatctgtaaaatggtgataataatagtatcaatcttataaggattatcatgaagactaataaagataatgcacatcaaattcttaatatgccatctggaacacggcaattaataaatggttccttgggttcttctattaagctcatacaataggtagaatcacaaactaattttcaaagaaaaaaatccattactcttataaattttcaaataaattaggaaaattttaaactaatagcccagcactgggacctagagggcctgctcttgccagccgctgggaggctggctatggacctgccttctgcaagatgaggggacggggtcaggacttctagctccctgtacatgtccagttctctctatggaatgctctcttttctcttttctaccctacgcagactgcctctccagtccttcagaagaggtgagaagctgtcctactattagtacttccagatcagccttaactgtaagctagacattctcatatattctaatctatctcccaaaggtaatttcagaattgccctaagacggttgtgaaggaattttaaaggaaataatcctaatgaattgcatgccaactcctccactactgtgactgccagcatttctggcaaatagtaaatgctttgctgaaaacaaaagcatactaaaacaagcaaacacaaagaacacaaagaagcagacacaaaacgtaagccttcacctttataaggcaaacaaacctttatgcacagtccttgctcaattcaactcactccctcgcaataggtatgactctttctctgttgcacaaaggcagagtgcccgtatagttttctcttcttcagtactaccctttccaagcttccttctgatacatttcagtgttagttttcattttctcaccagtctctcttctgacttcttggagtaatgaaaagtcaaaggaacccctagagtcactgttgccatcacttaacccaggacaattaggaaaatataaggtatgcctcaattacattttagtatcataaaacttcttagacagcctcagggtctttaaacaggcttaacagaatacctcgtaacagtaagaatttaataaatatttttgttattatcatgtgagcaagcaagcaccctcctcaccatataatgttgccataccagttaaccgtcaactgctgggtcacaggcaggagcaggagtgcgtctctgaccaacagtacagagctggtgagcgggcctccacggcctcctccacagccttcctccccggtttggcatcagttacacagactcgcctaggaacgcagtcttgcacacatccttagattgctttctttctacccggaggcaaaggtgacacactgatggggtctcccattgcccaactctcaggcctaggattggccaactgccctcccaacagattccaactgctcaaggctgagtgcaagctgttccctccggggccactgacatcacagtccgaccggggaatcctcgccacaccgcacctcacacacccctccccagccaaaggctttcatctctgtcaaatcaacacttcccaccccaaatgagaatctgacacattataatcaccttcactcctcctccgaggatcccacaaaccacagaaagacgcactcgtttttcagggctgcatgctggggacacactgccaaaacagcctgcagcccttccaagatgcttaccacccgggagagggagagtggccagccagggcagggctctgaaggacgattgtccaggaaaatggagtgaatgagttctctgtaaagtcaggtttgaagctcagagttccaactgaacccaatgagaaagtgggttgtcttttgaggacgcttgcttctttctgttcaagaaaccaaattgtgtgtgtgtggctgtgcacgcacatacacatacacatgtaaatgttctgacgtgtcctttcacgtccagggtagcatatatttcttccaggttcactgttgcacagccaagcctcttcctctctccctttaaccccagcagcatctagtcacctttccggcattgacttcctcacttgatgtttctctctgtgtctcagtgatcttccctaccggcagatttacatttgcagctttcctcatcagcctttcactcccacagtatgtgttgtataacggccttgagactgctttgtcaaggacacaaagtaattgccctcagcaggacctgaaggacctgctaaactccttttaactactctgacatgattgtatcaagtcagacagtggtattttcaaaaattgttcctgcactcttccctccattcctgactcacaaataagcaccaaattctttaaacatatctgatgttggaagcaagattagctaagtccagtggtcaaaggtttaaatatgttacatggtttggctacgtccccacccaaatctcaacttgaattgtatctcccagaattcccaagtttgtgggtgggacccaggggggtggtaattgaatcatgggagttggtctttcccgtgctactctcatgatagagaataagtctcatgaaatctgatgggttaccaggggtttccacttttgcttcttcctcatttttccttttgctgccaccatgtaagaagtgtctttcacctcctgccatgattctgaggcctcctcagccacgtggaactgaaagtccaattaaacctctctttcttcccagtctcgggtatgtctttatcagcagtgtgaaaatggactaatatgatatgactgaagtatttttttctctagctacccaaatataacaattacattttttacagttttatattacacataatttgctaacatttattcagtgcctgctgtgtactatgccgtgttttatgtgacttagcagcattgtaatatgaaatacttataccagccctatgaggtagagaaatgaaagaattggtagactcccatacttttaagatccaattgccctgtcctttaaattcctttcacaagagtaattattttcaagatttcctaatctttagatgccacagccccctgaagttttcgtgttaagaacttgctaacaggtaactacttagtgtttctcgaaattcacatagattagtcagggaggttctcttctgctttctgaagttttcatttatttgctcttgggtacattaaagaatcattagggtccctcatacatatctaattaattaattatagtttataattacatagcctcctctcaaagtccctaaaaatataaagagtcgcataacagaagagcctcatctaccaccgcaacatctcatcccaccctgccctgttggccgtaattattgttctatgccagatgacaaagagccatgggaaaaatcctttttgtaaccaatatattttaaaacagagactaagatcaggatatactaagcaaaacaggttaataagataagtttgtccttgggtcagtcttttcattcagcccttttcttccctgtcccactgtccatttctgttttcactagtccccagcctcagcattctccatgggcttggacagtggcagcagaaagtgaggccacaaatcaatcaagtaaggcacgctgcaacctcaggcacaggtaacaaacggcagcaacaggaaacaagccccgctgatccccactgtctccctcctgtcttcctagttctaatcctgccttggcccaccccaatctttctcatgcctctttctcaaccaagagccctaggaggcagctaccagcccgtgtgagtggactctggggaataatccacatgtctcccttcggtctctctcggggaacttcgattctagagaaagaaatgtagcaccagagtgcccttccacatgtgcaatttcagtcaccaaagaaactgagcgggaacaacatttctgggcaggagaataggcagatataccatgaagctatataccatgaagcagatataccatgaagtttcagggcccagcatgtgtacaggccccttccaaggtcctgggaatgacctcggtgatgagttcacattatcacatttttgtgaaatttgaaaaaggtacttttgtattattttccataaacagggcacccatatgataaaaagatcaagtcccacaaaaatccagtggtcctaaatcataccttgtacaggtgtgaggctcaggagggtctcacacctcatgcctacctacttgatgatagtttataagaagacggccacctctcaaagtccttaaaaccaaagagtcctatcactgaagagcctcatctaccaccacaacatttcatcccattctgtcctgttggcaataattattgttctatgctagacagactacataaaatctaacctagtttgtattacattttcttcatgtaacatcagagttcttttccccacaatacgaaagcaaaattaggttaaattttagaagagggaaaataagaagtaaaaataaattttattttttaaaaaatagcaaaagtagttactaatgatgcacctccttttcaaatatatctgaaaccaactttggcaagccacgggcatcttttagaaaatatattgtccaaagactctgcatgagtaaacgtacaataggggccatgaagctcctccatacaattctgccatccagccatgttgaggaacccctgcaagagacgtctgcagttgtatcccctagcaactccttaaaatctcactggtgctttatcgttattttagcactgtcctttagtgatataaggtcaaggccactgtaacacacatgttagtaagcaggaaacagtgaaaacatagaatcacagaaataatatttaacagcaaaaatgacacttctaacaactcattttgtagctgaaaggcactgtagtgaaaacataggaaatagctatataaaaggcttctgagtaacagagggaagtcttcccgaaagcattcggttcttaagatacactgttatttcctgaggtacctttaagtctctcctaagtggctcagatgaaagcccctggcagagaatctgggaggggagcagcgtcccagtgaggactctggggagggcccatgctctgtgtcctatgcgcagagcgacttcaccacagtcatgggcacaatgacccctaatggtattgaaaatggagagaaagggggcaagttcaatgacgtatgtgttatttctgaagttggtattttttacaacaacaaaaaattggcactaacttaaatatttatccactagggaacggatgaataaaaggtggtatatgcaacaactgaatacccaccctcaatttgctgaagcaggaactaaaaccatgggactgatcatgcaaactggagctatttccacttgtttaagtcaatgcttacaaaccatgctccttctaggacacatagaaagtgtaacaatcaagatatgtacataaagaaaatatttaggattagccaagaaaaatatataacaaagaaataggaaggccttcctctgccaccaagtctaaaaattaggttccatcctaacacccatttcttctcatttgtaacctttatcagcaaatgtattttatcagtaaactcttaacagtaaatttgtttatgactattcattcgtcttcatgggtctgtagtaaagcgctgggaggttacggaccattgtatccccaaggataatacggcgcctggcaaacagcagacccccaccaataaatactttcaataagtgaatcattggcgatagtttcgagtaccattcacattttgataccccacaaatactcagctccagttcatccttctggtccagctgactagctgacatcagccccttctggtccagctgagtaggtgacatgcccacgtgagtgtccacaagctacctgagaagctacatgcacaagactgcacttactctctttgttaaaaaaaaaaaaaaaaagtgttactatactgtcaaaagcatgcagagatagctacacaagagtgtcctggatgacattacttgtaaaagtagatataaagaaataaccggaaacatcctacatggaatgggatactacttatccttttacactaaggcgtaaagcagatctcttaggtacttcagtggaaagctggagggctgcttgcgctatgttactaaatacaaaaggaagctgctaaaggtaccattctgtttaagatgatcattacacatacatgtggatttcagtgtagaagaaaaaagctaacagggtcatatgtgggtagtggaatttcttagcttactttgaagattttccacattgtttgagtttttaaagtgaataattcctacacagaaaacttgacagttaaaaaacaaaaactaaaaaaataaactttctctactctcaagctctattacaaacaaccctccagtcaccacattagaagtgtggtagctctcctgaacccccttctttgcctcactctttacattttaccaccggaatatgtctttatcaaatttcattgcttcattttgctcatacctgttctctttccatctcctctgcctgaatttaagccttcatcatctctctctacagcggtccaccagttggcttccttcctttcatctgtgactcctggcaatccttgacattgcttccgtgtttccagaacccatattaaaaaacaaaacaaaaaacaaacaaacaaaaaaaaccaacaagtcacagctcagaatgagcccttccactcgttccgaatggcctgtgcagtcgcattcagggggctgggactgcccgtggcacctgcacagcacttctcccaccatttctccaactgtgctctgcactgttctaaaaataagtttcctgtagttcccaatgtttcacagtttgttcatgctatttcccttatcctggaatgtattgcccttgtcctccaatcagagttaaaattacttctgtttaagaactcaagtcaaacaccacctcctcctccatataacttttctgctccttttccctcaagcaagtttctggctccttcctttgtgctctcggtgaatcttccactgaagcaacacggaaaccacacacaaactgtcatttgtggcaggctgttgagtgcctgtggcttcaaatgcttcggcgcatgcaatgctactactgttttcaggtaggtggccatcgacatcttataaaagttacaaatgtccccatttttggaatagaagtcagaaaggttggagagtggggagagagacacttgtccaagaccacataatgaaagagacaggttttgattctaaatctttctagcacccactgtgctgtacaacctttattaatatgtcatcatacgcactggcttgaatttctgtttctccctataatatccttattttctcatggacagggattatttctgattcatcttttgatcctcagacctagtacagagctgggcacgcagcaggtgcgtggggatgtttgttgagtaacgcaggcaagggagctggggagagcgcagtcattaggagtcacacagtctgaccttgagcaaattattaacattacgaacaagcgaaaaaaaaaaaaaaaacagaaataaagcaccaggcacacagtctagggcacagtaagttctcaaaaatgctaccaacaattacaataacactgaggaaagagaagctcataagaggggcatgtgtcagtccgtcagggctaagtgttgctgagataataaactatcccaggatcttagtaactgaaaacacacaggatttgtttttcactcactgtccacatgcataaagttctgaggagtctccttcctctaccttgttctcactcaggaatgcaagaccaaacaccatgcagaacagcactggctaccacagcaggggatgggagcgtgggaaagtgagcgtcgcctattaaaaacttccacgagtcagtaacacacctcgcttccttccacctgctattgatcaaagcaactcacatcataaacttgcaatcttacctcatacccaggaggaaaaccagaaataccacatcactaatgactatagtgggaacagggaaacatttcttaagaggaggtaagtgtaccaggtatagcaagtaggagaaaggcttagggtaggcacaaaaattgtaaaaaaggtcaacagataaaacagtaaatcaagtatgaggaaaagcatctgcggcttggtgtgactggaccatggagtgcgtgcagtgcgtgcaggggcttaggtggaagaacaggctgagtcaggttgttgaggacttttctgctctattactaatcataagaggggtgggagcccagatgatcaatatgataagtgaataggttcactctggcaacaacttagggctcttcatattccaatataatatatacatttatcctcatatacttattctgttgttaccttgtcataattattgtcatgttttatctattttcttgcttcccaacttagaagtggtttcgttaaaaatgctttcagaatacttatttcactttttaaaagaacgtattgaactttaagaaatccactgactgcaggacctgatggtgctaatggtgcacaggtctcgtctgcacaatgagcatgtactacacacccaacgccttgagttaatttggacagcaatgctttagctgcaattacagccatgcacagcgtaatgatgttttggtcaacaagcgaccaaagatatatgagatggtcccataatattataacgaagcttaaaaatatttattgactgatgacgcagtagccttcctaatggtatagcacaacacattacctttttatgttcagatatatttggttacagctgcctgcagtattcagtacagtgacatgctgcatagggattgtagcctaggagcagtaggccacacacagagcctaggtgtgtggcagcctgtaccatctaggtttgttaagtgcactcagtgatactcacaccatcaggacgtcacctagtgatgcatgtctcagaaggtatccctatcattaagcgacacataactgtatttaaataccaagactacaagtttcagagactgacgctgggcagctgcagcgtgaatagagtttcatgtatgtgaaatgtgtctccaaatgagttggataacattttggagattcattcagtttataaggatgaaatgcagcacgtgtttaacagcatcaactttagacagctctacatcacctgtgtatctgctacaatccagaatccagatctgaggttcaagtgggccctgaaatccccgacaatgtcaatgtcaccctatcacacccaagtctccggtcctccgctgagtttgcagagaacagaaggggaacgacccacatgactctgagctgcatgatgagatgatgccacaatgtctctcccaggactcatattattctacgaacagttattctaatgcaagtattgcttttcttgtatatatatgtatatatatatgtatatatgtatatatatgtgcatatatatacatgtatatatatatattttattatactttaagttctagggtacatgtgcacaacgtgcaggtttgttacgtatgtatacatgtgccatgatggtgtgctgtacccattaactcgtcatttacattaggtatatctcctaatgctatccctcccccctcccccaccccacaacaggcgccagtgtgtgatataccccttcctgtgtccaagtgttctcattgttcaattcccacctatgagtgagaacatgcggtgtttggatttttgtccttgcgatagtttgctgagaatgatggtttccagcttcatctatgtccctacaaaggacatgaactcatcctttttttatggctgcatagtattccatggtgtatatgtgtcacattttcttattccagtctatcattgttggacatttgggttggttccaagtctttgctattgtgaatagtgccacagtaaacatacatgtgattgtgtctttatagcagcatgatttataatcctttgggtatatacccagtaatgggatggctgggtcaaatggtatttctagttctagatccctgaggaatcgccacactgtcttccacaatggttgaactagtttaaagtcccaccaacagtgtaaaagtgttcctatttctccatatcctctccagcacctgttatttcctgactttttaatgattgccattctaactggtgtgagatgatatctcattgtggttttgatttgcatttctctgatagccagtgatgatgagcattttttcatgtgactattggctgcataaatgtcttcttttgagaagtgtctgttcatatccttcacccactttgtgatggggttgtttttttcttgtaaatttgtttgagttctttgtagattctggatattagccctttgtcagatgagtagattgcaaaaattttctcccattctgtaggttgcctgttcactctgatggtagtttcttttcctgtgcagaagctctttagtttaattagatcccatttgtcaattttggcttttgttgccattgcttttggtgttttagacatgaaatccttgcccatgcctatgtcctgaatggtactgcctaggttctaaacgcaatccagcatataaacagaaccaaagacaaaaactacatgattatctcagtagatgcagaaaaggcctttgacaaaattcaacagcccttcatgctaaaaattctcaataaattaggtactgatgggacatctctcaaaataataacagctatttatgacaaaccacagccaatatcatactgaatgggcaaaaactggaagcattccctttgagaactggcacaagacagggatgccctctctcaccattcctattcaacatagtgttggaagttctggccagggcaatcaggcaagagaaagaaataaagggtattcaagcaggaaaagaggaagtcaaattgtccctgtttgcagacgacatgattgtatatctagaaaaccccactgtctcagcccaaaatctccttaagctgataggcaacttcagcaaagtctcagaatacaaaatcgatgtgcaaaaatcacaagcattcttatacaccaataacagacaaacagagagccaaatcatgagtgaactcccattcacaattgcttcaaagagaataaaatacttaggaatccaacttacaagggatgtgaaggacctcttcaaggagaactacaaaccactgctcaactaaataaaagaggacacaaacaaatggaagaacattccatgctcatggataggaagaatcaatatcatgaaaatggccatactgcccaaggtaatttatagattcaatgccatccccatcaagctaccaatgactttcttcacagaattggaaaaaactgctttaaagttcatatggaaccaaaaaagagcccgctttgccaagtcaatcctaagccaaaagtacaaagctggaggcatcatgctacctgacttcaaactatactacaaggctacagtaaccaaaacagcatggtactggtaccaaaacagagacatagaccaatggaacagaacagagccctcagaaataataccacacatctacaactatctgatctttgacaaacctgacaaaaacaagaaatggggaaacggccaggcccggtggctcacgcctgtaatcccagcactttgggaggccaaggtgggcggatcacgaggtcaggagatcgagaccatggtgaaaccccatttctactaaaaatacaaaaaactagctgggcatggtggcaggcgcctgtagtcccagctacttgggaggctgaggcaggagaatagcgtgaacccaggaggcggagcttgccgtgagctgagatcgcgccactgcactccagcctgggtgacagagcgagactccgtctcaaaaaaaaaaaaaaaaaaagaaagaaatggggaaaggattccctatttaacaaatggcactgggaaaactggctagaaaatattgcttttgctcccataaatgataacttgtggaactttttaacacaatgcccagcttgtaggcaatgagcccactgtgatggccaacctcatggacatctctcgtctcctttaaatgccttaagaaaaagtggccttcaaaacttttctgtataagttccacctttatgtatgagaaaccataaaacaatagaaagatcacactgcacaaagaatcagaaatctttttctggtttaagtccctgtccttaaattcccatgtgacctttagcaagcagcctaagttctctgcaaattacctcacctcagctctcttctctataaaataaggagcactactagtctaccttaaaagccttccaatcgggagagttgcgagtctacgtcagctttaaagcaaatcctaatgctattcctagcccttgcttctgcttgtctctctcaaaatagtgtttctttccactgaataaaattccaatacatttgtttttcaaaagatccttttgactgcaagaaacaaaagcccaattcatactaacaagcaaaaaaacaaaaagtaatttattgacccatgaaggagtcacctggacctgtggcaaactgtgtatgaaaaggaaatacataattgttgtactaagccattgagaatttcatagcacttgttactgaattagaacctcacctgtcctgactgataagctgacttccaaccaggactgaaaacatgtcctcccctgcttaccaaccacagtgaaatgttagaactgcttctctgggtgtcctcctgccagtcctgaggaagggctctgatgagccttaccatggtggaatcccagacctcaatgagtggatacaagcatgtaccagggccacaccgtgtgccttccaaaacggcacaagatctgaggctgtgcccagaaggggcggggaaagctgaatggagtgtgaataaggaataatgactatggtccagagaattctctctctctcaacttaacctctgagcaatcaattgcctgctagcctatcagtatcactgctgtagccattacacattttcatttccttcaaaacacataggaaaatccttcatatacacaaatacaattttctgtaagatagtctgccacaatatttggattagaaaagttatgtttattgcatacaaccataagtataatgaagataatgtactgttcaggtttgatctccttcgttcagaatcaactctcttattcagccagtgaagcaatttaccaaattcaatttgaaaagtatactgtcatcagtaataacctcaaacaacttcactggttgccagtattggacactacctttccctgcttcttttacacacttcatacatcctcatctcccttgtgctgaaacacatatgttacccacatgcaaaagacaactcaaatttcacttagggtttaaaaaacatcactgtatagtgaacaatcattattaacgacaagtatctacagaagcccatccatgctaaattgactttcataaatgttatctagaccaaatgagatatatattgctcagagaataagagaaagtctgtttttgatggaaaacatttgttattctcctattactccaaactatggcaaccctaggggaggatcttttctttcattcccttccccaacccaacaaaatataagcaaacatcaggaatgctctgctccttaatcccatacacttttaaaacagtcctcacattagaaaatgatgtgagaaataaacacagattttttttttttctattgagatggagtctcactctgtcacctaggctggagcgcagtggcacaatctcggctcaccacaacctcaggttcaagcgattctcctgcctcagcctccctattagctgggattacaagcgcccgccaccatgtccggctaatttttgtattttccagtagagacgggtttttgccatgttggccaggctgatctcagaagcctgacctcaggtgatctacttgctttgcctcccaaagtgctgggattaccagcgtgagccactgcgcccagccatatttttgtctcatgttgagatgaatgcaaattaaagtatacttcaagaaacaataccaaaataatgcaaaacatatctcttccagcaagactgtctcgcctcaccacatatcttttccagcaagacagtctcgtctcaccacatatctttcttgagtaactataaacctatcaacacaccaaaaaccaaaatcttactgttttaactaatagggcataaattcaaaaatgtgattcataaataacataagaactattagtgagtcctttattaaatttgcagtcagaaacaatgtttatagatgaaaatacattcaaatttgacacatcaaatatttaaaaccttgaacagaaaaggataagttctctttatctagaggatagtttattttttattttaaccaattttccttcacataggcatactttaaactagaaaacaaatcccttattttgattctatcccttgaattacatgataaaacaaaaggttatattagttttccaatagcaactgcctttaaaagagtaattctatacttttttgcatgtgttcaggtttttttaatgtatcacattccataatccagtattcaattgaccaaatacttgatgataatcaagaaattgcctgtttggggacacggaggaagccatagaatttcagaggttataaaacactattatttggccaggtgtggtggctcaccctgtaatcccagcactttgggaggccaagatgggcagattgcttgagctcagaagttcgagaccagcctgggttacatggcaaaactccatctctacaaaaatacaaaaattagccaggcgtggtggtacgcacctatagtcccagctattcgggaagctaaggtgtggggggattccttgagcccaggaggttgaggctgcagtgagccaagactgcaccactgcactccaccccgggtgacagagcaagaccctgtctcaaaaaacaataataataaaacactatttttcaaaactaagtgtgaaattacctaagtgattgtcaatatgtagcactgaattcctcttctgaatagcaatataaaagttaaagatagagtaatactttaattaacaactatactccagcccttatttccctctccaccttcagactccaacattaactgctaataccaacctgctgtatcttatctgtccaacaaatacttcaaaatctattgactcaaaactgaacatctccctcccgaaaccagcccttccttccttctccattccccttctcgctgacagtcacgcatcattcacccacctgcccacacccaaaactggaggccagcctgggacgctgccctgctcccacttctgccgtgtgcaaccattaagcaccaagttgtgctaattatgcggctcagacatctcgcaaacatttccacttactttgacctcttttgtcagtcactagctcctaaacactttgctggtttagtccaccactctactgactattccctgccttcttcagttttgttcctcaaaaccactatttctaacggccaaagtaatccttgtaaaccgcaaatttaatgttattccccatactcatccttaaaaatctttagtcaatcctcaccatttttggataaagtcaaaactgttaatatggctcataaaacctccaaaaatctgacccctaagtcacctcttcagcttcacatccaaccactcaccttcctaggataactccaagcacacaggtattgatgtccagctccagcaacacatcatgcgtgcttctcacgtctgtcctcacacgccacttccctcctcttctagaacatctaccctcctgcaatgctatctccatcccagcctggttaactcttacttgccatttaagcctcactttaatatgattaatttcagcaaagattttccccaacacagcaagcctgcattaagtgttctcattgtatcctctcaggacaccaggactatctttattttgttcactgttgtatttccagcatctagcagagttcttggcacatagacactcagaaaaaatcagaatggctgattaaatggcacaaaatggagagaacattttaaaatcctcagacagtctcactgactctcctgatcaaatagaagtaaggaatgctgagtgtaggaggcattcaattaaaaaaaaaaaagaaaaagtaataagaatccaagtgaagtgttaaacccattgggcagaatttatagaaatacatgtaaaataggccaggcgcagtggctcacgcctgtaatactagcactctgtgaggccgaggcgggcagatcacgaggtcaggagtttgagaccagcctggccaacatggtgaaaccccatctctactaaaaatacaaaaattagccgagtacagtggcgggcagctgtaattctagctactcaggaggctgaggcaggagaattgcttgaacccaggaggcggaggttgcagtgagccgagatcacaccactgcactccagcctgggtgacagagcaagactccatctcagaaaaaaaaaaaagaaagaaagaaagaaagaaaagaaaagaaatacatgtaaaataactaattcaattccattcattatttttagataaatcacatttgataagtttactgaatcataacaattatgtacatcctatcaatttcaatgtcggttttctagaaacacattttattcagatactctcaacaaactctgaaaaatatttctaataccaaagtgatgaaaataagtctgcatttttctacgtgtgacaaacagaagcaaaaggcaaagatgatcaggtgatgatgaaagcaatgggatattttcactttattgagttttttaaaagaagaaactttttaaatgataaatcattagatttgtgagtctgaggttcttttaaaaatgacatattgaaatatttaaagtaagttttatttcaaaagtcctttctataaagtaataatttatccataataataagttatttggtcagtttagataattaattttactcagttactacctagtttattttactgaaattcgcatgtcttttcacactcccgctgcttctctcagccgtcacacagcatccactgtgagtctgcaccatgtcagccctgcctgtggtcactttcattttctggttcctatgatctaacctcatgttctgattgggtttgcagcattgcaggggaatgcatgaatccacaccctgaaggccaaaacggagggaaataaagctaaatctatttttattgattcacgttcaatattttaacaccctgattttttacccacaaatttgaattttcttctttcagttttatgcccaatttacagtttgcaagtactgacttcccagtaagttgtttcaacctaattcctctttttccttttcaagttcacagaaggcattttccgagtcggttgtgtttccgtctcctacttggccctattcgcatgacacagggtgcaaggccacagaattaaacgtgagcagtagctcccggtgtatctcctttcgtacccagaatcctaccaggaaccaactgacaaaacgattctgaaaataagaggtccctgtgtgagaaagggaggaaacttccctaaccatatttagccaagaaacagtgtaagtccccagggaacagtcttcagcagccattgcatgatttcatgaagtagctgctccttggcaggcagtaggaaaacacttttcaaaaaaaaatccatgttttccttcaagtagctgtcactcctttagaaaaacgttttttttaggcctacagcctgaaggaagggtgatcttttgtggatttttctaaagtttgtgttagtcagattaaacaatgtacaggttatgcatatggagaagccgatatcatgttaacgctcttggcttggatgcaaaattaatatcctacaaggaaattattatatatccgctgagtttcaaagactagcttcttctagcacaaatgaattatcatattcatagacaacttattataatcagtttttcctgagcccaacaactcaaaatgcactacagtttcgtactcaaatagatgaaaattagagctgatctctgttcaacaaagacaaaggcacacatgacactgtgcaccaccagttttcacaaaacatttaaaactcggaaccaaaatttgagaacagagaatttcttggtgtattttactaaaaataaatatatattgtttaattacactggcaaacttctcttgaatccatgcaaaatgagtcaatgctatttactggatgttccagaatcaaagctatgggaaaacctttgagaaaatacatcttaatactagagatattctcaataatgaaagaaaagactggcatatcctcaaatgcacagtgctttctcctgtgtagttacctttaacatccttaaatggaaatgccaggagaagctctgggacaagagtaagtacaaaaaagcccaaatgtccattcattcttagcgaaggaagagttacttcctgtcacctgacccatcagacaagtgacccttgcaaaggccacatacccaagtaagcaatgcctaaaaatcagaaagagggaccgctttacgcattgcatctaccgaagtgccacactcttaagttcaatatgaatttaaaaaaataaaaaattgagttggagtctcactctgtcacccaggctggagtgcagtggcgggatctcggctcaaggcaacctcacctcccaggttcaagcgattctcccgcttcagcctctcaagtagctgggcaatatgaacaattaaaataagcctttacatctgatcggccattaatattaaattatcagtgagtgttaaagtgggggaggtgggagtaatggagacctcgttggggaggtgcttgttggaaagactgcgattagggtgaacactgatcccagtctgcccactcgggactaaggagtttgccaggacgtgggacttgtggtgccaagactaggaaagtcccagttggtcagtcccagcacgcagatgtgactaaatcactgggactgagcaaagataaaggttatcacacacaacatcaatcataagagcagggtaaacccaactgaccttcagcttcgaggacacacatttattctaacggctctcagtggtaaagtcaagtgtcaacagtgaaatgatcacacaaaaaattaaggcttcttttcccccaagcagattatacatattaattaaatggtagagaagtcaggcacagtggttcactcctgtaatcccagcttaaggccaggagttcaaaaccagcctgggcaacatagcaagactccatctctaaaagttagaaaaattgtccagtcaaagaggcagagaagaatctagtgacactgcttctctgacagcaaaaataggtcattaaacgaaatctatatgtattcaatatatgtatacattttatgtgtgttgtttaaatgtatatttgctacattgctaaaagctgatgcataagaaaccctcaatccaacataattgtgtagtaatgggattttttttctttttttactctgttaatgtaacaagaatttaacttgcaggctacaagggtaataaagaaatggggaaaattcactctctgataacaattcctaggtctaaagactaacagcctgatgctgtatcataccccaaaccggcacattcaataatcatgaaagaggcatttgggaatttccagaggtggccacgtgtccaccatctccatcagccttcctcttctccaggctgcagttcacacagacatggcccgcccaccttcaggagaaaccaagacattaaggaaacaatggtcaccatccaggagcgggacttaacacagccctttaccatatgcagggcctcaaagaaggggttcagggccccccagaaaaaaaatgttttaggcctccaacaagggggtagttggtactgacatgcaatgaagtcagctctgtctctcgtcctctctcctgtcccctccctgtgtccagaaaggggtgatttgtacagcttcccctcctcttgtaagaaaccttgttcacaagagagtcgcaactaaaactgtgaacttaccaatgaaatgtgagcgatgaaatgtgttgagagagcgcattaaatgaatgttacataggtactaaaagagccctaggagcatgggctggctgcgggctagtctctccttcatatgagagaagcgtgtagtctagtgtagtctagtgtagtgcagtgtagactagtgtagtgtagtctagtgtagtgtagtctagtgtagtgtagtctagtgtagtctagcatagtctagtgtagtgtagtgtagtctagtgtggtgtagtgtagtgtagtgtagtctagtgtagtctagtgtagtgtagtctagtgtagtgtagtctagcatagtctagtgtagtgtagtctagtgtcgtgtagtgtagtgtagtgtagtctagtgtagtgtagtctagtgtagtgtaatgtagtgcagtgtagactagtgtagtgtagactagtgtggtgtagtgtagtctagtgtagtgtagtctagcgtagtgtagtctagcatagtctagtgtagtgtagtgtagtctagtgtggtgtagtgtagtgtagtgtagtctagtgtagtgtagtctagtgtagtgtggtgtagtgtagtctagtatagtgtagtgtagtgtagtctagtgtagtgtagtgtagtatagtgtagtgtagtatagtctagtgtagtgtagtctagtgtagtgtagtctagtgtagtctagtgtagtctagtgtagtgtagtctagtgtagtgtagtgtagtctaatgtagtgtagtgtagtctagtgtagtatactgtagtctagcgtagtgtactgtagtctagcgtagtgcactgtagtctagtgtactgtagtatagtgtagtgtagtatagtctagtgtagtatagtctagtgtagtgtagtctagtgtagtgtagtgtagtccagtgtagtgtagtgtagtccagtgtagtgtagtgtagtctagtgcagtgtagtctagtgtagtgtagactagtgtagcatagtctagtgtagtgattggtgtgtcatctcaggaatcagacaaccccgggccctcactcacatagagcaccggggacaagctgcttccacttgctgccatttataatggctacatgatcgggcagctataaacatcagatgagatgagatatttaatggcacccagtcaatgttaacttctaataactgactcttagagaccctgtagtaaacttaaaagtctcaacctacagtaatctagatttctacagagaagactgtgtttcaagaagctgagaccacatttctgtctttccctacttacatgcttcactcttctccattaattgtattatttccctgtcaattcctgtcctttagctaataaagaaaaacttgacaagccactccacttccgggccacgatacattttgcaatacccagaaccagtctatatgctcacaggaggataacatcaaataaagcaattttttgttttcttttgtgtctctctcccacccccaccctggccaggcagtatctgcactgtgcatgagaaggtgatgatgggggggtagaaatggccaaagagatgcttctcgtaagtatctgagtaaaatatcttgagacatgtcgaacctgagcaatttcccaccagccttgcacttagagaggctacaaagcataccagggaatctgcagtcaggtcactgtggaaaacctagctgttcccttctttagaaacagccgaggaaatggtgaaacattgtgcagagccactgaaggctaagggaagagagaaaacgatcaataagtaaatggatgggtgcactgtggggtggccaaaggcagaggaagaggaaggcaggccactgcttcacctggtggcaaggatcatggaagagcccagaactcttctggactctacctttggttctagagcagattaaaacagcagagaaattgtgtctgtctctccagacaaaaaggatagagaaggctgggtaatcccaaccctttgggaggtcgaggcgggtggatcatgaggtcaggagatcaagaccatcctggccaacatggtgaaaccccgtctctactaaaaatactaaagttagctgggtatgatagtgtgcacctgtagtcccagctactagggaggctgagacaggggaatcgattgaacctgggaggcagaggttgcggtgagccgagatcctgccactgcactccagcctggcaatggagcaagactctgtctcaaaaaaaaaaaaaaaggaagaaagaaaaagggtagagaaagggatagctgctcacactattagtctttactccagttctaattctacatgtattgtcctgagtatttgaagaaaaaaaatttaaatgaccctaatcaagttttatgttactaatgaaaattacactgtaaaatgatacattaagttcagtatattttaaagatacattgaaaacatttatagaactaaaaaaaaaggaattatgttcaatgaatcctcacctagcaaatttaagctttcaaaaaaaaaaaaactaagcttcgtaaactatttaaagcattgcctataatgcttatgatacaaaatttagaaagtcaaacctattctttctggaattgaaaaacccctttccccttcaaaataggatctccggcaggctgcatacgattgaaactgtcagtaaagaaacacaggattggccaggcacagtggctcacgcctgtaatcccagcactttggaaggctgaggcaggtggatcacaaggtcaggagttcaagatgagcctggccaatatggtgaaaccccatctctgctaagaatacaaaaattagccaggcatggtggcgggcgcctgcagtcccagctacttgggaggctgaggcaccagaatcgcttgaacctgggaggcagaggttgcagtgagccgagattgcgccactgaactccagccctgggtgacagagtgagactcttatctaaaaaagaaaaaaaaaagaagaagaagaagaaacacaggattgacataaaggaccaaatccttggaacaaaagtttctccctcacatggtatcacagccactgccttctcactgtgatggttaactctataagacagctaggctggaccatgaggcccagttgtttggccgaacaccagtctagatggtgctgtaaaggtatttttaaaatgtgattaacatttaaatcagtggactctgagtaaagcagattaccctctataatgtgtcatccaatcagctgcaggcctttggagcaaacacagagattttcccaagaggaagaaattctcctcaagactgaaacacggaaacactggctgaggttccagcctgctgctctgtagaaattcacactcacggctgcagcacagctcttagcctgtttccagacttgctggcctcctcaaccacgtgagccagtgccttaaagtcaatcgggcaacctctctctgtctctgtatatgtgtgtttgtgagtgtgtgtgtgtgtgtgtgtgtatgtgcatgcgtgtgtgtcacttaatggaaacacgtgagaaacgtgttgctagttggtttcattgttgtgtgaacatcacagagtggacttacacaaacccatatggtccagcctactacataccaaggctttatgctatagactactgcttccaggccacagactgtacagcatggtactgtacggaatactgtagacaactgtaacacaatgctaaggatttgtgtatctaaacatatctaaacataggaaagctacagtaaaaatatggtattataatcttatgtgaccaccatcatatatgtgggtctgttgtttaccaaaacatccttatatagtgggtgattgtgtatgtagacatgcacacacacacacaaagtggggccatcagaaaacatgttctatgtaaaagttcatgctagaaagaaaccctgtaaagaaagaaacttcctttataatcaatttagatgccaagggatactgtcttgtgctctgcctttgacagagtttggaaatctcatgctgaattgtaatccccaatgctggaggtggggccccgtgggaggtgtttggaccatgggagaggatccctcatgactttgtgctgtcttcatgatagtgagttctagtgagatctggtcatttaaaagtgtgtggctcctccccccacccttactcctgctcttgcaggtgacgcacctgctcccgcttcaccttctgccatgagtgtaaacttcctgaggcccacccagaagctgagcagatgccagcatcatgtgtcctgtacagtctgcagacccatgagccaattaaacctcttttatttataaatcacccagtctcaggtgtttatttattttttgagacagggtcacccaggctggagtggcacgatctcagctcactgcaacctccacctcctgggttcacgtgattctcctgcctcagcctcccgagtagctgggattacaggcaccggccaccatgcccggctgatttttagtagagacagggtttcgccatgtcgtccagcctggtcttgagcccctggcctcaagtgatctgcctgccatgtcctcccaaagtgctgggattacaggcgtgagccaccacacccagcctcaggtgtttctttatagcaatgcaagaacagcctaatacagccttttaacctatgacataggaattgatgacagagggagagagagagagaaaaaaaacagataaacctaaacattctgaaaatgctatcaagggaagcacatctaaaacataaacttaaaatataatacaaaattattcctatattttaaacttacttcaggaaagcaggcttgtagcttagactctgcagacttcaatgctcacactgtggggtcaccagtggcctctcagttgcggaacccaatggtgggctttccctcccctcctccctcatgagtgggcattcacccctgaccaatatggtccttttagaaacactctcttcctgaccccaatcatgaatatgtccccaggtttttctctctaatttatattctttaacacctctgaaatacctgtctgttccaataactctgaaagtcctcctttctagcctggcttcctcctcctcagtggctgcatgcttctctggttgcctgccagacatctccatgaggatttcctgctccctccacaaatccaaacttgacaatgggaaagtgaatgaagtactctctccacaaggccaaggcctcctcatcaaactctgcttctgtcattcattcagtctggttcaaagtcttggatcttccttaacgtccccttcttccttgccaccatatcacatcaagctttgagtcatatccatccacctctcacaagagttcccacaagaactgtccctcctctggcccaggcctcgtggcctcaggctggctctcctgggctggccctggcacactctccagcatctggtctctctcgctccccacccaacccatgtacatccatcttcctaaaacacttcttgcttcatgtcattccccgattcaaaacacttttatctcggtacactctttattttccaggttgacttgaacattcaagtgtcaatcatgctagcactgttagacgtttaagactttaaatttcaagagacaaaactttgaatgtaattcgtcagctctgattgtctcttgcagcatttctctgttttttattttcctttctcctaagccctcctaaaacttaacattctaacattaactaattccagttcaaaattccagcccctaagtcactgaggctgattcccacgttaggagttttaagtcctaatcttgtacaaatgaattgcagcaaactcttcattcacccatcggaaaaacttcactgagcagcagctctgtaccagacactgctgcagaccctggaagcacaacagtgaacaaagcaaaccaggttcttgccttcaacatgcttatagacagggagtcaagaaagtaatatcataaatgtgacatgatcataagtgttttgaagaaaaataaaggtcagtaaaataaaggtacagagcaggtgtcacaggcagtggatgccacttcacatgagttagtctggggagacccgttggtagggatacactccagcagtcctgaatgcaggagggcctgagcctcaggtatctggaggaagagtttgctatgcagtgtgttcagttagtacaaaggcaccaaggggaagtgtgtttggtgagctcaaagtgcatggagaacaatgcacttgacccagtgagagagagagtgctggagagacggccgagtggcagaggaagccagccttcttcattcagggcaatggggaggactctggatttgacccagtctgtgacaagaccacagggccacagaagtgagacagctgactggccctgcgcaaggctcactcctgctgctgtgtggaaggagaccagcaaggagccaggccaaggccgggaggctaaggagaggctgtctcactggtccaggaatgggctgcaggcagagcagtgcaggtggcaaaaagtgggtgaagctggagtccacaagacttgctgtctggtgaggtgtgatactaagagtggagccaagaatgacctcaaagacttggacctgagcaaatggaagaatagtgatgtcattttcagaggtaagggtagaaacttaaggtttggttttgaacaagtctaagatacctgaccgatatggtttggctgtgtccccacccaaatctcatcttgaattgtagcttccagaattcccacctgtcatgggagggacctggtgagaggtaattgcatcatgagggtgggtctttcctatgctgttctcatgatagtgaataagtctcacgagatcttatggttttataaggggaagtttccctgcacaaattctctcttgctgccatgtaagaagtgcctttcaccttctgccatgattgtgaggcctccgcagccacatggaactgtgagtccagtaaacctctttttctttataaattacccagtctcaggtatgtctttatcaacagcatggaaacggactcacacactaactttccatgaaaacactgaatacacagtttaatatatgattcgttgcgttcgggggaaagtaaagtttgcagatcaacttgtgagttatcagtttatagacaaagctgtgggactaagtgggcgaagagagaggttggaggcctgagctttgcagcctcccaacatttagagattgagaggatgaagtggggcagcgaaggacaaaacccaactcaagaagggtcctggggatcaaagacacagttacccaggaaggagggtgcagccagcttcatcacatgctgccaagaggaaattcttagttctctccctcgcataagaaagtctcttagatcagggaatcacgctcaggaaaccacacaaaagtcgaaaatgaaagttttcatgaaggtgtttattccagatgttttcttttttggattagatgttaagatttccattcgctgagtatgttcattctcttatgtttcaacattaacacctccactgtagaaaacatgcagattattgatgttaactctaaaagaaaacttttaaataaatcttcccaaatacaaccatatagaaaattttctgagttaataagtaacaggaaataactatttaaatagcagactttcaataacctaacaaagagagaagatgtttggaatatacaattttttgaaagggataattatttcttctcgacagaaaacactttccaatctttcacagcttacctaaaataccacggctgaaactattaatgtgttaggaaagaagactttcttaccattcaggattaagagagaaggtaaaaggcactttgcgatttccctccctggtgcggctcactttcactcctacccacagtggtgagaaggggaaagcgaggtggggcggcggggggaagttgaaggagctggggatggggtggacagggacagttaacaaacacaaagggtcattccagagggtcctatctggagcatcagggacgggctcagtagcccttctgggtccttctggacctaaggatttatgacacgggcttagtttagatgtctgtaattttagaagagaagcaacacttcagatggtgacccagacttgcccctggaaaagccagagttcagaggcaggagaaaatgatattcactgacctctttcacatctctaaatctgtcctttctgacaggcaggattgcaagtccaggtcacttcccattggttcgaaaactacccaattgccttaggtgcacaaagaagttttaattgcggctttatttaaaattcaagttatagggatgctttattgcttttatacaaaacattaactatttgttgaaggtctcacaatgtaacataatctgtatgtaacatacaggcataagccaccacacgtggccctgttatttccatcagaaaactaaggcctgatgtattttaaatgcatattctattaatgatatattttgtttctattttgtttctattagtacataatttcccgcaagtatactgttcaacaatcaccatgccatatgattaattcttagaaagcaaatgggaactaaataaagatgatgccagatgggcctaaatatccaaaagctgcctagggctatcacagaaatcacagaagatgtaattccacactatcagatggagcacgacacagacaccaagctctgtggatgccctgctgcacccaagctgccgtgacttgggggaagagggacaaacagcctgggaagtgggagtgtcacctccagctgctggcagagcagagtaatcaaacaccacacaaaacacccagtttacaaacggcagggattttcattttcattttctagccagagacctgtccatactttaaggtgttaaatggcatatcactaaatatctttattttccagcacaaccactgtttctaaaactctgcaacaggcaactgtacctatcagagcaagactctgaacctagaattcatctgaatgaaatctgagaagccgcattacctatcaccaagtccaacccataaagctgaagccacttactggcaaagttgcctctgtcttgcatttgaaagcaatttattcttactttacacataattgtgacaccttggggcttacctggaatataaaccaatgccagggtacatcaggatgacaaacaaaaatgcctgtgaattatagtaaccttaaatgatgagaatttaaaagatatcataaacttaaaccatgagaaattaacagaataatgcacagtacaactccaggatcggcttgcctgggttttgaaattcggtgtgcactcaggccaatctacttaatttctctgacatgtattttcttaaatattcaatggagataatagttattaccacctcacaaggatgtactgaggcttaaataaaataatccaggcaaaaggcttagcacagtgcctaaaatagagcgagcatgcactaatgtgatagttcttttcttttctctttttttttcagaggtagagtcttgctctgctgcctaggctagagggcagtgacacgatcacatagctcaatgtagactcaaactcctggtctcaagatatcctctagcctgagcctcctaagtagctgggactacaggcacatgccaccacacccggcaattatttttattttttaatatttttgtagagatagggtctcgatatccaggctcgcctcaagtgattctcttgcctcaacctcccaaagcgctggcattacaggcttgagccactgcacatggccctgttatttccatcagaaaaagaatacctgatattaacttgttctgatttggaagtcagagaggcacacataattcttaaacaaaattttaatttcaacccaaaatggttaatttttaaagtgtagtgctttgagtgaaattcactatacactaatctaaacctccagatttatagataattgagattttgtgatagcattttttcatataaaaaatgaattataatgcctgaatatttgaaatgctgaggttttttaaaatttagatattgaaaagaccctttaattatcagagggcaacagatccatgcatttaaaagctaagacttttgttacagttgtcagaatccttaatatcatgatttttatgggttttttttttaatacagagataaatgacttcacactatttcaggatttttgatgtgcgagtgggtagatggtgtgggaggatataatgactaagagttgaagaaaaacttttgaagagttcctaagtgttggaaaagtttagctgtgccgtgtgtgaggagaaaatccctatatgaagttcagcagcagcgagctcagagggataggaccaaatcaagtaacactcattacgctttctttgttcttcttagatatcccagtgggacagaattagaattccagaaaatagtgtaccaatccaaggtatgacttcaacagcatacagctaaggttctacagaaaacactttttcacctaactgcagcttcttaatatcatcatactgcatttatacagccagaaaagaagccgtttgaatgacattttcaaatgtaaactcttttgttttgttaattagatatagtttataaactgtccaagtagagaatgaaggaatattaacaaccttttttttttttttttttttttaaaacagggtctcactttgtcacccaggctggagtgcaggagtgcgatggtgccgtctcggctcactgaaacctccacctgccaggctcaagccatcttcccaccccagcctcccgagtagttaggatgacaagtgcacgccaccacacccggctaatttttgtattttttgtggagacaagttttcaccatattgcccaggctggtcttcaactcgtgggctcaggtgatctgcctgcctcagcctcccacagtgctgggattacaggcatcagccaccacacgcagccttaaaaactactttcaattagcctagtttgagttatgaatttttgtttttttttaattaaagaacagtagagaattttagtcagctgaggagtagcaatcgctctcaattaaaaacaagaataaattgataccatattaaattatttttactgtactagttttgttgtggtttcaattaaacaccattgtcaacagaaaaatctcatccacaattagaaaaaatcatataggggccaggcacagtggctctcgcctgtaatcccagcactttgggaggctgagacgggtgaactgcactgagctcaggagtttaagaccagcctgcgcaacatgatgaaaccctgtctctataaaaatacaaaaattagccaggcgtggtagcatgcacctctaatcccagctacccaggaggttcaggctggacaatcacttgagccagggaagcggagattgaagtaagccaagattgcaccactgcactccagcctgggtgacagagtgagaccctgtctcaatttaaacaaacaaaaaactgtatatagaaacacttatcatccacacttcaaattccctgaaagcttcataacttcaatataaaagcagagaattcaagcatggttatttcaacactgatctgaatgcatttaaaaactgcaattatgtcaaaaaaagattttagaaatcccataccatttaaaagtagagagacttgatggactcatgcaaacttgtctccggggtagagacaaggctcgtctcagacttactcagcattgtttacttagtacctttattctgaccaccatggcttatgctggtaggacacggcatatttggaaaagaaaaatatttgcactgtaaattcttggagatacatatatttggcattctgctgtttagatataaatgggggaaaagtgaagtaacctcacaaaaaaaacatgatgatggcagcctggaaaaagatcaaaggtctaagcccttttgacttactcagagcctctgagtaggaaacatagagaataaaggaaatattagagagactgaacaaaacgggcagctcctctagaatcggctggatggaatgctcgcttgctctaaggccaaagctctgcctggctttcctgcaaatcagcccagtgtagtgaattttattttaacaataaactaaatgtcaggtgccaaaaacaactagaattattgttttcctgtgcagttgtgtatatagccagctattttcttttcataaaatgaagaaatgtctaatttcaacttaaccatgtggcattttgcattgctctctgttcagaacaatattgaagaaataggttaatcttattcaatttcatatgttattaagattatcactttggtctaggattcaatccacaatctttaaagaacaggactgataacaattgcaaatgacatgatattaattttaacctgtctcagtgagaattgttatacacacacgtatgtatacaacaattgttatacataattgttacatgcgtataaaataaaccatttttaaagaaaagtaactgaagttgctaggtccaaataaacattcacatcatcctcagcatctatcctgagagtagaggtgggggcatcaagatatccatccccttagcattttctaagtgagacaatttggacaaaagtaaactgtaatcagtgatttcctccaaaaatgaaatgctaagttatctacattactacagattcagtaaaattagtatgtcattatttgtatgtctgaattaaagagtttcaacatttttattacatggttaaatttgtcattgcagaataaatggataaataacatcattatacgaataaatcagaactctcagtaattaccaagagtaaagggtagagaaacaaggttgccaaacctgtgcagtatgctacagatgcccatcagatattctatctcatataaaacgtaagtttaacagaaatactcttaaacacacaaaaatggaaaataaacgaccacccaaagatagtgcctattcctcaaggtgacagtgacataactgaaaaatattgttttaaagatactgagtctaggccaggcatggtggctcatgcctgtaatcccagcactttgggaggccaaggtgggtggatcacctgaggtcaggagtttgagaccagcctgaccaacatggtgaaactctgcctttactaaatacaaaaaattagccaggcatggtggcacatgcctgtaatttcagctacttgggaggctgaggcaggagaatcacttgaacccaggaggcggaggttgcagtgagccaagattgcgccactgcactccagcctgagtgataagagggagagtccatctcaaaaaaaaaaaaaaaaaaaaaagatactgagtctgagattacaggaaacggaatgaacaccacccttcaccaggaggaagccacagaagccgtcttggtcttgaatcataggaaattaaattctagtttgagcttcaagctgttaagaaagctcaggtatgagactgtgacagcaaacatcaaataacagccacacagaaaacccctgaggacaaacagtgagaccttctctctccactgagaagtttctttaggctgtaatctctaccaacatcttagacttcagggaatcattgtgaaatgcactgttttgagcatgagatgcctgaaaaagcagagctatgctctgaatcctaccaggcaacaagcagctgggagaacaggacttactgcaatccctgcagttcaaaataatctaacaaaaaaagagactatgactttgatccacaaattggtaaatcttggtcagcgaatttctgccccaatgatacaaccatgaggggtgaagcggccgtggagaaaccagatcacaacagaccagtcgaatccaatacctttcatcacaagtatgggaatgagtgttcctttgggcacatgaacttctcagggaacaccagctacaggacatttcctactgacatctgtgggagatcattttgcctattagagctgtatacccaagaattacgcagatttgccaagatgggatcccagttctagctgaaattcacaaggcgtccctcccaatggagggggcatgattaaagcatcaccatcacctgtgtatttttcagcaactcaatatgctggaagagattccttcacaacttctggaaatagcataccatacttctgagaagaaagaaaagtcaccgtgtcaaaaaaaaaaaagaaaagaaaaaagaaaaaaaagaaacagcttttgatcttggtctgattgtaactctgcagaatagagcaaatgcctttggtttagacatctataagatgtagactgacttctctacatcaaaaccaagacactatgcagctttacatttttaaatcttcaaggagaggcttaaggcatcaaggagagattcaagaatcaataataaaggggcacaggttggcacacccattcagttcatgtccctgaaatgtggctcagaagcggccactttaagtgatctctagtaaagatatcctatacattaacttttctttacctatacattaacttttctttatagctacagaaattacagagtagaaaaaaactgtaaaaccccctcggaagggagaaagaagatggaataattgaggggaaaaatgaaatcaaatagcaaacatttcaaaacccaacatttatgtcttcaaaggaaacagggaaaggtcgtctggaggagtattagagaacaggaatagtctataatacatttttatttcattttattatgtttttgagacagagtctcactcaggtcacccaggctggagtgcggtggcacgatctcagctcactgcaacctctacctcccaggttcaagcaattctcatgcctcagcctcccgagcagctgggactacaggtgtgcaccaccacgccgggctaatttttttttttttcgtatttttatagagatgaggtttcaccatgttggccaggctggtcttgagaataattttatttttaaaaaattcctatttttccataatagatatttttgaagtgatatatataacctgaatccttataaattcaaatgtaaacagactcatagggtctgctatttaagaaagtcctatcagaaaaacaattcttttttttccaaagtgtgtaatctcctgagtggttctgaaagtcaagagtgcaacagaatcacctcgcgatgactgacaagctgcgggcccctccctcacggcttctgtttcagtgcgtctggggtagggcccaggaatttgcgtttttagtataatttcaggccatgtgctttgagaatcaatgcctccgatcagcggatctgcagggtttgtggaatgcatgtgtctgcagcggtgcccactgaagatcgtgtgtgtgtgtgtggagcgtcatgggttgttgaggagtgtgcggagtgtatctgttggtttcttgagagaacagggcacagctgggagagtgagcctgggctttctaggagaaacctcaagctgaacctgagtcctgcaactttattagctgtgtggctggttccccttatgtaaaacaaaggtaacacactcaggattgtattcgataccaaataaatgaagattacttacctcaccttgttccagagaacatttaagaaagttttcaaatatacacaaactacagcgagacaaagatagcatgcattaaactgaaatgaaaaagaagaaagcaaacaagaggtagggaagtaaaacagaagcaggaaaggagataacacaaaacacacgccacaaaagtgacacacaggctacggagaagccataaatttgactgtaaactgacaaggtgaaaatttgaactcgtagtttacaaaactcagtgcccacagaaagaaagtaaccacttgttctggaaaaacagaacggtactcctggtactaagacaatgtgcacgtgccccaagtgtcagtctttcctaacaaactttctgtagacacaatctcattctgatgtccccagaacccatgcttcacactggctagttccacatggcatggtccaggtggctccatgggtccctggcctgtgttcatttaagcatttatatagcgaccatcgctctatgttgcctgggaagtggttggactactactcctccaggttgccaatgaaataaagatccatttgccttaatcaataattaagaggggaggtagaggggacattcctttagtaaattgagtgggcaactcacactcctagtagcagtcacttcactaagactgagaggcagcctaagggcttcctttaggtaggcgcagtattctccgtggaaaaatgtttggaatcactctaattgagagatgatcaggcaagtatgatcccaaaataaaatagcattaaaaggtacgtgcctaacatagagattggattgataaaaggcatcagaaaaggttaatatctcccaaaggaatattatttgttatttcattggtgggggtagtggttattatttttcattttgtaagactgaataccagcaccagtttagtcttggcacaggcaaaatgtcagagatggggtttgtcttcatggtgcaagtcaagtggggtgtgagtgtgtgtgtgtgtgggtgtgtgtgcatgcacgcgtgcacgaccatcacagcggatttggaattacgctatccaagcaaacaagtgggtactttagagtatatctacttttaacttattccaaagagatttgtggcaaatctaaacattttcttagctatgaattctataaaatttattcagaggtttcaaataagtacttaagacagtttcacgtacatacaaatcaatgaacagacctacacaaatcaatagactatcgtaaacacagcgtgaactttggttttagtaacatacaccatttggggcatacaagaataaaggtacctttaataacgattagagaaaaattattaataaaaaatagaggtagacatatcttgtttgatagaaacagaagattccattctcttaatagaaaaatattatatactgcaccattacagtaagctgcctgtatgcagtgtttcaaagaataacatttaaaataactgcaaatatcacaagctaagtgttatcattatgtaagcattttactgtaataggagccattcccatgacctctgggaaatcccttagctcttgttttatttttataccaatttcaaatgcataattctatctgtaaacagacatttacatttacatggttcccctcttgtttgcctaggacatatgatgcatattatcaaaggaatcccctacttcctattcctgggttagggtaaaccctgggaagtagacctcaagtgctcacctcaacacactttatcccattagcaaacacacagctagttcactggctatgtgaaaaggaaatccctcccatacacacacacacacacaaacactcttcaaaataaagttacaataattttcctaggagcaaaattgaagtagaaatattgaaatatgacttgccaagttacatttatgaaatgcatattctactcatgtagaattttgagaatcaatcatttaaaagaagaactccaattttattacaatttacagcttttcaaaaaaccttcacaaggaaaaatgcaggcaaaaccagcccttacaggaaacctcacattccagacgttccacaggctgaggccccaactgtatccccaagaacagctgctgtctgttcccctccagcttcccaccctaaatgcaatacttacggttcacaaaaggacatttgccacgcaagctattattttgcaaaaactggatagactgtttatgcatctgcccgaacacatttgtgaagtactaattggaggtgcagaaatgaggctccttttgatgccctgtgtttgcttgtgtcaggcatctttccatctgctgtagaaatgctctgcctaggtccagccacccctcacctcggaagggcaagtcacttaacacctcaaagccacttttagtatctgtaaaataaagggatctcaatagcctgcctctctaacaagactgccatgacccacctgagacgattcatgtgaaaattgtcagactgtaaatgaaatcatcatggaaatgaaagagcagctcatatgtattcagcccactgtcctacacacctattatttaattaatttaaccctttggactgcttgatgaacaagggtactattattttcatcccatgttataaatgaactgaggcaaaaaggatagttatgcaataaacttctcacagactataagagatgggaccaggatttgcagctagctagggtgaccccaggaccgatgcacttaaccagcttgctcagtggaacggcaaagaatcacagatcaaggctgaagcaataaaaaacaatcaaaacaaccaccaccacctataccatactaggatgtggcttccagaatgtggccctgattctgtcaccgcacacatgtcctgccagaaaagccactgcaccacccaggccctgcctaggtgtccttaacgtgcaaggtttgtacctgactgaatgacggtgtccagctttatggcggacgggtaacacacacaagactgcggaaaatttttcacatttggcatggaaaaagagaaagactacacatgcagtcaaaattcattccatacattctggagaacgtcctgtgtgtcgggcagcataacagggtcacaaaaacaaaaccccactttgtttccaggcatcatgttaagtggcaaaaggttctgcgtcaatagtgcaagcttcttctcatccaaggatcggaaaaagaaaggcaaggacaggggtcatcgacccaggacccaagtttccccggcacaggcggggcgcgtcctcccagatttgtactcaagactttacggagctatcacggaattctctgtggaatgatatttacaataagggcagaacgccaaagcagaaggcaaaatctggcttgattttccccagagccaaaagataatttctcaaaatatgccttgtctttatctcttgaaatgagaaaacgctttgtagccttcattcaccacaatcccatctcccataggtttttattccatttcccatctcctcctttcctccagccagccctcgcctgccgttagcagatgttgtcagtaacatctctttttaaatgggtcagaaattctctgtgctgggtgaaagaggccaactcaacatggtatctaatcagattcaaagattatgcctttgtgaaatgcctcattggaaagcctcttacttcccaccaccctccccccaccaaaaaagaaaagaaaaagtattttaaccctttctgtttggcgatgattctactatgcaacacattcaccttcctttttattttcactttatacttcagataacttttaaagcacagtaagagtcaaaactaaacgcaaataaaagccaactacaaatggagttaacaaagaggaaggacgagaaggaaggcaagagacagagagagagggtggaaggagtcgttttatatcaaagcaaatatagctttaaaataaaaatgatttaattttcttataccaattcttgccattgtgttgtgttctgaaaggacgcatgtaatacacattcctgtcttcagaccatctaatttgcactggtttttgagctagaacattcaaactttatattttatattgccacatcactacacagataaatgcaaagaaaataaaattttaaaaaaggatatactatgaaatcttaaacttcatcattaaaatatatactaaccaaaactggtaaaagttaagttcgtcatcccaaggttaagtcgcccacacaacacccacattgcataataagctatgtatttagttgcctacctagcaatctaaaatagattattcaaacaacaatagaaagttaactactatactaagggaaaactagagtctttaagaacctagaacacacaattaccactcaaacattatataacaataaggcttattaacatttacattctgtgtcctccagattttgtaatgacgccctaacaatgctgatttttatagtctacaaagtaccttcacattcattatttcatctttatcctgaccaaatgggagggaagaaggaagggagggaaggaaggagggagggagggagggagacagagagagagagagaggaaggcaggaaggaaggaaagcaggcaggcggcaggaaggaaggaagctagctggctgtgtgatagtaaaattaccaccattttacagattagggagacattcaaaagttaaacaatttgcctaggagtccacaaccaatgtatggaggaaccaaattcaaactagtcaatattcaaactccagtcaattgactgcaagcgtcacattcattacatcacacccagaaaccttgtttttcagctttctgttgagacttttcatccttcccttcatttgcacaatttaaaactcagagattagttttatttttaaagaaagccatacctattataattctcaactgcaaaaaaaatcaagataaaaaatgaagagagggcaggatgcagtggctcacacctgtaatcccagcactttgggaggctgaggcatgtggatcacctgaggtcaggagttcaagaccagcctggccaacatggcaaaatcccatctctactaaaaatacaaaaaatcagccaggcatggtgatggatgcctgtaatcccagctacttgggaggctgaagcaagagaattccttgaacatgagtggtagaggttacaaggagccgaggttgcaccattgcactccagcctaggcaacagagcaagactctgtcccaaaaaaaaaaaaaaaaaaaagagagagagacataaaaatcaatctatggccaggtggagtggctcacgcctgtaatcccaacactttgggaggccaaggagggaggactgcttgagcccaggagttcttgaccagtctgggcaacatagggagaccttgtcttctatagagaattttaaaaatgagccaggtgtggtggtgcacacctgtggtcccgacgactcaggaggctcaggcaggatgatcacctgagcccaggaggttgaggctgcagtgagctgtgatcgcaccactgcactcaagcctgggccatggagcaagattctgtcaccagaaaaaaaaaaaaaaatctatacaaccttgaatcgactaaaggtctttaagttgcatgcatgtaactctttcccattagggtataggaaatgcagacttaattaatgtgaaatttttaactgctgaaaggctttcaaaacataaagattctaatggtttctatttaccagtgttttaaaaattttttaaaaattgcctgcctttctgtttctgtttacttattagatacatattaaaattttttttaccattttcaaatcacctatcacaatacattatttattcagcaaacaggtatattaaacaagtatattcttggtctgcaaagtttaaaagtaaaaatttcatgttactttatcagcaagattacaaaatttaaataagcttactcaggtaactccaaaatgggaaagaaaacagttaacattttggctcaaagaaaatgaacataaaaattaagaagagctcttatgtaataacctgttattcacacactgttacagaccattagccattaataagtgctgcagtgttcctctacctcttcccttctaaaccttcctgttcagaaacgcggaaaccacaacatattcctatctggatgtcaagtgatttcaaatgaagtctgataaactaagcgatgttgttgctagaagatacaaatttaaataaaacacagattatgtaaacagtagtttataaatttgtttataaaattacttatgaaaatggtttacataattggccaagaataatataactcatctattaataagaagtatgataattttgcattggctgttactttgtcctcagccagcacctaccaggaaatattcagaatagttgcacacagaacaaatatcacttgtctgatgtcactatatagtgtccatgcagtcagaagaggtgtcttaaatcggtgacctcagcacttggccgtggccagcccttcagctccttcccatcttcaaggcaagctgatcacagcaacatggctgtctgcttcacctgaccacagaagagggatggacccaagagactgaatagaggaggatggccaggctttctgagcagacacgtgggggccagtaaggggtgactgacgcccagaggtcaacaaagaaaaaaaaatgttaaaagtcataagaaaggtttttttaaatcttttatttatctttagaaagacaaataaaaatacctagaaatatgaggtagttaactaattatagcagcaaacagaactgtaaacctcaagagtcctttaaaatacatttctctactataaaacaataataactgatgctcataaaaaggtaaaatatcagatgcacaacactatatctaagaagagaaggcatcacacatgttttaaaggttgatgtctgaactaactgaaatcactaaaaacaggtgctttaaaagttacacttcagtaatctggcaaatgcttccccagcaatgctggctctcagaggcagaggtggtgcctcacccatgataacccacagtcagagcgggcactggccactcagctaatattggcaaatattatttagagtgccttgggggcaggccctccactgagaccctgagcacagctaaggcaaagcagcctggctcctccctcactgcacccaccgtgtggtgattcaagtctgttcctagatgccctagatgttcctgagcctcactttgcttaggattcctcttcggactgttatgagaaccaaggaagatgaggaatagaaagcaatctttgaaacagaacacggtcccgtctctggcaagcggtgtttcggttcatctcaactctccagccaccctgtacctcccacggcagccccgcagcctctgtcctgcaggccaccagctggagtggcagaggcgtggctggtaggaatctggtttcctttgacgcccattcggggcgtggaatcatgaacgtgtgtgtgtgtgtgatgtgctcatttcatcgggggtgtaacttactgctttgactctgggaaggtggaataccatgattctggaaagccacgcctgcagttaaagatgtctcctacccttcaggtctctgcacaagctgcccctccgccagaaacacctgctctcccacagccccacatccataggggctaacacagtcttttccttctcctctgtctcttccttggggagatgtccctagatgccccggatgaatgtggcttcccgtgcatatgtgtctagcatgatacgtttgttcaggtcggccttggccacgaggcacaggctccctgaggtcatggacgtccatctgtgcaccaccctatcgacacataggaggcactcaacaaaggactcaggctgtatttaggagggacacagccacattaacgtggaattaaaataaagaaaatataatcaattgcagagattttagaggggtagtgctctgcaaagcactgaggtgtatatagccccacataatcattctggttacaacagtggtacggactggttggaagttgaaagactagcccctggaatcctctctgatcttgctgaggagacttgtaagacagatctcaagtaaaaccatttgtagtccttatgcctgttggctgtaccagtccggcctttatgctttcagacactctcaggtgggtgaacgctacacagcctaggtaattcgctcacatccagcctgttaattcagctctaaagagccctttgcattcactcgctctcttgcggcatacctgccaaagaacgtgcgtcccatcacacatttttaagttgccatataaaaattgtatcacaagtttaaatagttgtgaatgatgtatgttctcacatttttttttttacggcaaatatgcctcatacatatttttgtcaaaacctggagctgaggaatagttcactcagtccatggaccctgtccaccaaacaaccttcctggaaagccattctccagtggcaagtcaaatagctcaatcagacctaatttctgtctgaaaaggttattttataatttaaatacatcatctaacttgcatccctgtaacaatttctcatttctgaattatagttctaagatagatgggaggacggatggtgggtagatgtatgggtggatgcataggtaggtgggtggatggatagataggtgagtgagtgggtgggtgggtggatggatggatggatggatggagagacgagcagacagacagatgaacggatgggtgtacagatgtatggacagatgagtatgtggatggagccttgccatgggtttgctgacttagtgaaataaagagtctcccacattcacagatgctctccttagtttgttctccccaaactctgccctaggaacagagccttttcagattgtcccatcgtttagtaccccagagatttttacatgctggggcaatgagccatagtaaggctctgaagaagaaagggctatccctttcttcttttggaaatcggagaaagtcagtcgtgaaaacagataagtgaaataagccaggcacagaaagacaaatactgaatgacctcgcttatatttggaacttttaaaagaattcattgaagtagagaacagaacggtggtcaccagaggctgggacaggcagggatggggaaaagaaagatcttggtcaaagcatacagtttccatcagacaggaggaataagctttagctatccattgcacagcatggttaccatggttaataatgacatcttatacatttagaaattgttagaagaatagatttttacatgttcaaaaaacaatgataagtgggttaagtgatagatatgttaattcacctgatttaatcattccacaatgtatgcatacatcaaagaatcacactgtacttcataaacatatgccattactagtcaattaaaaaatatatttttaaaagaaagctgaaaagtacgactggcagacctgttgtcaggtagacatcctcagaaaaattcattttttttctgttttttgagacagagtctccctctgtcgcccaggctggagtgcagtggcgtgatcttggctcactgcaagctccgcctcccgggttcatgccattgtcctgcctcagcctcctgggcagctgggactacaggcgcccgccaccacgccccgctaatttttttttgtatttttagtagagaacggggtttcaccgtgtgttagccaggatggtctcgatctcctgacctcgtgatctgccggcctcggcctcccaaagtgctgggattacaggcatgagccaccatgcccggccagaaaagttcatttttaagagtctccgtgaagatttctttaagtgatctttgcccatgcatcctcttggaagtgggtgtgcccataggaagcagcctgggagaaaccaccagcacctttcttcacatgtacaatgcccagaggtaagggcaacaggcaggaattgtggaagtacctgtcacccagggaaggtgaagggagacgccaaatgtgtaggatctcttgaaattccaattcttgatcacccgtcttctaactggcactcacaacatatacgtatattgaaacatcacactgcatgtacttcatcaacacaggcacctaaacacagcgtattctatgaaaacccccgtatgaaatgactgtcttagaacaggggtagccttcccctgtggaaggccagatggcacgtgtttcagactttgtcagccctgctgtctccctggcacttgcccacttctgccactgcagctcagaagcatggacggtcatgagcaaggccagggcaagcgtgattgtctggatttacgttgatctccaggaaatctgggaactttaaaaattaatgagtgctttttaaaaaatcatacacctcagacttggaaagtagaataaagaacataaacgtcaccctaattgtgttagtagcagaagcctctggcgcttggtaccacatcctctcagcctgcttctggtttctgccacagcagtggtggcctgtgcctagtgaggtcagtctctcctgaagtggtggatcctacttcaggcgcacatctgagccttgctgctttcatccagcacccctgccagggccaggagagcccactcgatttccaaaagaagcatctgggagtgcacagcgagggtgcggctgccttctgtcctcctgagcgggggcctgctggaaccagtaactcgccttttactggctctcccttcttgcccctgaccccttgcttcactccctactcctgcctgctgcagtcacctctcaaatgaaccacctgtccttatctcaggctctgtgggcaaggaaacccaaatagaaaactggagttcacagacgtctttcttcaagggaaactgagtacttcagagaaccagtggaatcagaagtaagtccttagggtgagtttacagacacgcaagcacattaaatctggcaaaacctacacagttgttgactgagatctcctgaaaagtttacttcctggctgggcgcggtgtctcacgcctgtaatcccagcactttgggaggctgaggtgggcagattacctgaggtgaggagttcgagaccagcctgaccaatatggtgaaaccctatctctactaaaaatacaaaaattagctgggtttggtggtgtgcacctgtaatcccagctactagggaggctgagacaggagaattgcttgaacctgggaggcagaggttgcagtgagctaagatcatgccactgtactctagcctgggcagcagagcaagactccatctcaaaaaaaaaaaaaaaagtttacttcctttagccaactactaatatccaccaaaacaactgctaaatttgactacaaatagtttcacatattcctccacttgaggacaatgcccttatataaggtaggaaacaagtataaagggaggcaaaataacccagcaagacaaacagcaggtcaaatcctaaaataggagcatgcttgagccttctcaggaaaatgggccagcctggcacagaccagggaacagttccacggcagcatcaggaacgcgagggcaaaggcctcactgcagctctgtccccaccccggagtgcaaggacgttcatttatagaccttgtcatgaagtcacagcctcttttaaaaatcaaaagcaacatttgaaggatttctggaaacggctctccattttcttgtctctttttatgttgaaaacctaggtggagcctatcatacttgaaatcaaaactgattataaatatgtaaggtgggcaattcaagaaaattccaaagtattatgacctaaaacaagcctgcaatttcttctgtgcaggaaaaagtatttaatgaactattcaataaactgacatttgttgaacatccattttacagatgagaaaattagagtgctgagaaattacacagagctgagatttgagaccaagtcttgctccaaaatacacgtctccaagtgtcccacactgcttctcatgaccccttcattcagcacgcgctcagtgattcctgcagggcactgctagtcatctgagatggacagcagaactcaagcttatgatgtcgaggaaagacaggcgagcaggagtcaacagcggcatcgccacccacctgctcccctgctgctccaaacacagttccgggatgagaaggagcacctggccacagctgcacaatggacgcctgcctggaaggtctttgaatgtttatgaaatatgacctactgagagacagaagccaaccatttttgagaagtacacatgcccatccgacagtattaaacaattccagatatatcgtaacatataaaagtgtaattcctcaaattatttgcagaatttttaattaaaattagataaagccttgatagctttgtttcagataaaggcaaaccagacgtagaggctgtgtaaaggcatttgacacacagcactctcaaaatgtacccataaggagatcattgctcatgatgggcacattctcacctttcttcaagttagagtaaattaaattacaaaagaaaactgtgatgcatgtacaggactaagtccacacacagagttaagaatacagaccaacaatctacaaaagtctagagtaaacaaccagtcacagagggaaaccatacaaagcaaatataagctacagtgtccatggcagagagggatggtgtcctggacaggctccaggctcacctaaggccactctgcccccggagctgccagcggcagggccttcccactcaaccccagcagcaggagacccaacagcatcgttctgcttttagacaggaccgagtgaaggcgaaacgctcagagacaggagagggcagaggtgaattcttttggaggtgcagaagtcccataaatggggaatgggactacaatagcctttcaaaaaatagcttcccctaaatggaagaagcattctaatgacaatcccctttttttttttagttctttttccaaaaattcttcccttttatttgcaacacattttcctttaatttcttgccaagaaagtggaattgcttgcggactccagccatttcctgatatcagcgtttccagaagctgaacttcctgcaactacaaagaaacacctttcccagccaaatggatgctctcagcagcctttctcttcctttcccgactgaagcccctttggacgtcacttgcagagactgccttttcggaaaagactgtctcagaacccaaggaaacaatggctacgtgtctcagcacttgctctcctgaaggcactattgcaaacacttgctatatattatctcatttaatcttcaccacaatcttaacgactgtagcaaaagaaacaactacaacgcaggggctcgtaattaagcactctaggttacagtgcctccttggtgtttgtttaacaaatacaggcacacacacatttgtttttcttttttcttttttttgagacggagtctcgctctgtcgcccaggctggagtgcagtgtgcaatcttggctcactgcaagctccacctctcgggttcacgccattctcctgcctcagcctcccgagtagctgggactataggcgcccaccaccacgcccagctaattttttgtatttttagtagagacggggtttcaccatattagccaggatggtctcgatctcctgacctcgtgatccacccacctcggcctcccaaagtgctgggattacaggggtgacccaccacgcccggccttacatatgcatttcttaacacatcagaccatccactgtttcttactgagaagtcataaagcacaagaaaattactgacacaggccagcaggatatcgattaaaaaaagaaaaaaaaaagagcaagagtgaattacatctctttctatacacgtgccctctctgaagctgatctccacctaataataatggcatttggaaaacgtttaggtcacccccaaacctactactgaatgccttattctatcagccatacgcagtactttccaccagactgcaacccagatacaagaagtcacaacaattttgaatcacaaacattttgctgaaatacattcaaaaatggaccaacacaaaacaaagaaaattcaaaaatcatacaggaaaaaaatggacagatttcctaacgatggccctcacaaaaggaacagaacagttacacaatacagagtgccaaaactctgcacgcacagtcagatcgcctgagaaatgaaattaaactagggcagtaatattattcacaaagaataacctttcacacaaaggcattccgggtggcttgcaaagcccctgaaggatttaagtgctccacagagtgaaaggaccgtgcagccaccttctcctcacccatccccatccttgtccccatcccaggagccactcccagaaaaagagagcaatcgccaccagggttttccccagaacagtctcctgtgagaaaggggtgccctgcagaaagagaactaggtgagtgcacactgacaggcccgtacctttcagagacttgggtgtgctccacgggttacctgaagagatctcacgaggagcttgcagctccaaggagaagcttgcaaggggagtgaagatggaggtttaaaggtcaggaaagggttctcataaaatccagtaacttggaaggaagtagcagctaaaataaaaccaagcagcggactagaaggaaataatattaagtgataagacaaagaaagctgtcaccactagaagcagagcacaggaaaataagcaggatgatatccaaaccaagggggaagagtcagtgaggggacagcaaagaggcccactgagacactcccagagacagcatgagctctaaaccccaaggaaaaccagggcggagggcaaacacgggaatctaaataattcaagtgtccccatgaaggcccagccagagggaaggctttgtccctctggccctgggcagaaagctctcccagggcagagttctggtcagcctagacccctagccccggtatacagcagctcccactctgccctgcaaagctgctgaggaagaggtgcaggggtgcccactgcccctgctgtccagtcaactaatcaaatccctgtcacaacagaataacttgtaataaattgctggggccccctttagtggtgtcattaaatgtcaatgtcacttgaggctacatttgcactcactggagaagcgctagtatctaaagctcatgtttctacaacaaggcatctggtttctttctaaaaagtagtgatttctaccagatgaaactggctgggcagctctccagtggtttaaacgatagttcacatcttaagcatgaaaccatcaattgcatcagtcagaaactgtattaaaatagaagtgatgctttccacgttcaaatctgtgcatgacgtcagaaaagagctgataagataaccacaaggggtagtgatgcgtgcaatttttttaatattcatcgtttgacattttgggatcttgtgtaggagaagtgggaggccagaggaagacagaaatcgatcaaattttaggggctgacaaatgaaaccatgatcccaggaggaagaccataaaaacatgaccccctaatgaacacgtgaacagcaaagtaaggcaattcaccgttaattcaatgccacttcggtaccttcttgctaattctgaaatttaatttttgaatgggagataagttatattattcaaaaatcaaaatgtataaaacggggtaacactgaaaagtctccccacaactctggttttccatcccccaggaccccttctcccctccacctccctttaccgcccagcaagtgttacataaacagtttcttgtgtttcttcccagtttctttacgcaatcacaaatacaagtatatgcttttattgtcctttctaacataaaaatgtatctgagtgtgtgtgtatgttgtttacaccttgcttttttcacataacggtgtatctcgaagatcttctggacattcgtttacactgctgcaaatgttatttaaccaagcgcccactcgtagacaggccattagatggtttccaatgtcctatttcaaacaatactacgccatattcatatcttgttaagtcactttgcctatgtgtgagtatgtctgagtaataaatatctagaagcagaattactgactcaatggttacatgcatttttttttttttgtcgccaggttggagtgcagtggtgtgatctcagctcactgcaacctccaccccctgggttcaagcgattctcctgcctcagcctccccagtagctgggactacaggtgtgtgccaccgcacccagctactttttgtatttttagtagaaatgggttttcaccatgttggccaggatggtcttgagctcttgacctcgtgatccacccacctcggcctcccaaagtgctgggattataggcgtgagccaccacgcccagccaacatgcatttttaatattgatggatactgccaaattgccttcctcggtagctacaccacttgatactcccaccaggaaagtacagaagcacctgcctcctcgtggacttgccaacagtgtgttatgaagtttatgaatatttgcaaatgtcacaggtgccattttcacaggtgttattttcaattgcatgtctcttaccatgaataaggctgagcatcttttcatgttttcaaagagccatttacttcccttccgttgtgatttgtcttgttcatctcctttgactattttttatcaggctgttcttttttttagtcatgtccaagagctctttgcttaatcatttctaggaactctttatatattaagaaggttagcactatgctgtgataggagctttaagtgttttctctagggccacaattcaagaactacagggagttgttaacatggtgttggagcttctggcatgctatgggacatggagaaagataggtggagaggtaggagaggcaccagggcctcaacaggaacatgctaagacctggcttacaggatttggggcaataccaaggtgtttcattgtgttttttgaatgtggattaacttatcaatcttttctttacttctggtttttgagtcccatttaaagggtctcctcactccaaggctagaaaggaatttcctcattttttttctttttatgatttcctttttgcatttaaatatacacataaatatacctatatatgtacatatgtaatccatttggaatctatcctggaggtgctctgcatggaataatctatttttatttttttctagatgactacctagtatcctcaaatcatgtattcagtagtctatctttgcttctcctaaatgaaatgacacttatatcatcctttagattctgccacgtgtctgggtttgttaacacttttctgttctgttgcattaatttgtctacctatccacatgccagtaccacttgtcttcattactgaggttttataagtagatctttaatctgcctttaaaaattagatatatttaaccctgagaagcagagtatagtcctaaaaagttatgatgactgattagacaacttctggtcctgggacaccaagaaaatttgaaatgtatataaccctgagacaccaatacaatatgtaattagcacatccaagaagccatagtaactaagctcttttttgttgttgttcattttgtcttttgaggcagggtctccctctgttgcccaggctacagtgcaatggtgtgatcatggctcactgcagcctcaacctcccgggctattttttttttttttagaaacaaggtctcactatgttgcccaggctgatctagaactcccgggctcaagcagtgctcccacctaagcctcccaaagtgctaggattaccggcaagagccacctcgcccagccttcaagcccttttggataacactttagatgtttatttcagaagctactaaaactataatacagaaacacaaattacatcctatacaataactacaacttgaattctatattaccatgctgttttttcccattctgcaccagcctccacccatccctggactgcaactctgcagttacctgttagtctctttttttccaacagagtaaactgctctttatgcaaagccgcttcttacacagtacttaccaacttttaaagggccaaatacgcttgtatttttgtaaataattcatcatattcaaacacgtcagcccttcataagcaacactttcactttgctgtgtagaaatgttttcatcaaagtaaaaagctttttatcactgccccaggaaatgaagctgaggcatccagaacgctctaaacacttatctccctccttcccatcaactcagggtggctgctccacgccaagccatgccccaccagctcgggcatatggacacgctgtgttcacagtagctcagaagccctgggtcactggtgccaactagtgtatttggattacatgaaaatattataaatgaaacaaaaatgaagtttcaagtcatgccagtgaaattttacaatcacattatgtatttcattatttctttccctttaggaaaattaatattttaaaggacgatttcagtcatattccctcacttaagcaccttcactatttattcattcattcaacttattttgcttggcaacatgctcggcactgaggttaggaaaatgaatgaaacatgcttcctacccgcaaggaacactttggctaatgggagacaaacacgaaagcagacaactgtaagcaccagcaaggatggaagcacggatgagcggaccatgacgaagcctaggaagatgcagggaaaaagggttccagggcactggtggcaaccaagaggaaagactcccagtcaggaggataccatgacacagggcagaagcaccagccatgcgctgaatcacactgaggaagtggagagagacagagcagaaaggccagagagctgcagggcctgagagctccacaggagcgcagagggacctccgtctccatcccggggcacagctttccccaccacacgtgtctctaccagcggctctccagaacgcccctcatcaggtctggatccctcatgagccagcaactccaggaaagcaaggcacagctctgatgcagatagaaaccaatgagcaggaaacatgcactaaatatctgcatgtcatggtatctccccacaccgtgccctctggcacctccccacgccttcccccaatgcaaagctggactcagtgcgtaaggaagacctgatccaccgtgccagctttctccgtcccttctcctctgcacaaagccccccagccatgagatcctcctactctacgagccctgacttctggctgcgcatcttgagcctggcgcctctgtccaggctctctcctctctggaaccttgccctcactcagctccacatatcaaatactcttccaccctcaagataccaccccaattggactctactggtcaacttgcatcaagatgagtatctgaattgtgcatacctttgtgtttagtatattttttaaatgcagagtgtatgaacatttactctgccagccctttctccgatcccccctgtacaccggtactgcatgtcttcctaaactattaatttaattgcatcactttccttctaaaacgttcccagtcactcccgtcatcctcctcattgtcctgttcctagcctcccagttccagtctcagcaaggctgggccatcacctggcagccggcctcccgctctccccaaccccacccctgcttccccaggccccgctctcctcctcggctcactctcaggtggccacagtgctgtccaattgagagaaatggcggtcagaagctggggaaagcactgtgaattccatctccacagcagcccccatactggttccttccaaggttccctctctgaggaaaaggtttccttccagtgtccaaagccatctcacgtccccacattctactcgccctgtcctctttaaggtttgtttccacccgacttcctatttcatcaagctccttttcttcagcaaatcaacattcccaagtcaattctccatgcagaaaaaggcagcatctacctgcccacagctgagattcaaaaggccccgtctgccatcctcaccacactggcatcaggtattatccatgccactccaccgcaatctcccgaccgaggccacggacgacctcctggctgctggaactcacctgctctctggagcatctggcttcttccctcttgaggctccgcttctgaactccaggccgtgctaccttccatctcaggatcttgccgggtcacacctctccagggtgctccatggctctgccttcttctgtcctatcctccgacttctgctcactcccactattcactcctggtctccattcacgactgtggcttcaacgactaccttggtgttgcagagtccaaatctctctttctactccggctcatagcacagaattccagcgggccgtccgttcgcgtgtcaaacttcagccaggcacttacattgcacccagctatggttgattaaccaactccgtctgtatttccctcagagtcaaaatgtcactgaggcatctatatactgtccttggggcatccaatcccatgattttagatgctgtgactgcagtttctatgctgcagtcttgaacgatcctttggatcaaatcctcccaggctttgtttatccaactgccttcctagcatatgcatctcaggctgaacaccaccaaacgccacgcctgattccttgcgcaccccacgtgctcctcctccaggcttcccatcccaatcccagtgaacagccccaccatttacccaatctttccagccaaaaacccaggcatggattcttgattcctctctctcccttgacgtccccatatccaacccacctgcaggtcttatacacgccacctccaaacacctcctgaaccaccgcggcattttgcttctaccatcatcgccgtgatccaagttaccattgctcttgtcttgactatgacagtagcatccatggactccctgtatccacgacatctcccttcattcattcaccaaactgcagccagaatgagcttctgagatcataaaccatggatcacccactgctcaaaacctccccaaagcctctgctttcatgcggagtaaactgcagttttttcctctgactgacaaagccttcatccggcccatttgccacttcacttgccactgcctggtgggctcagctccagcacggccgtcaccccgctcctctgccttgtgagccccctctgcctagggtgcttttccccagataactgcatggccgatgacaccttgtcactcagaggccatttctactgcccctgtgaagagagacctgcacagaacaaggcaaggagccacacagctgcacaggccactctccgtgtgcattcgctgtgcagctctcttggtattttttgtttccctggctggttcttgtctgcaccaccagagtgtgggcaccatacaagcagagacgatccctactaccaaggaggctgcttaacacatagtaggggctcaattctcatacttcccattctgatatctcttttctctgggcatggaactactcccattccaaccccaactctctctctctctctctctctcacacacacacacacacacacacacacacacacacacacctttccaatccagaaactaaggagtcagatgtctcctgccttatccaaccagccacctggatgtgtgactattaactgctacctcctgcttgtatctctcccgaccattcatgtgcatggccccatctctggtccagctcctacctcttctcgtgtgccgaggactctgccaccaagatcagccctctccctgcagtcacacagaatcccagctccagcacagaggggattctttctacctgtcttccatagctgtttctatacactcgtctgaggggtcattgtaaagtatccttagcttagcctaagtaatcctctctcctgtcttatcacccgggtccccaacctaccacctgtccaggctgttttccaccctgcaacctcagaagatccctttcccttggcctcagaaggtccttcccaggcttctcgcaaagcgaaggcactgcctcttcacaccttgtgaaacctttccaggacctcccagtcagaggccgtctggttctcactgtctgcagagcgccctacagcctgtctgtgggtgagcgtgtctgtgaactcttgtccatctcttctgtgatctgtgtgctcctcgaaataactgattttgtctcatacaccttggaatcctgagtccacagaacagaggctcatacaaaggaagctttcaaagagtgctcatcgatttctaggtttcttgaagacaggcaccatgttttgttctgtttagatttattttggctttcatctttgaatttccaacacaagtatttgagtaccttctctatgtgtgtcagccactgttaacagtctcagggaaacaaccaaaaaagacactgccctcaggctctcatggagcttcctttccagagagggaaagcaggcaataaactgataagccagtaagtgagcaagataatttcagcaagtggtgagtgctacaaagaacacaagagtactggataccttctgatttccttgcaagattatgagttcctctgtcactgtggagttttcctttagacagacttagagaaatgatcagctggaggagcctaatttacattttaaaaggaaattaaaatgttttgaattacaactaagagttttccttttaagggaaaatattcgttttacatgaaaattattttttctctcagattgcatcagctatttcgaaacaaacaaaaattaacaatgtattcgttggtgaaatgtgcaccgcactatgtttaacctgccgtatagtaaacaaaatcctaatatttgcttgactgactgttgcactgagttttttccctattggagtggaaaaagttttacatgcagaaatgatctaagactaatatactgattgggatagcagatgacaccatcttctaatgtttcttctgcttctcatttgaattttctcatgcaggtttctcaaaattaaaagtgcaatttcttgaaagttaagtattaataacttaaagaatcccaccagtttaaacagctctgccctttggccttaagtcctttctgatttccttaccaaaaaataggtcacccttccacggaggactgtgacactcacgtccacaccctggctctgccggaagaagtcatgccttgctttgctggtcatttttgtaggtgtccatagctatatttcaagtcctttggggtacctgttatcattattttaatctccctcaaacaatttacactcagtagatactcaacaagtatctgtgagttagctgttggctgatttagacccatttccactgctgagtgttgttctcgcattcttctacaacctcagtctccctgagcccacaaacagaagttaatggcgagtctagtgtagtttgtacgtgttaaacacatttgctcttaaaagagatcatatttatctcagtttgttcaagtgtcggccacacagtatcttatgtctcaagaaacagtaagagtggttactgatgagtgtggagcacatttaaactccacaattcctgggagcatacacatctcctgttttgaatatttggcaatcaactgtagtctgaagctatccgcagtctgcattcaccattttttttcccatcttattttgctaactttctcagtatcctccttgaccagccggggttttcctttgtctgtatctctttatgtcatcagagtagctaaccagggaaacacaaacagagagaggtgcgggcgtatttgtggcttctgactgttctccttatccacaggcgtgcctcagagttcctgatctctgcacgccctgcagccgtgttacatcagggcagccacactgatcacctgcgcagacaacctatgttatcttttctagaagaccaaatgccactcacactggtctgtcccacgtgacttctccgctctccattgcacaagcaaacactgggctctctaggcacaagagtttttcctactccgatggcaactttgctcacaagaaagcatgaagctgggtgcctgaggaggaggccagagatcagcaactagaggcagatggcaggagatgaggtgaagtcaggaatggcctgataagggcagagtaagggcactgggcatggtggccactgacccctgggcattaacttcaaacgtgcttctaggggactctgtctctattactggatggcagagtgggaagctcccacagcagcttcgtagcttctactaggcttctttctttctttctgtctctggggcctgggtcctgggtcctggcggtagctcttactaagtgttgtttggtgcatgagtgagcgaaccagccggtcagtgtgaagagccaaaacgcagagctaaaatggacagaagcggagctggcatatcataccctctacacatgatttgctttcgatggtaataaaaataaaaccagcattcatacaaacagtaactggacaaaacagcctttacgtgacaacttgcatatcagaccaacagaagatcaaactgaaagaaaaaaaaaaggaatgacactcaacaattagacacatttgtatgcatttggccattctaaaatttttaaagaatctagaaattctttttcaaaagactgattttttaaacgatacatatcagaaaaatctgtcaaacttcagtactttagcaattcagaccagtggcttgtcaggcagcaacagacagaaacaaagacccaaaaagtaaagagtgtcagagcagaaattggctactctcttttaataatctatccccttcccaagcttgagtgaagtgggtctgataattttgtttaaaagtatcttcttgtttactacctcagtcatgtcccaaataagactgttctaaccttttgctcctgttcaaggccaaagctactgctcagggcaaggtgtggggcgagggggcctttcttgaaagttccctgatgagtctggtttctctgatgcaccagcttctcctagctgggcctttctgcagagtagacccttctcctctccaggtattgtgttcctaaagggagagcctgctacgaatcccgagaggactccaccctctatccagagctgcgatctttcttcccctccacaacatccagcagggccctgaacacacgagccaacagcagtttcagcagcaccaacagaagccccatcatttcaggaccgcgggctttttccagaagcctacgatcccgtgcctcagtagcaccacctttcccccagagcagcttgtcactgcaagatagagcgttcttcaaccccttccccaaatcaaaggtcaactgagaaaagcagatgtttattttcttaagaaagaattcacaagcccaccagataggggaccaggaggaaccccagtcctagaccaggcctataggctgatgccaacaccccgggagagctggtggggccccatcctctaccaccttcaatgcatggccaaagggcacttcagtagggaaaagtgcttctactgaccacatctctggccaacagagaaggccacatgctctgtccatgcacacccatctccacaccccttccccacctagactgcagcgggggtgggaggcagacaccgggggggaggacttaggggtcagaggacttcgggagcattgggcccgcgccccgctagccaatcaagcgcaagcagcgactcgctagccggagcccgcacgggtgtacgagaggccgctgaccacgcggccgccgtggactcgcccgtgcccgggaagcggggttgcaaggagcggccgatcccggcgcgaatacgctcgccagcccgggggctgcaccccaaaggtgcctgagcgggcggtgagcccggagcagcttcggccgcagggaggggctcaacctcgggtgccctggagacccgggtcggccaaagcctgggaatgagccgcagttgggagcgggaaaccgaaacagcaatcctggaagagcgtcggcccagagaaggcgccgcggaaacgcggctcctgagcgaggcgcagacaaaggctcgggtgcacacgcggtggacggtggctccggagccgcgctctgggccgcgggaagccgcacccgccccgactggcgccggagtcgggcgggggcccatgggcgcgacctcctgcacccggaggtgctcctacccggccccgccgcggtcttcccgtcctcaccctgctccccctccatccgcgaccgcgacgcccccctcctctgcgcaccgggcgcctcctctttcctcactgtctcccgcctgcctgcttccttctagcgaacccctgccttgacttttctgctcaatcttgtcccccacccccgtgacatgcctttctgccacctctgcctcagcgcgctctcggccccgcgcccgcgggtggcgaggaggagtggccacgccacagtgggcccgggggcgcatcctgcgagtcggaggcggcggcgcctttctcttccaccctagcgacctattgtccttcccttttctctaccaccccggaccccagagaagcccgggaccaacaggacgcggcccggggtgggggtgcgtcccctgggtggaggtgcaaccgtttccaccccgccagtccatgctctggatgccggtcactgcgcggggtgggaggccgggcgcccactccgagtcctggagaacggcggtgccatcacagttggaagcgcggggttctgaggccctggcctccctcaccccggctacagggacccggtgggctggacccccaagtggaaggaagcgcatctgctccagccaagtggccacaggctcaagagggaggaacctaagtggtcacaaagttgagtataaatacgcgccggacaagtgtggccagaaacggcacgaggggcggagaaggaggcggcaggtcccgctcgcaacgtccaagctcccgccgccctcccgagccgcccttcccccgagcgctcgcggagcctgggaaaccccggcgtccctgcgcggccgaacgctcccgcgctccgccaggggcaccggctcctgcccctccagagaagccccctgggcgctccacgcccgggcacgggcacctcgctcgacacccgcttcccacccagcaggccaagccccccacctgcccccaggggatgaggagccgccccacctccggggaacggggagcaggccacttactggggctcaggaagcactcggtcagccttcggaagcagctcgcattattagaaggtccatcttccatgtcggagccgaagagcagcgcggccgcggcggcgagggcgaagctggcgccctggggacgccgcggagtttggccgccgccgcctgg

SEQ ID NO: 1716 - DNA, 334814 bp, Homo sapiens; identical to SEQ ID NO: 1715
